United States Patent 7,745,391 (HUMAN THROMBOSPONDIN POLYPEPTIDE) - sequence listing, part 199

SEQ ID NO: 469521 - DNA, 556 bp, Homo sapiens
aaagtttgaaaaccatgtgtattagtccattttcacactgccattaagaaatacctgagactggatagagatgaggaacttgttgggaactggagcaaaggtgactcttaatgttttagcaaagaggctgatggcactttgcctctgccctagagatttgtggaaatttgaagttgagagagatgatttaggatatctggcagaagaaatttctaagcagcaaagcattcaagaggtgacttgggctgacaatgtgatagaaaatgaaatcccattttctgaggagaaatttaagccacgtgcagaaacttgcataagtaacaagaagccgaaagttaatcaccaacacaatggggaaaatgtctccacgggcagtgcggaagggaaatgtgggaatggtagccaccaacagcttgcaccatatgcccagaaaagctgcagacactcagtgccagccataaaagcagccaggagtgggggctgtaccctggaaagccacaagagtggagctgcccaagaccatggggacccacctcttgcatcagcatgacctgga

SEQ ID NO: 469522 - DNA, 736 bp, Homo sapiens
gctttgccaacagtcatgctcatgatggagattgggggacaacttcagataagaccgtcatggaaggcttcactgatgaagcaatatgacagcttcactgatgatggcttcactgatgaagcttatgcccatgaggagggagtcagaggaagagggggcaaagggcagcagaaagaagacaagaggagcacagaactggaaggcacagaggagcagacccatgttgaagcagggacgggtgatgaaggtcatgctggtcatgcagccacatacaccatggagagccagttggagggttgctgccagggtgcctccaggatcgtggccaaaggtatggactggttcatgacatatttagaagatataattagaagaaggcagttcttatcaaatgaaaaggctgaacaagaaagaggggatgaggacatttcccatccctttggaaactggaaggatggtgatagcagctcctggactatggaaatgtaggaagaaacactgatagaaagctctcaggagcaagattccattaatgaccccatattgcttttgttacacttctttagtctctctaaatctccagccacctttgtcacatgattctcttgagtatttgatattgactcattaaagaaaccaagtcaggttgcagggtagaatacctcacagtctggatttgtctgattgttttcatcccatgtcacttctaacttgttcctctcttcctcacatttcc

SEQ ID NO: 469523 - DNA, 1168 bp, Homo sapiens
agtagtctgacagcaagaatataatgctcaattctaaactggagaatgacacagttaattttgatgcaactaacctaaaagataagcatattctttctcaaccactttgtaaagctgaaagtaaattcagtagcctagaaattgatctccatcatacaagagatgctctcagagaaaagaccttggttttagaatctgtacaaagaaacctaagccctcatgcatggcaccagagagatgatttagggtatgtggtggaagaaatttctaagcagaaaagcattcaagagctgacttggatcctgttaaaggcattcagttttacaagggaagcagagcataaaagtttagaaaatgtgtaccctgactacgcgataggaaagaaaaacccattttctggggagaaagtcaagccggctgcagaaatttgtgatagcggccctcatggagaacctatgctagtggggaagggaaatatgaggtcagagcccccacacagagtccctactggggcaccacctagtggagctgtgaaaagagggccactgtcctccagaccacagaatggtagatctactgacagcttgcaccatgcatctggaagagccgcagacactcaatgtcagcctgtgaaagcagccaggagggaggctgtactctgcaaagccacaggagaagggctgccaaagaccatgggaacccacctcttgcatcactgttatgactccggcgagcctgtgtttctgggagagcgctacggctacggcctgggcactggtggctacagctacatcacgggaggaggaggaatggtcttcagcagagaagccgtcaggagacttctcgccagtaaatgtcgatgctacagcaatgatgctcccgatgatatggtcctgggaatgtgctttagtggcttgggaatccctgtgacacacagccctctcttccatcagactaagaactgtgttgacaggctccaggggaatgtccttaaccaggactgttaccctgtttgatgtacacactgtctcatcccagcacagaatttaaagccataccaccaaaagtacctgtgtgtgttaatatgtttttcttgtagcatagattgactatttgcaatagtattagtatttaccatttttccaaattagcaactaccagacctcac

SEQ ID NO: 469524 - DNA, 618 bp, Homo sapiens
acttctggcatttctataggcgctcacccgaaaggcaaggtgatgttaagcagtaatgactacagaatgaatcgtgtctgtgccaaatgctgtggaagagatgttcaggatgctgtgagaacatgctgcagggagatagatggcttttgcctagactggggagatggatctcaacagggagccatcttgcaccccagggaacagtcaggggtgctgctgaacatcctacaaaggcacaggacagttccaccccaccatcgaacaattaattatcggatccaaaatgccaacagtggcaagcttgagaaactgtggggtaagggtcaaggaaggcttcctagaggatgtgacgttagagctcagacccgaaagggaagcagaaatcagctaaatgaagtaaaggacgttaaatggcctcagcccgttgtgaaaatagccccattcagttcccttgagttcctgtctagttgcccttcccagtgtgtgtcagacttcagcacacatgagaatcatctgtgtgtcctaaagaagcctgtatttgttaaaatgcagattcctgcgttccagctccagattttctgattcagaagatctgaaatgagacttccaggactctta

SEQ ID NO: 469525 - DNA, 618 bp, Homo sapiens
caacagcgaaatccaaaagtccagaagagtgccttcaacagactggatgaggcccacccacattggggagagcatctgctttagtcattccaccaattcaatgttcatcccatccagaaacactcccacaaatacactcagaatggtgtctgaccagatatcagggcaagttgacataaaattaaccaccacagagctaaaaccaaaccaagccaaacaaaacaggtatctgacaggaagaggaagaatggcgagtcagaaaaggcagaggggaacaggagaggatggtgtcagaagcttggctaaaatggaaaatagaagcaaaaagcacagtctgtgggtgaggatgaagggccccagacttttaggggccaaaaccaaaagtcccaaagtctggcacggcatttgtttggagaaacatgggctagtctggagaaatcataataatttgatcttgccttttctggggttagttttcatcctgccttgtaaaaaatgaagccactctcccagtgtttacttttatcctcctttctcagtcttccttactaggttcgtttctctcccctcttctctaggtgctcttccctgggctgcaatggtttgtgctatactttt

SEQ ID NO: 469526 - DNA, 1567 bp, Homo sapiens
aggtccaggaaaaactctgtctgagctcttgtaggatgggcctggtgatgacaaaatctctcagcatatgtttgtctgtaaaggattttatttctccttcacttacgaaggtccctcagctgcaggtctgttggaattcgctggacgtccactttagaccctgtttgcctgggtatcaccagtggaagctgcagaacagcaaatactgctgcctgatccttcctctggaagcttcgtcccagaggggcatccacctgtatgaggtgtctgtaggcccctactgggagatgcctcccagtcaggctacatggggcatcccaggtcaatctcacactgctgtgctagcagctagcaaggatctgtgggtgtgggatccaccaagccaggcacggggggagtctcctggtctgctggttgtgaagactattggaaaagcacagtatttgggcaggcgtgtaccattcctccaggtgaggcgacaccctgccctggttcagctcgccctccatgggctgcacccactgtccaaccagtcccagtgagatgaacgaggtcctatttttctgagattttattatgactaggtattgaatattaacagatgcattttctgcatcgactaaaaatgagaaaacaatgtttaatatacagatgacctccaacttgtgatggttcaacttatgttattttttacataaaaagagtttatggtgattataattggaaattattaataaggctacttcttgttatgccatcatgagaaaaagaagaaatcaaagtatgtcttttagaattttctttcaaaacactatgtcactgcctctttttccctgttcctgtcaatatcctgtgtagggccttatattcaatcaatactaaagaagctttaaccttggctaaagactgactttgttatttcatgggttttagtttgatttccccatctctgaaagcacgaagaagtgtggacatgatcttacgtgtttgaagtaaaatccttgattgtatacaaaatactatgttacagatattaaagataaccatatcttcatattggattataatttctatgtgaaggcaatgtagccatcaattgttaaagcactgattgtcaatgttgagtaagctgatgcaactaatcaactggccatctttttccatcttgatgactatccaaatattctatattttaaatatcattcctgaaataacatttctttgattgaagttatgttgtaacacaaaatcttgaccatttgagaacccaaataacttacatacctaaaaaatttcagtggctttttgaaagttatgagatcttttgatgaaatatcatttaactatatttgtaaaaattcaaatgattatctgttcatatgccaataggtatctctaaagaataattataatatattttttaaaattgctaataaaatgttttatttttagggtaaaaatgattgattttagattgataagtttttgtgagatttagcaaaataagtgaattatttttcccctaatgtgaaaatagaatctatcatttacaaaaacttgaaatgtt

SEQ ID NO: 469527 - DNA, 796 bp, Homo sapiens
gcaacagtccctatttattccaaaattaagctgtggcccagttggcccgcggaggtgcaggtagcactagagcaggtggaggagcatggactgccccgtgggcaggtgggtaacattctgagagcacaagagctggtaagcaacgctcttggtggctttgagcatgtacagctccatcgggtagtcatccccgggcaccagtgagttgctctggagccatatcataggcagagatgatagccgcctctttctgctgctcatccttttccacctcaaatctggccatctctgcttcccgctgagctacctgtttggcttccactgcttctgtgaacgccttcctgaaggtcacatgcatcaaggacatgacgtccaggatgagcccagagcttctacttggatagacagagcagaatgtggagactcacattatcaacttttgcttcaagatgaatatgccaagaaagccgagagaatccacagaccctttgaaggaagtggattgctcctgcaggacctgggagacagcccaaacactgtgagtgtccaaactgtgaaagtgggaaaaggggatcatctgcccctgaatgcacaccctcactggggaacaggaactgggaaaagactacagggagaaggaaacctccagctgaattttgtaacaattccaaatgaatgtgaagtttcctggcagaacttgggggaaggcagaattcagtgtgaagacatgacaggcaggagacgcagaagccctgcttgctttctgggccaggaggccggtagcctggggtaagtt

SEQ ID NO: 469528 - DNA, 698 bp, Homo sapiens
acgcataccgggatccttggtgtcaaatgatttcatttcagagagtctggcgtggtgtcagcagccttgcatctgtcaatgagatgtcatcgtgaagcaattacgaacacagccaggggtcttgcaagaccatggagggcaagttttccgtgcgactggttaaagagtgatccacatcctctaaggactggggaagcccatggtaatgttgacatcattttatcaaatgataattctctcaatctgcctttctggtgttccaagtctactacaaaggtggcctgttataaagagtggacatttggccacattggaaaagcaagcctatcttcttggcctaatacagtattccagggtgttgcacactgtgacacttctgctgagatagcaccagtccaaggttccagagaattgggtgaggctgtgggaaactaccgagaacattctcccccaaagcttcctgtgggcggcactggacatcttactgatactgtctgattctgaaatttgggacaatcccacttaatttacgttgattatagaagctcaaatatttttcctagtcttcaatagtttccattaccttcccaattttcttttatccttgtcttccacttcaaagagtgaaattgtttccttaaatcaatccattcagtttttcattcattcagttacttattcatgcatgtctttattcc

SEQ ID NO: 469529 - DNA, 536 bp, Homo sapiens
agagatcttttatctctctcctggatcccatctccctgttagtccctatcccagagagcactaatgtgacacaatgaaaataagctgctcagatcttctgctgcagggagcaaagttgatgatggttccagctgactcccttctggatttactgctgttaacctgccttcctcaggcaggtgaagaaagtgggaaggataatcaagaagaaagaacagaatgttcaagttatggagtgatgcaacggtataagctgattggagatgggttggtgcttgaccaaagctgggtcaatcagagtggaggcattgttggcattaagataacttggtcttgtcaagctggagtgggtgtcatcttctggccttcatctttctttcgtgctggatgcttcctaactttgaacattggactccaggttcttcagcttttggactcttggacctacactagtggtttgccaggggctctcgggcctttggccatagactgaagattgcactgtcagcttccctacttttgaggttttgggactc

SEQ ID NO: 469530 - DNA, 927 bp, Homo sapiens
tcccccgatccgagtcacggcaccaaatttcatacgcctccactagggagtgccctagtggggactctgtgtgggggctccaaccacacatttcttttctgcatttccctagcagagctctccatgagggctttactcctccagggagactctactcctccaggtgtttgaaagttcctcctccacatgctctctctctctctcctgccaccttgtaaagaagaggcctgcttccccttctgctatgattctgtccatccacaggaagcaggcagctggccacagtggctgcagtggcacccatttctattttgacccatgggtctatcagtttatgttgattcgcattttacttggaattccttgctcaccccaaattgctggtactctctcaggcaaagctgtgcacttcagttctccttatgtgcaaacagtttctcagcagtttcttacaaaacaaaacatactcttgccatatgatccggcaattgtgctccttgatatttacccaaatgagttgaaaacatgtccacatgaaaacctgcgcatgaatgtttatagcagctttattcgtaattaccaatatgtggaagaaatcaagatgtctttgaatagggggatagttcacgtggtgttgtgtccggaattggttccttcctatgggtttttggtctggctgacttcaataatgaaaccgcggacccctgcgaaggactgactttgagcatcatgaattaaactaaactctaacactgagcaaagaaaattagaatattttcatgtcttggctgttagagtacttgataaatataaggaattattaggccttttgaaatagctttgaaatagcacagatttgtgctgtatccaaggattcctgacaatgtaacagaacaacattgcggtatcatgaaaaaggtgttgtgt

SEQ ID NO: 469531 - DNA, 1199 bp, Homo sapiens
gcagttggataaaaccctgagaggaacgatgggacgctatgtgtttcctttgcttcggtgtcaggagcgctcagacaattgccagaaggaccccagggggaagcggaggcagggacagaacagaaggataagaaaattaagcatccctcttaccaactcacatcagcagtcaaactgtgcatgggaaaggttgttaactagaaacctcgagaaatatatggatacaaagaattccagctgtactcatgtaccacaagacatgatgattcctatgaactttctaggaatgaaaatgataaatctcttcaatttcagcactgcttctttgatatctatgcagtgcctgccaaaagcaagaggagagcatgtgttacggagacagccctgtttgggcaggctgcatagctctgtggctagaatgccaccccagacttttccatgtgactctataagtgatcttaggctagtcattcctagcccagtgcttaatagtatcaatggacaaccagaaagcttgtccaaacagctaatgactaataggtctcattaatcatttagttttctgactgttaatttttagcaaataatagttcaatggctactgcaccaagcattgtgctcagtgtatgtaaagaagaaaacaatgttcctggcattaaagaggtcattgtccaataaatttgccactcatatgaacttataaatcctgccactgatggctagatttgagactttgcaaaagagaagctgaaacactgggaaggcatttaaccctggttgtctaaaatcatgtgagctggtgacaaagctagacaaggggtctagtgtgtccctcaggcctgtcttccactactggactgccttgtaaaatatggttgcatcatttcaggatgaagagtagcgctgattattggctaattttggctcactgaggcttcgttatcgagtgtacttcctgagagccctgtatttcctggtttaattgtggctgatgacgtacttgtaaccaaggcacttggctcagcccaagcacttctatctggctaccagggtgcctgccaagtaaacaagcatttttctgtgctatgtctaaaaaaaaaaaagacgatgcaaagattaggggatcatggaggatgggaggcaggactagattgcagctctggatagagcagcatgcgaaggcttgcattgtgaatttt

SEQ ID NO: 469532 - DNA, 744 bp, Homo sapiens
cgaattttcagagtctctactgcaactctgggccacatgttattaatcttctaaatatgatgaacatgaaggctgagaaacagcaggacagccatgctatgggtgcactcatgccattagtggaagtagactgggaagtggcattttgtaatgcaattgtcatcccctctcctgtgcctgatgtcacagtggagcctttgaatgagactgccgctccagccaatagccgcactgcagccttctcagacatcttgagccagattaacccagttaagctgctcctcaattcctggcctataggaaccataaggaggtgggaccttttgggaggtgattcggtcatgggcgtggagccctcacaaatgatatcagtgctcttaactcatttgtctcttccatcatgtgaagacatagcaagaaagcctaactgtgaaacaggccctcatcagatgctagatttgccagagccatactttggacttcccaacctccagaattgtgagaaatacatttgtgttgttcagaagccacctagttaatgatattttgttatagtagcccaaaccgactaagacacaattgaagcatgtgaggcaaatgtctactcaaactattaagcaaaatggattttcattttattttttaatatttctagggataacatgtaaaaaatgtattaagaaagtcttgtatactcacaattataaaagatatttctttgtgttttttaagtatactctttgg

SEQ ID NO: 469533 - DNA, 1841 bp, Homo sapiens
acgttaggaagagacatcaggtgaaaatgatttttctaagacctagaagctggattgatgctttcaggaatgaaccaaatgtgaaggataaatgtgtcaaactctccctgggatggtatgagttcactcatgcagtgcacagagcagtgcctgccaagtcagaagcacttgataaaacaagctatgattatttttattatttgcttaatgatgaaagaaggctaaaaattgccagttctgaatggaaaaccttgcatcatctgctatttctggaaacacgaaggttgctgcttggtcccctggtcacaatgactttagaatctagagcagggaagtttaaggatgatgtagttcacgaggcagagatggggcaccattctttttgtactatcctattctctgtatgctttgatggcctttatttttatttgatttgaattcctcacaacatctttctcattgatatggaattgagttttgacatggttattgttaggcctgctgtcccccgaggtggctgtgtattaactgccatggcgcatccttttgcagcccctctgtggctttccttccagcctaatgcactgggctcatttcatcttgattttcaactgaattatatttactcacattttccatacagtgaagtaaacgttgattttattggctcattcattgcatcaactgtacttgtcagctttacactcacaatatatttgtaatctggtgactttttaccacctttattgccaaaactccagtctagtcatctcttgcctgtactactgaaataacctcctgttattaaactctattatcatagccattttgcctagtatcataagcacaatccattagcaacttcagatgtgaacacaaccaattgacttaagtaatcatgaaatagataattctttgtttaagtatgacactctgtcctttcatctttaggtcttttactatcctcatttggattcagaaaagtgaaggaaacattaaaagcctctgagttttcaatgtctcctgtaaacagcattccctcttcatataataaaggaatattttttcatttttacctttatcccccagtaaaaaataatattatgatatttttagatctaaaaccccaaaatcaccataaggacaatgggacttgaaactaacaactaggcgatggcagcatcctttagcctgagagctggtctttccatggctctattaacaaaactgctggtctttccgtataatgaacagttggctaaggcaagagcagacatgaactaactacttttgaccagtggaattttgggcatgtggtagaaatcaaaacttactcactgactgggcgataactcttagattttccctttgaggctattttcttgatcctataggtgtgcgtcattgttttttattctttttttctctggtttcctgactatgtatttcaaaatagcctatcttcacactaattcttctgtttgatcaattctgttattgaaagactctgatgcattcttcaatatgtcagctgcatttttcagctccagaatttttgcttgattctgtttaattatttccatgcctttgttacatttatctcatagaattatgaactttttctctctgttatcttgaatttctttgagtttcctcaaaacagctattttgaattccctgtttgaaagttcatatacctcgatttcttcaggattggtccctggtgacgtattttgttcattttgtgaggtcatgttttcctgaatgtccttgatacttgtgcatgttcttttgtgtctaggcattgaagacttaggtatttatcatagccttcacagttt

SEQ ID NO: 469534 - DNA, 1332 bp, Homo sapiens
ttctcctctcccctttgtctttctcgcaccacatcttttgtgatttcctcaatgtctctgaggcaccatctccactagcatgctctctaactcagactcagtgaaatgtggttcttggactagagtgtcctattacattgtctgcacaggtaaaccaataagcccagagaggaatgagacaaccagactgactcctttgctggaggagcagggcttcccaaaagatcaggaggagatctgctctactctttcctattctccagcagaattctggctatcccagtgttcctccagcatggcctttactcgttctgattcaatgaggaatgggaaagttacacttttcattctttccagatatttctggaccattgtggccccagacccatcagcctcccaggcctcagaccccagtgggacccctatttacttcccaagagctcgtagaacatttactggagactgtgggaaaatggccacttggaaatgttattttaaatcagcccttccggtaacaacatgaacattctgtttcataatctttacattggctctttccacatgcagtctacagtcaaatcagtccaaaattccagcaatatcactaagctcttcatgcactctcagaatttcttgtgtatagatttacgtccactagcagatcgtgaccctctatgagatcagagactatatcttatctcctagtgcccccaaatcaactttagcaatacttcataaataataggcactcaataagtgcttgctaaatgacttcattttaattttcccttttgcccgtttaaacccttgaaggattttgttgtaattaccttaaaatcagtatttaaccttgaaagttttagtatcaaatgcaaggttgaagatttcactgtgcactttctttctgtattatttttagcaatagaacatatgatatgtcctgcatgaatccctggaggcctcaatgtcaatgaatctttctcctaaaatatatgtgtttatccctgatctttgtctcgtttctaaataatgtcttcctaaaacgtgtaaagagcaaatttaaagaccttgttgtatacaaccttggaaaaagctcataatgggactttaagacttctgtcaggtctattttgtccacatattaatctgcccctctacttctgtaacactctaatgggttgaccagttatcatttctccttaaattaccttgcctttttttttgtctccatgttagacaaattgcccactcaccaggctagaatgaccaaaaaggtccactaggatgtttctagtgatgaaacttacattggctaatcccctgccctgtaac

SEQ ID NO: 469535 - DNA, 922 bp, Homo sapiens
taaaactaatttcagacttctctctccagaactatatgagcatatgtgtgtattgtttgaaaccacaaattttttggtaatttgtgacagcagctataagagagcaatacaaatgagaggaattagacagctggggctggaattgcgagtggggctctttagacatctcccccatttctgtgtggtaaatgccagcagctgtgccaatagaaaagggatacctggaagccaggcatgttcaacatggaagcttcatcttcctttctctttgtcaaccatgtgtgcagtacaggaacaagcaacttggcaccggccaggacacagcatttgccccttctggaggataagaaagaaagcaccattctggaagcagagagcaactctcaccagagatggatctgctgatgccttgatcttggacttcccagcctccaaaactgtaagaagataagtttgtgttctttataaatgactcattcttgggtattttgttatagaaacataaaaagaccaacacaatgggttaattaaattgtataatcagagactcacgggaatctaaccctgtatttctcctagaagcaatggttacaggagagtattcatcaacttagtatttttcagcaactttatataacacaactactgtgaaaaacaagaattgactgtaagttacagtaataatacccctttattcttaaatcctttgtgtgagtttcctaaaattataggtattcttttacataaccacagtagaattatcaaaatcaaaccattataactgatatagcttatttatatcatctataaaccatattcaggtttccccaattatctcactgatgtccactgaagcaaaataaaaatatgtacttttcttcttggtccagttcagcatcatacattgcatttatttacccag

SEQ ID NO: 469536 - DNA, 633 bp, Homo sapiens
tgagaacgggccaggatgacaatggcggctttgtggaatagaaaggggggaaaggtggggaaaagattgagaaatcggatgaggggatttactggtttcttccttttcttttttctttttatttcttttccaagagctcataatctcttgcttcttctggtgtctgacttctggtgtttgaaccacaggctgggatgtggcataatcccatttctctcccttattctttatggagaagccttgagtctgtgtcttcttccaattttgttaagctgtggattaagaaatttaattaaagagagaacaatcactgatcccaacccccagaagtactatgagtggggaggaaagttaaccttcaggacaagagtccttccacagcacagaaccatggccactcgggatagtgttagaggcattattttcaaaatttcaaaatccagttttaaagatgctccaaaaagaggagtccgtcagatgtcatgttgactcgctctgctttcacctgtgaagatgctgatattatacaagtatgtatctgtcactggttggctcttacctactcatattttggggttcatgagcatattttgttacctagattttttattaatttcatgattgttggaccct

SEQ ID NO: 469537 - DNA, 696 bp, Homo sapiens
cgtgagtcccgggaaggggtcaggaaaatatccttcttcaatatgagaaaggtggatgcatcatcaaatatacacacagaatatttactgttcttgctaaatagcccgacttttgatccagtgcatggattgcctgccttgccgctgttcccctttgtagccatagctgttcactgcttcatcaccccctaccccaaatctcccttccaaaaatgccccagtgcactcccaattgaggtacgatgccaggaatttctaatgccatatgagaggggacttgaatctggaatagagtcaaaagagtcaaagaaactgccaccaatgaatgaaaatgcccgggatacactatgcaaaataatatttttgtcagaggaaattgaaagctaccagaaaacacagagcagagagaacagccgggagactatgacatcaagatatttcaaatgtggaatttatgactggagagtcgtttcaaaggcatctcaaccctttgatcttaactgtggcaggatcaaagtcccattcggccactttcccactcctctgcatgcctttgagttcttgccaaaatggaagaactcaaagttgatggtggctgaccccatcgctatagcaagctctgagtaaacagctgtggcctgttctaatttggttggtctttattcccatgcgaggtgacatgtgaatgaagccttc

SEQ ID NO: 469538 - DNA, 667 bp, Homo sapiens
aaatcaagttgcttctctccaacatccaaccatagtctccaatgtccaactacttatcctcctctctgctggctgagtctggggattttatggggtgggccatgggtgattctggaaaaggcaacattcaagtggggaaacatggatgtaagctctcactttgggccaagcagatccaccaaagtggccataagcatcctctcccaatccggcctttgaagagaactcacgtgcatcttacagcttcctctgacagcaacggtgtattgcctgtcacactctcatttggcaagtgtaagaagattttgaaaaagaagaatcaagttggaggaatcattgtacctgattttaagatttactatatagcagttatcaagacggtatggcattggcagagggataaatgcatagatcaatgggacagaacagagaacctagaaataaaccacacacatatgctcaaccgattttaaaaagcactttatgcctcatattagcacaaaatcatatttttattgatttcagcctcttttgcctctgggtttttgtttgcagtgccatttccgcaaactgtacatttcttgtctcttcagagaaacttcactgactcttccagcctgaagtagtatcttctacttctaagcttaggaagaagcatttcatattt

SEQ ID NO: 469539 - DNA, 1056 bp, Homo sapiens
cttatagagcatgcaaactcaagcccatctttatttttcttaggttcatcacagaggcacagggctcgtaagacacatgggcctgctgtgtcagagccctggcactgggaagtggtcgactcatgggttggtaaaaggaatttaccgacaacagtatagaacgcccttttttcaatcctccctgcgattggctacttttaggatcctgctgattggtgcattttacagagtgctgattggtgcattttacagaacactgattggtgcattttataatcctcttgctagctacagagcgctgattggtgcgtttttacagagtgctgattggtgtgttttacaatcctcttgtaagacaggaaagttctccaagtccccactcgacccaggaagtccagctggcgtcatctctcaaaaggacgaagcacgcttccttctacctgcagctgagggaatgtggtttcaagacagccactcagagagcttgacacttattccctagaatttgaggaaagcagaaacagatatctgatgcaggcctcaaaagtcaaggatgtgactccctggcctagtggagagggaaagtgccacagctatgttcatggctgaggcccgtataaacaaaagacagattaacaggagaaaagcatacaaatttatttaatgtaagttttacatgacaccagagccttcataaggcaatgaagacctaaagaaataggtcatagaaacaattaagtgtttttatgccaagttggatgaggagtagagagtcacgtagaaatatgatagggcaaaaaagggtcttgcctgactacctgggtcataactcaagtacttgtaaagtcacggagctgaccatcattgcaatgcattatgggctgcaacaaaatgcagcaagacaaccctaaaaaaaacacctaaaagccccaacccaatgaccaataggcgacgtccgggaagattctgtaataatatttactttatatgtataggtgcttcagtgttgggtgcatatatatttacaattgttatatcctgttgctgaatttaccc

SEQ ID NO: 469540 - DNA, 1902 bp, Homo sapiens
tcatcacagtctgaggcagaaaggatttcatcaagcactcaactgattgtgtctgaagaaataacaacccaaagagcacccaaaatggatttatttagcagcaagaaaaatttttcattgaacatctttaatacattctgttcagaagaagaagaagagggagagggagagggagaaggagaaggagaggaagaggaagaggaagaggaagaagagaaagaggaagaagaggacgaggaagaagaagaagaaggagaagaagaagaagaagaagaagaagaagaagaagaagaagaaagaagaagaagaagaagaagaagaagaagaagaagaagaagaagaagaagaagaagaagaagaagaagaagaagaagaagaagaaagaaagaagaagaagaagaagaaggagaaaagactggagcctggagctccttttctctctgccatttagggagagaactgtatattaaaaatgataccatgaggaagtttttaccatgaggatattatggaaactgaccaattattctaaataaattaataatagtaatagtaacaataataatgaggcagtgttagctgcaaatgtatttgctattgtaaatacactttattttttaataaaataaactgagtttatttttaatttataaaagaataaagtttataattcatatgtaaattctataatgcatatgtaaattataaaatttatactataaattatattatgtttacattagaaattatataagtatattataaattatatttaaataagtagaaattataaaatcataaattaaaatgattataaatatattataaaaataaaattatttaaataattatttagttaatataattatatattaactatatataactataattatattaactatacataattataataatcacatattaactatatataattataataatttatattcactatctattataataattatatattaactatatataattaaataatataattatatacaataatatataactatataatataataacataactatatataattatatgtaatcattatataattatatattatataattatagtacattctaattgtataatattaattatgtaataataaaatgattatattataatacttgtctgaataaaaaataaattatattaaatgtggaaagattattagctcaagatgaaaattgatttaaatcatccattataaaagaggcatggaaaacagagagtaatacaaaacaattcaaaaccatgctcctcttccttcttactagctttattcaaagaaaatatatacatggcaagtatttggcaaatatttccatcctgtttagaagattggaaatctgagacacaaatatttaaatattttactcaagactaataagaaagtaagtgatccacatgaagaaagtgttcaagctttcccgtcctttaactttagttcatgctgccccttgtaaatgtttatcatttatcttcaaggctttctcgaatagtaccatgtatagaggagctcatattatttgataagttagcattttcttaacaagtctctaatgtaaaagacaagttcaaaattccacatttccactgagctgtccacttaaaatggttaagatgataattggcttaagtgatgtctaagaaaacctaatgtgatagagttctgaatagttttttaattgacagatttcttctgaaaactgagatattaagcaaaacttgttatcatttcaagttacttccttgtaaataatttttaatagcctataaatattagatgtttacctaagcaagaaccttaaagttaaatgcagggggatttttgccaatagctcagaggattcagctacttttattaaa

SEQ ID NO: 469541 - DNA, 620 bp, Homo sapiens
gcagtgggcacacgtcccttagttccaggctgcacgtcgacccccccagaggagaagagtttcctggaggccggaaactcctgcctgcctaaccccatgggagacacaccaaatggtgggccggctcctccgagtgctgctcggaggagggtggtggtggtggtgctgctgctgctgctgctgctgtttcttgctaaaaacagaaaggaggaaacagggataaattcatccctttcttaccctcatctcctaggaacccaggacctttactgcttgaggctcagaaaagaagagtcagtgtgctccaggcagaagaacacgtgcaaaggcactgaggcagagagtgtggtgcatttaaggaactgccagttcctctatttcttctatgagtatctgacaagtattggtgttgagggaacaggggatgcaaagagagataaaacagagacccagggttacacaagtaaaatagaggtatcaataaaatccattaaatccaaaggatttctcaggactccaaagatggatttgaacttgtcgtttttcccttattgatatggtttggatgtttgtcccctccaaatcttatgtggaaatgtgattcccagtgttggaggtgg

SEQ ID NO: 469542 - DNA, 663 bp, Homo sapiens
ctctgcaggccatgaaggaaaaataatggacacagtgacgtgtaaatccactgagcaccttggacatcacaaccagagggtcatggtgggcctgcatcatcgggctcctctgcttccagaggcttcctcctccaaacaagatgccaaaggaacctttcaggcactgaagcacaatgagaaggacagagcagattataataaaaaggcatcagctgctcggcctgaggcccaatggtgcatgtcccctggagctcccagtgtgggtcttaattcggtgatgggactgaagagccactgcgtgtgggcaccagccagctgcgggcggatgtccaaatacacagaacagaccatttctaccttcatgagtgagctaccccactggggtgcaggagacacgttaccttctgatccacggcaggcaggggtgacttcagatctgctgtatgccatgcttctggcttttcacaggcaaactagagctcagtggggtgccctggggggagaccgtgaggcaggagcagaagcagaagccttttagaagagcctagcatattggagaccaggagaaagcaggagaataacattttatagcattgtatttcgtgcatatttcatcatgcaaataagagtgtgacaattagtttctctcccttggcagcgcct

SEQ ID NO: 469543 - DNA, 760 bp, Homo sapiens
ctcctcactgaccatgactgcttcttgtcttggctgccctgaccatggcgtcaaactggcctctcactcattgtcatttcctgcaggccttgacctagtagatggtcaagaagtgatgcatgtgcaaaagctaatgcatttgcaagagaaaaatggtgaatttgaaagactggggaaaaaagaccaatgtgctgccatgcaagaagcaaagagtgacaatgcagaacaatctgttactgaagtggagaaagagtcctactgtttgctggtgagtcacacacagagtcaagaaagcattttgagcagtagagtaacccaatatttaaaattatatgcagcagctctttcctgcatgcacaagttccctccaggacatttttgcattcattcctgcagagagtcctagctatatccccaatctaggaccaggttttatgaaaaaaaaaaaattttggtttggctgctgggtagtggtagtttggtttggattatatgggtagtgtaaatttactacccaaaactcggatgaaacgtggtcttgtggttatggatttgggggaaggagggtctctttttctctactcaaagacaaactagcttcctttatctttctgtgccagtgcacagattttcctactcaaaccttttgctgagggtacagccatttaagcatctggattaaaggaagggtttggctcatttgaagctctttttcatcagctcatggcctcaagtcctattgccaaatgaacattaaaat

SEQ ID NO: 469544 - DNA, 826 bp, Homo sapiens
aggcctgagctcctcagaaggatggatgatgacatgagcccagtggcgctgtgcagtgccaaggacccaggctccttgagacttcttgctcttcatctttggtcgctggctttcatcctcaaactcacctcatggtgcaagatggaaggagcttcagcagccatcattctggaagagtcccactatctagatgcagcttgcagctacagtcccccaaggcatggtgtaattcaagctaagctgcttctagagaagacggtcttaggagatcttggccgccgtgccaataaagtgactcaagaggctgctcagctgcccccagaggtctattatttttatcaggactgtggaaagtgggagttaaatcccttcagccaactttctttcatgtctcattggccagaactgcctctgcccaagcctcaccctggaagggaaaaggagctaccacaattggcgtaaacttatcttgatacaccgcttagggctggagctggggcccattttccctaaagcacttagcgacgtgtaggaggctggacacctggtggaaatcttaatctttctgagactcagttcatctgtaagactgaactaatagttgtgtgtacttcacagactggttgtgttgaataaataagataatgggagctttgtagatagctaagaagataagctctatggcctttcagacactacagaagataagcaaacacagtgtaaggtagtaagaactgtagtgtaatgctagatgagactggacaggcaacactccaggaggatgctgaggattgagtcttgcattggacctgaaggacttagtgga

SEQ ID NO: 469545 - DNA, 880 bp, Homo sapiens
ccgccgttcattttgccctgctttggaaggacggttttccagtttcattacccacgctttcgaaagtgcctttgggggaagatggcggcagcacccatggcttggtaagggatcactcccgactgattctgacaccctgttcatggagaaccacggggctttgtggaagggtgtagtcaagggcagatccagtgaatataagaaggcgagaaagaccagtgcacaggcaattgaacgagaaacaggaatgtcggaattcgagggcttaggagtgaagcatttccagcttgcatcaagaggactgatgaaggagaagccagccgttggaggggaagctcagggagtgttcctccaggatacgaggaaggtcgtgtacaaagaggctgaaaaggctggggatggttttagggcttgtgggacttttcatcagatcttaatacagctggtgcagaaggcaacaaaaagtgggataagcactctgtgggacaaccttggacagccaggcctcgtcctgggtggggggcagaacaggcgtaggcccgtggagacaggggaatgggaaagacagccaactcatttacaaagaggagagacaattgctggcttagaaagctgtacagagcctttactgtttctaggaggagagactggagagggagatgacagcccgggatccgccatgctggaggtgaccccagagttgccttttattacaaggacctttacaaacgactcaagtctttcattcttcactttctccagatgtggttttgaagtgtacagtgacagctgatgcgtttttgtgacactgctttgatttgtgctaaggaaccagcagttttacctaccattgcttttgtgtcattaaggcaaatatcaa

SEQ ID NO: 469546 - DNA, 658 bp, Homo sapiens
tttagaatataaacattttatttctacccagacatgttccaacttcctggcctttacagcgtgggtgtgaggcagaaaatcagactgactgatgtgggtctgggtgaagcaggaggcaggcagcccacagcacagtttgttacccctggcctgaaggcctttgaatcacaagcctggtgtaagggtgggagacggagtggaaaggtagtgatggagcacgaggtggtaattgctgcggcaaactgccaagtaggaacttacctctctgtggtggatgttctcaactcccagggtgcccttcctggtcctccagtcaccagccatctcattagcatacaaaaagacactcttagcactctggagattccaagggtcttagaagctctgtgtcagggaccagggactaagaccaaatattataacaaaagatactcctatcattcaggaagttagaaggatttttcctctgactaaaatgtgctgtggagaagatgtttttgaattgtatctatttggggatctctaagctttctgtatctggatgtctaaaactctaactagagttagggatttttcagccactattttgttaaataggttttccatttttctattgtctttctatttttctattgtctttctattttaatattgcctt

SEQ ID NO: 469547 - DNA, 684 bp, Homo sapiens
aagcagtttaataaagatcacaatgaatgagattgcagtctttctgagtcactttgttttgggtgtgtctcttgcgtgtagcgtgtggttggctcttgccttgggcagtgaacatggatcagtccatgggacagtgctccctgccccatccctgcacgtggcagtcattaccaatccattggcacaacagtcccaggatttggacatcctgaagcaggtcagtgatgatgaagcccatcaaccttccgttccccttgaggattttaggctctcagccccagagcctcccacagtgctgaggactgggagccaaggagatgccggcttttggagacctgcttttgtgtttctgggctctctcaggctacacaccagaccaatgaaaattagaatatctggcattgaaccagcacatcaggattattttaacttctcaggtttatctgaagagcagtcatggctgaagaccacttctgctcccccaggtgtgatcccaggcccctgtcacctgggagcttgttagacctgcagactctcaggcccatcccacgatactgaatcagaatccacattttcataggctcctctgatgatttgtaggcatattaaggtttgagaaactgtggtttagaaattacactgtaatttaatagttcttggcctgccctcacattcaatcattcc

SEQ ID NO: 469548 - DNA, 780 bp, Homo sapiens
tcctcacagtggccgcttcaaataggctgcagccaccatcgattccagaatgttttttggtgttgagcattcagaattagttcttccagtgcccgaacaaaatgccagactgagtggcttcaccacagaaacttttctcacggttctgacgctggagagcagctggagacccaggacgactgcacacccttggcattctcgtcgagaaaagtccaagaccatctctccttccctggaccttggctggactatgaaggctttgactaagagaatatattgtaaaggacatgattccagttctatgctcacctgtgtgaaggctagcagcttggtcttagtgtgtccggaatttattccttctggtgggttcttggtctcactgacttcaaaaatgaagccaccagcgctcgtgatgtgtccagagtttcttcattctggtgggttcgtggtcttgctggcttcaggagtgaagccacagaccttcgcagtgagtgttacagctcttaaaggtggtgcttccggagttgtttgctcctcctggtgggtttgtggtcccgctgacttcaggaatgaagcctcagaccctcgcgggataccagtgattcataaatttggcctctttacataatcccatacttctcagaggttctgttcattcttttatattattttttccttatttttgtctgactgtcttatttcagagagccaatcttcaagttctgatatttttttctcttcttggtttattctgctgttaatacctgtgattgcattgtg

SEQ ID NO: 469549 - DNA, 634 bp, Homo sapiens
caccattttccgtgggtccagttatttccttgattagtctcaagtgtgactatcggtatggaattcttcatacacagttttgagctgctaatatttcattatgatgatttgatgcatgaacagatgatgtggcaggaatggctggctgcactgccatccatgacccatccatcctttagtgttgtggctgggggcagctgcccccatggtccacaattcccagcccctcagcctgcagccatccgagtcttctatgcccgttttcatggacacaaggaggttgaagctttcaggtattgtaaagagttcagacaaacgtggggacaagagtcaaacaccaaatctggaccattatatgagaatggctgtgaaggagaaggcaagcttctgggtggcccagctctggaagtcttaatgcctgtccacaaaatgtcagtagcacctccatttattttgacaaaacaattccacaaatttgcaaaatacccactgagaaatgaaaatgaaattgtaagccccccaactgactgaatgtgtctctttttgtccaagggtaccccagagaaagttaaaaactgacttttctgccatgacttgatggaacgttgaacatacattatgcctgtattagtcc

SEQ ID NO: 469550 - DNA, 755 bp, Homo sapiens
aaactaattccaactggctaatttaaagagagtgacggggtgagtggtttggcaggaaaaatggttatgacagagcagttaatcggaatgagtcagggtggagcagcaaaggctgcctgtggaaaggatcccatgtcagttagatatgggcaacaccagtgccaccaccatggtcattgcctggtagtaacccagaggggccgtgacatcagtggaaatgcagcatggactcaagtgtcaatggttgaagctgcttttggactcttagacttactccagtggctctcaggccttctgtcacagactgaagcctgcactgtcggcttccctacttttgaggttttgggacttggactgggccgctactggcttccttgctcctcagcttgcagacggcctgtcgtgggacttcaccttgtgactgtgacccatcatggatcgggaggagagtcagcttcaggcagtcagcctttccttgctgtcctagctcagccacccattcacatctttgtgctgatacttaccacattatattggcacatgcttttactactgatggatggtgctttcccagggaaggctttccaagtattcaaagtaaattgagtgtcgtcgtctaattatttggtcactgtggccttatctgctccaagtccagtaacactgtgactcttgcagacttgtgaaggtactgcctcagtagttttgggtaagaccttagagaattaccaggatttccaggcagagactcttgt

SEQ ID NO: 469551 - DNA, 725 bp, Homo sapiens
caccgtagccaacgcagctcacgatggtctgggtctcacctgaggccagcatgtcagagtttcacccttctcttcaaggcagcagcttcccttctggtccaggggtcgaaaagagctatgctgcttgtgttgaagatggaaaaggaaacagtgagtcaagctggccgacacttacggaaaatagaaaaaaacctatgttgaaattccgggggtgggttcccccaataccctggctcacacttgacttcacacaggtgttgtgccttcctctggattctggatgtgacttcgattctgtccctgtccaagcagcacagttcccatccctaactacagtcatcttactgcagtcagtaaagttttttggtaagaaagtttatactcaacaacagaaaataagaatggaataaaaaatgtagaataagataaacactaaaatgcagcagaaattcctgtgtaacttaggcattgttatgctctcagaccaaaaaatggaagcaagagctctaaaacttttgtaaaaacgtctgcccagcaactgtctatcaaaccttgaactgacatctcccttattattgatccttgtggccaaggataattgtttcacttgaaaaccttcctcttgctttacctccctgaatacattcgcatatttcattgtaacgttcaatactgaataaacattattttctttttaagagcctttatgttaattatttaggttt

SEQ ID NO: 469552 - DNA, 614 bp, Homo sapiens
gaagaccgtaggtacctgaagtaaggtggctcttttccaggaatgccgataagtcttcagtttggggtagctctcagcatgctgggctaccctgcaaggaggtgcctcttctgtgccatggagcctgctcaggggaagaggggcagcccaggttcccaggtttccaggtttccaggcaaaaagatggctgtgggtccccccagcttccacactccagaccctggaggggagagggtttcccctggtatcctcatggcaacaagcctgactggcagtgaacaaaccactgagtcgggcaatggaagccatgctttctacccactccctccatggtgggaaaggccaagcaggcagtcttgggaaggaccagcgggcaagggggcatgtgatcagatgccccttggtcccatgacaatgtcagtgaggcctgtcttggcgccaaatgtccactatgtttgtaaaaatattactgatcattttgctacctgccagtattgagttgctatatttgtatcttttagataattaaatgatgtttgaattatccttgtagaatctctgttattttcaacagtttttacccactgttgactcttgtcaatgaaatgaccatt

SEQ ID NO: 469553 - DNA, 826 bp, Homo sapiens
ttaatctcctgtcccagacgactgtcttcaagataccaggcgctacttcttgagggaccagtgcttcaaatacgtatgtgcacggccctcaaccctgccacttttctcccagaggatggggaaccaatcaagcatgactgccaacaaattatagtccagacttatgcagcccaagatgatctcttagaagttcccttagcgaatcctgacattaacctatataccgatggaaattcatatgtggagaatgggatacgaagggcaggttatgccatagttagtgatggcagtgcagatgggaaatgtggggttggagcctccacacaaagtcccctctggggcactgctagtggagctgtgagaagctccagccccaacagtggtagatcctccagaccccacaatagtagatccactgagagcttgcaccatgtatttggaaaagccacaggaactcaatgccagcccatgaaagcagctgtaccatgtggaggcatggggacagagaggcctaaggccttgggagtccactcctcgcatcagtgtggataaatagttaccaaattttcctttgttaaaaaatttattttgctatgttaacagctccatgaggatgcattcagtgtgaaaaaagaaaatatcttggggttgttatttacttgatttatggagtggacatatttaagcaatggccttcactagataagaagatattctggatttgcctgtttttctttggtaaaattatttggcagatgttaattttaagggataaggataaatacttgagaagacaacaaatatatcattttgttgtttttataac

SEQ ID NO: 469554 - DNA, 1892 bp, Homo sapiens
ggcgaggacatccacggcccctttcagttcagatgtaatcaagttaaaatgatgtctttaggatgggccctaatccaatatgactggtgtccttatagaaaagggaagtgccatgtgaggacacaaacgtataggagaaggccatgtgaccagagaggcagagactggcgtgaagcacctgcaaaccagggagcactgagggtgaccggcaacaccacaggcaggagagcggcaccgaacattagcttctccaggagccttggagagagcatggcctgtcggcgcttcagttttggccttctagcatccataactggccggctgacaggcagtgctgggcggaccctcgcagccctgccggggctggctgtcccgcctgtctttgatgtttataaaaatggcatcctcattaaagcagagaacacaaaatcctgccacctcaaggacacgtatcccttcatgaaaggataatcaggtcactgtttgtcacagaatctgctgtgcaggttgttgtcttgtgcctggggaaagcaggcaaaatatttatttcaatacccaaagaggtccttgaagtcaagattttatgaagattaagatggataaagaattattgagtccacactatggaacgtgataccttcatacattctactaaatggctagtttatgttttcatacacagtggagtacaaatgcttcttgttttaacttgtaatcttttctcactgaaaaaagatgataccactactgatcgatgactgagaaaactgccttgctatggtcctttggttgtgttatcatgtgtctcaccttctcctgtacctgtatttccaaatttcttgctggtatatggaatttttctgatatgagtgttcaaattatgacttggggagatatctctgtgtttatgtttgtactttttcaaaatacataattaaagcagatcccttttcaacttaactgttttagttgttttatgtcagttcttaaatgcatagaattaaaagcttccccttcaacccaaaacacttcccagaaagagaagcagtacagccggtcagaaaagaatatggggactgaaggtggtccgtttggatccaatcttgcaactagcaactgacactaactacctgtgtaaccataggcaagtgttttggcttctctgagtctcagttcgtgtatccataaagatggggaaagcaacactgcctactgcatggaattatctggaatgtggtaggagcacaacatatgaagcttctggaacaatcactgaaaaagagtgagtgctcgaaaaaaattgcaggctctttttatcttttgctttattaattgtccaggaactgtgcacagaatctcttagcatggaattttagctccctgtttctgagtcttccgcatccagcccaagcaagtgcctcatcatttcagcctagatcaccgatgaagcaagaaatattattaaaataatgtgatatcggaaattctaagtacatatttagcaacttgggctgattcgtagctattgtgaagaagagctcctttgtgacagttcttaaaggattggctaagatgatttgtgattaggataatgtatttaattgatttctagtgcaccggtcacctgagtagtgtacattgtaccctacaggtagttttctatctctcacccccttcacaaactcccccattctgagtctccactgtctgttgtatcaccctgtgtacctttgcataccccataggttagctcccacttataaatgagaatatgcagtatttggtttttcattcctgagttacttcaatgcaaacttgctgcaaaagaaattttgttcttttttttatggctgactagtattctatggtgtttatattatatacatttcatt

SEQ ID NO: 469555 - DNA, 900 bp, Homo sapiens
tccagcaaagattgtgacagtcaataagtcatttccagaggacacagtggaggagcgtgggggcgcggaaatagaatttaaggagccagaataaaaatggatatgttcccatcgggcaatgctgaggaaagtggttgcaaagaggatggctagatctgaagagactccaatactggacgccccaccgtctgcgagagaggagacgttgtttcttaagactttatggctgcaggatgcgattccctattcagaacccattttaactggaataacggtggaaaggcaacgtattgtctacaaagcctggctctgttcccagtattttgaagtcacacagtttaactgcagaaagacaattccttgcaagcaatactgtttggaggttcagacgaggtgtccatttatattgcccgacaatgatgaagtcatctacggaggcctctccagtttcatctgtacagataagagagaagggcaagttatgtcattgaccagccatagccgttgcacacgagaaagtgaaatgcagaatgatttcacaggcctgtgtgttattctactgacttgatgctcaagtcattttttatgtagctcctctctgctggagggggaggagggggaggaaggagggaagagggaaagaaggaataagggaaggagggaaggaggatatcaatatcttcttgctttgagtttgagacaaaattcaccagacacaggctattaattcatattgaattttgcatacaacattccacaaataaccatgaagataaggccttcattttttttttcttgtgggacaatgaggtgtctgtgacatgaggacttcagagaagctattcgatttttatgtacaggttgtgtttatgcatttacactcacattggcttttgtcct

SEQ ID NO: 469556 - DNA, 919 bp, Homo sapiens
gaaggaaagtcaccctttgctcaagccagactatgcgcactgccctcagagaggcagtgccagcgcctgcactgctgagctggcaatttcactggatgagtgttcattttcactcggtccccctggccccgcagctccagggtccttaaggttcaacctcagagttacgtctgatgccaccaatgagtaggaacaggtcctgtggccgcactaaagtcaccgggactacagcagttgatattacatactttcgaaatattgaaataaagtgtgcatgcttatgtttgaattgataagtggtgctcatgacacaacatccaaaagacccaaaacaggcaagatcaagtcacctcctccagccaactggcgactgatgtcatggggtctctctgtgtgtccaaatttcctctctgtgtccaataatgacatctgtcctattgaactaggacccaccctaaaagcctcatggcaccccaataatgacatctgtcctattgaactaggacccaccctaaaagcctcatggcaccccaataatgacatctgtcctattgaactaggacccaccctaaaagcctcatggcacccctttgaaggccttacacacacatattgtgaaatacatttacatgttagcgtactgggagttagggcctcaacagagatgtccctgtttccaatgctttcgtaatttctttttgaaaattgctatagtactttattttcatttgattttctactggaaatattaaaattactggaagtccattcaattcaagtctgaaaaataaagaaatgcatttgacagagaaaaaggcatctgtcagaattcaagtcagagaagaatgatgtagaaaaaagagctggaaaattttctaggcagtcccaaccaaaaagacattgttttatggcataaatc

SEQ ID NO: 469557 - DNA, 895 bp, Homo sapiens
cagcatcagcttcggcagagaggtggaagggggtccataaagatggcgctgactcttcctggtgttgatcatcctcagagggcagaggagcaggcccatgggaaagccactgatcccctgaacaccagaagagacaccgtttctaaggacgcatcagcatctccttcacaaggccttcacaaggcgttcctttcccgtcctatctatgcagcagaggccgactggcaggatcaccacagtgttgcttctgcacattccatcactgtccacgctggggaccacccagaaagaggtgcagatgccctgagcaatgctgacacaggaagggtgagcattccaggtggagagaatagcaaatgccaaggccctgggggacaagacggggaagccagggtagggcggggaggttactggaacgtccagcaagggacgatggaggctgaggccagcgtggcatccacagagatggtgagaagtcatcgatttctggatactttgaaagcaacgtggacaagatttgctgatgaggaatgagagcaacggaggcatcaaagatgactccggagttttagacccaagcaactgaaaggcaggctttcccactaattggaatgagaagcttttaggggaagcagaaagcagggcagttgctggaatatggatattttgttgcttagttggctctatttagtcattcattatttacctattatttgttaattatgttttttatactgggacaaagtcacgcaaacctacaaaatacgtgtgcttcgtaaactgttaaaagctttacttctttaagtaaaccaatgttaccagttttaaatattttttgttgttgctgtctgctttttagcatcgcgtagaagtaataaaatagatgggcaatagc

SEQ ID NO: 469558 - DNA, 550 bp, Homo sapiens
gatattcacgtactcaaagaagacctaagaaatgcatggatgctctccagtgtctctaggggctgttgcagacgtcaagtcgggtccaagtcatgccctgtcacacgcgcatgcagcaccatcagccacaaaccagttggaaatcaaagtcggttttgaaactggagggaaggactttttaaattccagggcattgtatgtgctggccaagaaaccctacaccaatgcgaaggctccaggaagtcgtcttcaggaaccaagtctattttgtaaacagacagccagctttggatttaatacaaatacacataagccaccacttgttcacaagtcagggcgtgagagtcttggaggagacttggactctgttcactgccatttttctgaccttgtctgcaataaaatctacattatctgttccaaatctgttatgcataaatgtcattatcacaaaatcaggaaaatcgggctttttaaaaaatagctttcttgaatgctgatttatgatacatttacccatcaaagcagagacatcaacaaatttctattt

SEQ ID NO: 469559 - DNA, 994 bp, Homo sapiens
gtggtttaacaccatctcctttggtgttgtcatggtgagagtgagttgtcacgagatctgattgtctataagtgtgcagtgcctctccccgcttcctcctgctccagtcagctcctcccggcttcctcatcatctttgatgactgcctgttcacagcaggccagcagggctttgcagacactgccaccactgggcgcctcatactgccagccatggtcaaccctactgtgttcttcgacatcaccgtcgatggcgagcccttgggcagcgtctccttcgagctgtttgcagagaagtttccaaagacagaagaaaactttcatcttctgagcactggagagaaaggatttggttataaaagttcctgctttcacagaattattccagggtttatgtgtcggggtgatgacttcacatgccataacagcactggtggcaagtccgtctatggggagaagtttgttgacgagaacttcgtcctgaagcatacagatcctggcatcttgtccagggcaaatgctggacccagtacaaatggttcccagttttttacctgcactgctaagaccgagtggttcggcaaggtgaaagaacgcatgattattgtggaggccatggggcgctttgcggggaatgggaagaccagcaagaagatcgctgttgctgactgtgtagatgggcacctctggcatgaagatcttatgacttgcttcaggggtgaggggcgggagaaaagtcagaatgactttcctaggttttatagtttgcttcagaaatgccgaagataattgtcttttaaaggtaagaagatacttgaaaccagatctgcctgcattccaagccctacaggagctggaaccttttcacagttgaagcacaatttttcacttttaattggttagcttgtaatgggaagattgtgggacaaaaagcaatccttgttctgattagtgatggaggggacctgtgagcgttgggaggtttggaggttgta

SEQ ID NO: 469560 - DNA, 813 bp, Homo sapiens
acgagagaaagaacaggaaagaaaactttcttaaccctggcagataaggtgtataagacccatgctagaccccaaggccaactctcctatggtacacctggcgctgtttcaaccacttttgttctctagctcgcattggaaagagattaagaaaaggcatcattggccagaagagaccataaggctctattacaaatcagggagactcactctgcaagctgtacacacatttgacgatagtgagtgtggtcaaatgtgtgagtttggtcctgttattgtgtctgaaggcgcctgggtgcagctctctgagaaccccatgggccacactgtaagaaacaccatcccagggctctgcaatatgagcttttcccaactgggaatcagccgcacacacttttccgcagatccttcaactcaaaataagactgaatgtgacacacgagtacatgcagcaggccagtcagggggaggggaaggactcagggctcctggggaggagagcacccctagattagaaactgagggtgtctgttctgccctggatggggatcattccatgggactccaaaagcttcttccaggaccccaggattttgtcaagggagtttggggggcctccgtggagcaccttgggctctccaagaatttctggggcagataattgtttctacagtaagatgaagggtttatgcaccaagaaatctgttagatgttcctgttagacagttcctaaatcagggactgtgtaaacatacttttaaaatgtcactaagcatttagtgttattttcatcaagatttttatgtatttagg

SEQ ID NO: 469561 - DNA, 678 bp, Homo sapiens
gtcttctttcaaagtttatggacaatgattgcattttatgataatgagaacaaagtgcatcactgtgaatagggtctcaccacctaagtgtgcagcaattgttggattggtgagtggtgttccggactggtggggaatcccttgtaaatgtcagtttgctattttcattgaatggattggttcattttggcatctgtggttgaacaaaaagatgaaagtcgagggccaagatatggactttgtgtattgttattgggccactaagaagggctgccctcggacagagccaaggagaacattgactcattcgtcgtgtgcagacctttgcggaagatgccgatgtgctcaaggcatgctccctcatggctaccatgagaaaacaccacagactggatggcttgaacaacaaaaatttatcttcctagagttctggttgctagaaatccaaggcaaagatgtggctattataaattgttaaatagtgcagggagaaatatctttgtgtataaatttatgtccacagtttgaattgtattttaaaatagagctctggaaaggaagttactttgttaaagaggacaacattccttaaggaagtaaataattatttcttacattacatttcagaactgctacacaacgtctatgtccatcactagtatatgaaagagctgactt

SEQ ID NO: 469562 - DNA, 691 bp, Homo sapiens
tctacaaaattataatctgataacaacagaacgttttggtattttgaattctgccttttgacattgctctgaccccacctcgcctctgcatgccctccgacactgctttagctcaggaccctgtctcccagcttcctggagcaggtgcctctcccctggtctccccacctccagagttaccactgtctatggcagtggctttcaaagccattcctggaccagcagtagcagctagaaatgcgttaggaatgcaaatcctcaagccccatcccagactttcagaattggaaactctggggtcgtacaaagaaggaagaaaatgtgaggagacacagggagaaaatgactgtctacaagctaaggagagaggcctggaacagacctttccttcacagccaacagaaggaaccagctttgccgacaccttgatcttggacttccagcttccagactggcagcttttgcatcaggctgtggacactccaacacaagggctacacatgcgagtggagaaaagaattgagctcgtgcattttcagaagacaccagctgtacaagaaatataattttctttgaaacactgacagttttatgctcttgcatcatgtttgtccttacaatgaggacattcgcttctaatatttaacttacagctggaaagacaactttgtattcttcctaggaggtgagg

SEQ ID NO: 469563 - DNA, 593 bp, Homo sapiens
aagattttgcttcatggagcccacatgcttttttagccaacaggagccttcaacagatgagttattttttcctttgtggttttattttgaaatgattttaggcgtacggaagagttatccaagtgcccctccaggccatcctcctggctgggagtaccatggctccaagtcaactctccccctgcacaacccagctctggctacaaggatgtttatcctgccaaactctgaaccagccctgcaggagttctccttcactccactgctgaagagctgggagtccagatttgtacttgcaattttccaggcaggggtaaacctgcctgcagggttcagccaaggggaaggccctacaggaggagagtggctgcgtgcttatgcctcatgttccctgctcagcagtgtctgtatttctcaatggcaggccctcgccctgtcaggtgccttcaccagcagatccagcagtgctgatctccactaaccacttcttctcctcacccctgcagagtaaaatggtgctgtgcttggctcttcattgcttcttattgctttctcttaactccgatctcacctttctgtctccttagactctc

SEQ ID NO: 469564 - DNA, 653 bp, Homo sapiens
gttccgttcttgctggtttaagattctcctttgagggaagagtcggctttgtttatctttgatactcagagaaatagttcattgttgtaaaaaattatttcctcgctaaaaagccaacggatgttggacagatttcaccttcagtatactgctggagggccagaacaaggagttaatgagaacagcatctatgaggcgtgccatgactgttgggtggagcagagagggcagccccctggcattgggcaaaacctccttctctgcggcagagttgagaaaatggagcacaaaggaactcacccgtgtgctcagggtctgtggtcagggaagggtcctggtgggagcagaggctctgcaggatcaggccctgattttggggtggaaggcccaggatggcctcccatggagcccctatccccagacctcctcctgccccacaggggatctggatcttcctaccgccctgatggcagtgagcgtgctccggcggctggcatggagagacgacgaaatggatgtggagtgtctcagagccctggggaacagggaggggtgtgtgcttctctttgtttcgccagcaatgttggacaagaaacctctcgtctgtctcaacttttacgccagctctctcctctgaagtggttactctaaat

SEQ ID NO: 469565 - DNA, 719 bp, Homo sapiens
agagttacccagaaaaagtgtgtgtgtctgtgtctttttttttttttttttttccgcagtgagtacagccgctcctaacgctgctgcttcttggtcttcaggttctcctcggcttgttgagccggcggcgcctggcgtttccagtctgcagaatctttcgtatcagggcaatccatatttttaaattcaaccaatgcgggtaagaggctcacatggtgcaaagcatagatgcaaagaagaggaattgagtggctacccttcccgagcctcccgtgtgagaacggaaacactcagcccagaagtgacccatcacttctacttgcgttgcattggctggaaccagtcacgtggtccctgtcagtaccaggaagtactgagaaagagggagggaacaagaaatagtctgcaaatggcagactggaaggtgtctcctgggcttgatgtcactcttttagttgttcataaacatcttatcaaagacctatgtatcatggacctgctctgtcacgcactgcatcatggcggcatgagagaagtcgcagaggatttactagtgtattacacaataaagagagagacaggggtgaggggagtaaggggtgaagagttccctgcctgacagaatgatgtgcaatctgttagatgaaaacatttcttaattactcatttgcaaacttttgagaaaggagatagctgagtgttggcatttgcaagagagc

SEQ ID NO: 469566 - DNA, 716 bp, Homo sapiens
caggatagagctgcacggagaaggggtgggcaggatgcggagaggtgttctcaccttcatgctgctgctcatcggatgaaggtggtgaaggggaaacagttctctgccagcatggagggggatccaccagcagctcatctagttgatattcgcaacctgaagtatgatagggttggcatgcagctgatattggcagcgtgctcactgtcatcagatgccagcttaaatggatgctgcactgaaaagccagcatcctgtgcttccagtgccagccctgatttgtatgaaaccagcaggctcaggtgggaaccagcacaacttcaacagtatcagcgccatgtcttctgccatgtggaccaggggagtgaggtacggcagcgtgacaagagagaaaaggcaaaaacacggcagagggttattgcagagctcaagccatggaatggagcaccttggatgggtcactgccacggccaagggagattaatgaccattgcaatttttccttggattgttccacagggtgcctctggccttaatgaaaaccaagtgaaaactttgagccaaattctagaattattgttcgtgcctttgctcatgtggtcaaagaatcctaatgcaggttcgaggctctacttcattctgtggtcgattagtttgttcattcattcactgaataaacacacctatcacgtgccaggcaagaggatgcaatgaaa

SEQ ID NO: 469567 - DNA, 616 bp, Homo sapiens
gacgcataccagcacaaatggcagtgaccaaggcagtgggtatcctacttaacttttaaagttataattctggagcccaaaatgtacaaaagcaagttagcaacttgctgcccaaatccctgctttatcaaatgctattttaacaagtcgctcttctctgaagtcatgatacatgttacacaaaatatgtgctctcattctggaagaagcaagaggagaggcagaaaatggcagcaagtatggcacagagaagcccagttactagaacgtggatgcaagattaaagcaataccagcagtgacagtggacttaggcatagattcctcctctacctctgtcttctctctgagctctaaaccagcagatttcaagaggggcaaatcaggcaagaggcaggacccttccgtcttcatcagcgatgatatacagccccagggaagcatcgcgtgttctggggaaacgcaccaggaaagaacagtgcctcagacaggcagcttttcaaatggcagtcctggatgtgcaaattcctgaaagctcattggagtttttactttcaagacaatttcagaaggtaatagggtaagttttttgcattgtcaaacattcatttcaaaga

SEQ ID NO: 469568 - DNA, 903 bp, Homo sapiens
gaatataatgatagagcacacatttttttttggagaccgggaagtccaagatcaagacaacagcagattggatgcctggggcagggagagtctattatttgtacctgtctcctgagcgtgggatcttgtttgccttgattggttgcttaggttatctttgtgctcaaccaaatgccgactctcaggcaggcaactggaaaggccccaggttttctgtggtggagaaatcaggggtaccctccaacttcacgtggctaagtgggaggagtcaaatggtcacatgtaatctcacagacaaatgtacaatcagaaatcatcataaatggcaggaaagaagacgatgtcaaaaaaagagaaaagtgggccccgcttgctgcagcctgaagcctgcggaatggagccagcactgccagcatggccagcacgttcatctttgccttcccaatggactgttgctctgtccctgctgggagagcctgggaaggggttcatcttgcagctctagcttgtctcttcctgcccttgccttccttgggtgttctggtttattccagagaggaggaccgtcccaacgagggacataagcatttgatatgcagatttatttattattgccatctgtttctgtgaaagctatttaagtgctaagcagttgcctgaatgatgttcagcattttgtaaggacagtgtttttgccatcattatttcacatggattgccacaaaacgcgaacacagatgggtgaggtcagtaatttgcttattgtgtttctggattcttaaggtgatgtcatttggtccacatttaacactgactttcataataaaagtacttagtttgagaatttattttttgaaagcatgtttgtgaatactcttttttcctccttcctactcatttccc

SEQ ID NO: 469569 - DNA, 1131 bp, Homo sapiens
ggcctgcagcccttttgttttggacaatttcttctatttggaatgggcgtatttacccaatgcctctaccccctaacaatttactgtgactacttagcaagcacttttgacatctctgattctggtatcaaatgtcgagaatatgagacaccgcctttctgcttgtgtcagaagaccagctatcggtgtctctcttccataagtactgtggtttttaaaagtcagaatgattcagcccaggttggttataataatgatggccaggacactgtccgcggaaaagctggcttcaagaggggcttggagggagcacagactgtgaatatacaggtgaggaggaagggctttgaaccagccgtggaaggaaaacaatgtaagaaattgtgtcttccactccatgaagggaagtcatgggaaacagtccacagtctacacagcctgaagggctgtggggatactatccctggcgagctgaagatcttcatggagatgtcgtgcaagtatgaggtgttttgtgggccgcctgtggcagacacactgagctttgtgtcaggtttcactagaagaagagattaaacaaaatgtagatagaactaaactaaattagtccactattttagattgtaggcatttgttactgaatttttcagactctctcaaatttctggaaggcttttgaagattacctggctttgtgatttatcattactttttaaaattttaaggatttttttttactttaatccaaagtaagatagtagaaactttctatttttaaataagtcattaattatgtattaatccagtaatattagtgtatgtattttgaaattaagtcatactattttaacttaaattgatttcatcattttttaatatacatctaggtaaaattcacaaaatatgtataaatcaatttcttagcttgggattgaaaactaatgctaccttaatatcacttacacttaataccactttagcaacataaatacaggttaaatttatttcatccataggaaacaaaagagagcatgctttaatcaaagctttcaccttcacatatgttgtaaaacgtaattttatgttaatattgagaataatatctctttacctaatataacaataactttt

SEQ ID NO: 469570 - DNA, 1493 bp, Homo sapiens
tccttcgttactgggtgcctcagcgccaaacaggatccaggcctccgccaccgggaacctcttccctgaagacaacgattgttctttctgaggaattggaggcacatgtacacttatgtcgagccatcattttcactagttaatcttgcccctggcttggctggggaaaatttaacatacagcattggggaattacagatatctagtgaactgctgctgttggtggatttgaatctagattttccctctgtgcctgctgccgcagtgaccagccaagttgcctctgactttcgtgtgtcaaaggaggatgctttcaccaaacaagacaaaacaggagaggctcttatcactaataagcaacaggcattgcaccaggcaagccaaaaggacgctgacttcctcgtgttcatctgttgcttgtctcttctggaactagaggccaagcttataccacatgctggagatgagccaggaccctcctgtgatgaccgcctgttccctgcgaaagcagaaggggacgtggccataggtacctgttgtgaggacaccctggggcacggacgatggtgggactggaatgtgaagaacccgcagcagaaggccagctctctaggccgagattctattgcagcccagggctgggattatgagagtggcaggggcgagaagaggcaaggttatggagccatgcctgaattaaaaccaagaaaactgggtgacttgaatgtggggctatacaagaagggtagcaccagcatctgggtgccatgggagggcttcaggcagcttccactcatggagaaaggtgaagtggagcagatgtatagagatcacatgatgacagagaagcaagggaaagaaaagagggagagaaagagtggaggttccaggatcttttcaacgatcaattctcatgggcattgcaagttcacagaaagttttaaaagcgctgaaactgtttaccacgctatcatttcaaaagcaatagaaatgaaagcaaaaggaaatgcttcaaccaccttcattaagaagttcattgagctgctcatttcaacagcaggctataaacagagaaaacagcccttagaaataaatattaaaagctcatctccatagaccaataggagagaacagagagctagcaacctttgatatcacaagggagaccattcctcagctggaaatgtaccaaagaaaacctttccaagaaagaaatctttttctgagaataaaatggaaaatttctaaaatcctattaaaacactcagtgtgaaataatagaaaaaacttaaaggatgcatcataaaataatatagcctaagaaatcagcaggttataacagaaaagaaaaaataccacctcagtcatgttaataaaacgagaagtgaaattaaacactataaataagatttcttacagtctttaaaaagaaaatggtccaaacagaatacattttctgaggcttaactgtttcaaataatttcttttgaaat

SEQ ID NO: 469571 - DNA, 913 bp, Homo sapiens
tttagccaacagcagaattgctgaatcctatgataattctaggtttaattttttcaggagctgctatactatcttccacagtggtgaaaaattctccttgtgtcactgggacctttcctttgccatggcttgtgtacattctcaagtagctttcagagttatttcaaaagaagtcgggaccagcgatgccagcatggctgagcttttcacaagttttacacctagaaatgggtggtacagcaaggtccaaggcaaaaagatggctcctctgacctctaggacaccccacaccccactctttgatccagaggtgttggagcctgtgaggaaggatgaggtggcaaggctgatcttgaactcctggcctcaagccatcctcctgccttgtcctcacaaaggaatggaattacagaaacatccctacgttctgcaaagaatcccattttttgttgactttcttaagccaaggcacaactccctctgactcctcccgagtgtgagcccgttccatctgcagccaacacttccggaaaaagagaagagaggggagaaacaccatctcattgttggcatgtggtgtgacgagccaagtgatggcccttcccactcggtcttcagcgctgagaggagcgtttcttctccccaagaaaacacatccagtgattgacctcagccactttatcctgggctgaccatgggattaggaccacaaagaaaatatgatcaaggggttatgactcttaggcaaaaataaagattctattttattgtttttaaatacagacattttattaagaagttaaacattctataaatttcaatctcactaacggatattagaaatttttagttattaaagtactcatgagatgttttaaaattaagcatctatcttgataaatgaactctaagt

SEQ ID NO: 469572 - DNA, 1533 bp, Homo sapiens
gagaccttcatgtgagaagcaggtcacgagaccctcacgtgagaagcaggtcacgagaccctcacgtgagaagcaggtcacgagaccctcacgtgagaagcaggtcacgagaccctcatgtgagagcaggtcacgagaccctcatgtgagaagcaggtcacgagaccctcatgtgagaagcaggtcacgagaccctcatgtgagaagcaggtcacgagaccctcatgtgagaagcaggtcacgagaccctcatgtgagaagcaggtcacgagaccctcatgtgagaagcaggtcaggagaccctcatgtgagaagcaggtcacgagaccctcatgtgagagcaggtcacgagaccctcatgtgagaagcaggtcacgagaccctcatgtgagaagcaggtcacgagaccctcatgtgagaagcaggtcacgagaccctcatgtgagaagcaggtcacgagaccctcatgtgagagcaggtcacgagaccctcatgtgagaagcaggtcacgagaccctcatgtgagaagcaggtcacgagaccctcatgtgagaagcaggtcacgagaccctcatgtgagaggggccctccctgtatctggagggacaccaagggaaatctgaagaaacaggctttgctttccacagtttgctacactcagctcatacttttttagtcctatcacattttcccatggctttccactcttcacgaaagctaggatcttcagttacctatgaaggctcatgagtcacaaacagcttatatgaaaccagtgtatatgctgttctcttggcaatctgtcttttgttgcaggggcccagatgatgaacctaagacggttagaagaaacaggtgtttttcttcccctacacggttttccatgtgatagcaggtctctcagctgtggataccagcacctgctctggtggagggagcaggagactgaggtggactctgtgagggtctttggctacaagcctcctgctgagaaagcaagcagactcacatttccttggctgtcccagagcctggagcagcaatccacctccttcaaagggtctgtggattctcttggctttcctggtatgttcctgcagtacttcctggagcaaaagttcacagtgtgggtctccacatgctgctccgtccatccaagtgggagctgcaagaatgccgaagttctaatgcaagtgaggaagtctatatcccagcttgtgtgcgggtccctggattctgctgctggtcgtgcggggcctgactcagaggtgaaggccatggtgtccctcactgcatcttccattcttctgggcaaggcctgagagcagaggccctgaagcccagggcccaggcccctcagggaagcttctggtgtaaagcaaaaataaaatgctaagccccctaaccatctgaatgaacccctcttcttggaatgccaagggcattccaaagttaatctgaaaaacgagttcaggctatgatgggaagcaggggttggacatgcctcaatataccttccgcccttttggaatt

SEQ ID NO: 469573 - DNA, 1100 bp, Homo sapiens
ggagttgagacatgactgagaagtgaggaagaggagggaataatagaccacaagacaatgagtactgtcagacgtagagagagatgtttcgtagcagtgaaagtcacttatcaagaagacatgaccgtcataaatgtgcggatgcttaagaagagtttccacatacatgaagcaaacattaaaaaaattaaaggaagaaatagaagaactcacatttatagttggagattttcacgtctctttcacagtaattgggcccaaaactactggcttatgtggctccctgtgggtaaacggatgtgggaagtcagcccacattctccaccactgtcctgcaccttcatttctggacgtcaaatccctgaatctgtagagtgtgcaaccagacagccgtgggtgcagggagagccccaggaggtcagacctcagcctgaatatctcctagatgcagcagtgcttacagcttttggtccaaaccagaagtgccaatcactcatggatgacccaagccttgggtctctcctctgtatggacacggttgcctagggctgtctacatgggagtcacagcgctgtccagatcacaggggccccgtggctgtctcagctcatttctattttaattctctctagacctagatagatgcaagcctctccaaaggtggagcctcaaggaatctgtgtaaacctaatgttcacgtccgttttcttgctcagaaacattaagctgtttccaggccagtgatatccagtaggatttccatggtgagctggagtggttcctgtctccaagtcatctcaaataagcactgcaaattttctaagacacagataatttcaattagttttattgataggtcaaactgccctgcaggtgtgttttgtgaagtgttgctaggaaataaaaaataaataatgacaaattgtcactgctccaaaaattttttggagcgactgatcaatggggcaaggattaggtttctcttctatgccaataataattataccgttgttatgggttgaattgcattccctccaattcatgtgtggaagtccttagtccttagtgtcttcgaatgtgactctatttctaaatgtaat

SEQ ID NO: 469574 - DNA, 2406 bp, Homo sapiens
gtgacaaagaggaagaagaagaggttaaagtcggctttaatgccatgtctatcagtgccgtcccaaatgccacgagcttagtgtccttctggctgcctgggctggaaagcatctgtccggaggggacggtgcccaatgacatcttggtccaacgatggcacgagtgccaagttaggaagacaggctccacgggcaggctgagaaccctgttggcagcatccttgagcgcatcccggatgcgttctctgtgcgctgggcatcagggccgccaactgctccagccacactgctgcaattcgatggcacaaagcgaaccttccacagaagaactgttctgggggctgtccctgcagcagagagaagagtgtggtggggggaaggagtccacttcccttggacacacgctcccaggtggtctcctggatgctaccacctcggcacccccgagctgctgagcccagtctcccgaccctgcccggcatctctatggcaccacaaaggtttatatgtaacttgaggccacatcgtggatcccatgggtatgaacaaaggaatcctttcacatgaccccaacactcttgttttgggcagggatttttcagttacacatctcaaccggcaaagatgtgtgagagactcataatgctgtttctgcacagaacctttgcacacctcctgttaaatacatttgacagctgatgtttttactcatgtttctgtttgttactcgtgtacagaagcacaactgctgtttttttaaaaacattgaccctatagccgggcattgtggcatgcgtctgtagtcccatctactccagaagctgagacgtttataagaatttactggcgaattcatttgggattaaagagttctttgcgtgaaggttttaagttacatcttcagacaataaattcagaattaggatgataaaggattttttctttgtacaaatttccaaaatatttgtactttttaaaagaatttgtctatcttatgtaaaatttcaagtttattgaataaaaagttgcttataatatcttcttattattttaataagattagatgtgcccttttatattcttgaaatttttataccttccctctttttttgatcagtctcaccaatggatgattagattttttagttatttcaaagaaccaaataaaataatggttttattgatcttctctattatacacttatttcctatttcattaatttttgcttttatcttatttttatagtttctttggatttaaaatgctgctgtttttctaacttcttaaaatgcatactcagcttattttggcttttttcccccataatatttgtttctaaattcatacttctctttatgcaaggctttagctgtaacctaaaagctactgaaacgtagtactttcattatcacttaattcaaaatacttttaaatttccaccatgttattttctgtggctcatgggttgtttagatgtgtatatgttacttgctatatgtgaggattttccgagtatctttttattacttatttcaagtttaattcattgtggtgagagaaaatatccatgtccttcaactcgaatcatcttttatcatgggcatcctagtgggtgtgagatggtgtctcactgtggttttgatttgcatttccctaatgattagtgatgttgagcatcttttcatgtgcttcttggccatttgtaggtcttccttgaagaaatgtctatttaattgctttgcccatttaaaaatgtttgttgttgttgttgttgttgagttgtgggaattctttatatattctagatatcaaccctttatcaagtatctgattcgcacatattttctcacatcccatgggttgcctttgatggctgtgtcctgtggtgcagttttaaattttgatgtggtcaaatttatgtcttatttcctctgttgcccgtgctttcagtatcatattcaataaattactgccaactgcaatgtcatgaaggtgttcccctgtgtttccttctaagagtcttatagttttaatcttatgtttagtaagagttgaatcttacaaaacaatatttaataagagttaaaatgataactaatgtaagtgtattcatatatggtaattactattaagtaatatttatacgtggtagaaggtaagcgtccatcttcattcttttgcacgtgaatgaatctctaattttctcaacatcacttcatggcaagactcctttttcctgcattgaatgatcttggcacccttgttgaaaaccatttgtcaatatatgcaagagtttacttctgggctgtgtattttattccattggcctatgggtatatctttataccagtaccacatttttaaaactactatagctttgtagtatgttttgaagtcaggaaatg

SEQ ID NO: 469575 - DNA, 1002 bp, Homo sapiens
ccactctgggtctcctctccactgagagctggacactcatcaagatgagctgcctgcagataggagctacccactccaggtctcctaagagctgtcctgttgctcaatgaagctcctctcccccttgttcaccctccagttatcctcatacctcattcttcctgaatgcaatgagaaggtgagaagagctgtggcccttctgggagcccagccctcggggttccctgacctagatgctggcgcctgcaatggaagctgcctgtggtacgtctggtccagtttcagcctctcacagagctggcacctgtgccggcacctggggctgcctgttctgccacagcagccagtatgcctggctgtgtacagtggctggaccctgcgcttgctcgcccacatatccctcgccactctgcgtctggctcacccttggcaggaacagcctacatctgtggcccccaagggcttgtgctctcccaccagcttctcctcatggtgtctggctgcatctgccccagcttttgacatccacaagtagaaactgagatggcattcggattttaaaatctactcgtgcttttgagtagaatccgtagatcaagcaagaaacctgtttatattttgaatagatacttgtagacctatttttaaaatggctgtatggcattctatcttataattatgtgatagtttatcccctttttctattgcaactgtgcttgcacacatttcttgtgtaaactgtgagtgttggtcagagtatatcttagtggacaaactgctaggttttatgaaaaatgcattaaaaatgcatgacattaaaaaaatctcatgcaagacattatatgtatatgtataagtgtatgtgtatgtatatgtatatgtatatgtgtatgtgtatgtatatgtgtatatgtatgtgtatgtgtatgtatatgtgtatgtgtatgtatatgtatatgtatatgtatatgtatatgtatatgtatatgtgtatgtatatat

SEQ ID NO: 469576 - DNA, 1695 bp, Homo sapiens
ctctgcttaagtcaaatgtaggtgacctgagctagtgcagagtgaggcagggagagtggtggcagggggcaggtgttcacttctgcagctgggtccagcagtgactccccctcatcatccagatcacagcctaatgtcacttccccagagaagcctcattctacgattgccaaaaccaagccccacagaccgggtggcaccaacaacagccaggttctcaaggtctaacttctcctcaaactctgcttcttcgtcaaagcagtcaattcggtgtgcgacggtgcagctgctggaagaccaagttcaccgccacgtgtgctggggtgattggatgggccatgtgtggcatcctggttgggtggaagctgccatcatgtcctgggaggaccttgtgtcacagtcccagggaataatgaatctcaccgccgtggaggtgaacaaggacgcccggttcatgaacctccatggaggttattcttgtttccttaaagagatagtgaattctctcatgtcagagaccgtggcatgcgcctctttcatgggagatgcagaaaagctatgaaacaagctgtctgaagcagaattgaaaggggacagggagagatgggcaggcaggaggaatttattttgtgctgactgtgcaaggtgcagagctaaggctttccatacacattacataaactcaccctcacctgcccccaccctaaaagactctgaagaaagtattattatgcccatttaaaaaatattaaaaaaccaaaagcacagagagactgtctcatcctggggtttggttatgatgtggcaaagcttggtttgaacactggtgtgacttccctagtctagagttgttcatgctgagatgggaccagtaaacacagggaagctgacatgtaccctagtatttagtaatagattctaaatgagtcttctcagagatgtacgtgtcacaaaagatacatcacagttgtgggaattccacagtttggaagaggcaataaatccttaaagaatttttgtatcattttatgttaatagaaattttaaatattttaaatatataacttactatattccaggcaaaatgctaagtgctttgcgcatcttacctcatttaatacacacacacacacacacacacacacgtgatccagtgaggcaggtgcaaatatcatccccattttgcagatggtgaaattaaagctaaaaataccacagccaagaaaatcttgaaaaagaacaaagttggaggacacatgctccctgatttcaaaacttattacagagctacactaatcaaaactgtgtggcagtggcataaagagagacatatagacagatggaatgaaatagagagcccaataaaccatttttggttgatttgtcatatatggttgaatgatttcaacaagggtgtcaagaccattcaatggggaaagggcagtcttttcaacaaactgtgctggggaaactggatattcacatgcaaaagaataatgttgcagccttacttaacatcatatacaaaaattaactcaaaatcaatcaaagacctaaacgtaagagctattactataaaactcttataagaaaacatagggaaaacttcatgatattggatttgctaatgatttcctttgtataacaccaaaggcacaggttaaaaaaataaataaactggacttcatgaccatt

SEQ ID NO: 469577 - DNA, 5580 bp, Homo sapiens
gccaccgaggtggctgtgtgtgtggcacatggccctgaggtccctggaaagcagccacctacagatacgggtgatgctacatgcagaaagagagcaggggacctccaggaagagcctgaggaactcgacagaaaccatggggatgatgagatgtgagaaagaagtcacaagaggaacagtccaggttttggggagacaaatcctgggagaacagcccaagtacggtcggcatgtgcgcatctatttcccacagacgctgtgcgtggcgtctacacacaggataggctctgacatcaaggtggcctgtgtggactccctcctggaaagggctctgcagcatccctcggcatgctgccttccagacactggggatggccggcagcagcagctggagcagctgagagcaacagagagggagcaccaaacacgcaggggaggatggcgcagtggccatgacgtgccctctgcagagagccggtgtcaggcaactgcactttatgacagcctgatcagtgtggacgttgacccggcccatagccaacagcccacctgtggggagcttccactggcagaaggcggtagcagcttggggagacactcggggctccaccacattggtagcatgggtcatgggaaagggaagaaggagcatggacaccttgtcacaaagctcagttcctcttgattagaacccagccctctggaggcagcagaaaccaccaacaatcttctattttaaaatctattgttagaaacttcaggcatccaccaatgtgctcaaacctggctctgcacctgcaaaattgttttgcacagtcctgaataaatgaggctagagttctttccctggcacgtccatggggccctctcaacccagaaatcgtccagtgacaacagtcactgtccccactgtcatgccctgtttaatgaaggtccttccagtgtggtcttccttttgcttccttcctcctctgcaagctaaagaccataaagactcagggtctttcggagttaattcaagcaccaaacaccattgtagatgaaacagacaataatgtgaaaataaataacagtcacctgtcaccttgtcttccagagataaccactgctcatattttcagtgtctatccccccgagtctttttcctgtgcacacacacttttgtattttgacagcaagtaaagaaccagggagaggtggcctcccaggccattcagaaatgcaatttaaacaactaggcatggaattgaggaaggcgcccttccaggcaggctgcccatgggcaaggggctgggggcacaggtggcatctttgcaccaactaggaaagggcgcccttccctggggtagaagcagccctgcgccaggatgctcagctcggcaagcaggtggctgtgagggaaaacggggtagctttgaggtctggggagagagcctgctgccaatcttccccagaggacagacagtggaggccactgtgtttaaagaggcctggacacaacatccaaacatttttcttaaaagttgtgataaaatacacataatgtaaaacttacaaccttaacccttttaagcgtgcagctcggtggcattaggcacattcacatcgttgtgcagccatcaccgccatcatctccagagctctatcttgcaccactggaactctgctcccattaaacaatgacttcccatccctctcccttccaggccctggcaaacagcagtctactttcagtgtgggtaaatttgactagtctagggtccctatataaacgaaatcatacaatatttgtctttttgtggctggcttatttcacttagcataatgtcctcagatttcatccatgtagtagcatctgccaggatttccttcctttttaagaaacgacatcccaccgtgtgcatgtcccgcattctgttgattcattcatcctttgatgggcacttgggttacttctcctgctctgctattggaaataatgctgctgaaaacatgggtgtgcaaatggccaatgtcagcttttggaagcccacaaggcatgcctgagtatggactcccacactggtgcggaaggaaggcagggatgccatgctggggctaggtggtgagctggggacagaaatgtctgggtgaggatgggacacagaagaggagtgatgtgacctggcctctggaggcttatgctggccagccctgccctgacccagctcatctgcaaagaggatccagccataatctcatggcaattttgctggccttggctttggcctggggttcagtctggggtcttgttactcttaactaaggtgtccttggttccagtttacacctgctgtaacagcacctgctctccctctcaccaccatccctgccttttggtctcccccacccagcctgtcctccgagcgtcccattaggtaaggtcagagtggagtcaacagtcagagcctcagagatcaggctcagggttccatcctcgaccagccgtgctctgaaaccctggacactgcacatcttggcagccttgcccatgagatggggatgataaccacacccacttaatgtgtattttgtgatcgttgaatgtgaaagaccacaggcaagaaagttgctgtgtgtaagagatctaggctgaaaatgtaagcgtggatgagaagaagcaggaaacgccaaacttcagggtgaaaaccaggcttcacacagaatagttagtgaacatgcaaagcacatgaaaatcaccagctatttattcagagcagtaataagcaaaagtgctggtgccaccccatgacaataatgacgatggctaacaactatggaatcctctaaatgtcacacgtacatcatgaccgtcaatttacaaatgagagaactggagtgcagaattgaatgttgaaggtcgtaagtgcaagagctgggggtagaatccaggcagttgatagaggcttgtgctttggaactccatgcttcgtggcctcttgacttgtggagaatgctgggggcctgccctgggtaacaggaacctgtgtgcctgtgctacagggactgctgtccccagaacttctcatcctgtctcccttacagccctttctgagagaccagcactcccctctccttggggttgcagctcacagcactggagttctctggcccagagatagtggtggacaggaaatggcccaacagagtgggttttctgaaagactaatgcttccttgggctggattccccatgaaaatagactctagtccctggtctcagaatcacttgggtacacttcagatataaacctaaataacatggcctattaattaaacgggtcctacatcttataggttgagtccatgcctgtcccctaccttggaggcttttcgccaaaccactgttgactgatgctgatgaccagcactttgggacatcttcaacacccccagctgcttgtccttggtccccagtgacagttgagcctcatgtctgctgtttctacttgcccaggtgcatgcatcctcagccccagtgacctcaacgctgaggcccactgaatctcacctgcccatggagccctccctacctgcccacctgcccacctgcgcatggagcccatctacctgtggagcccaacccacttagccatgtagcttacctgcccatggagcccacatacccatggagcctgccccatctgtccatggagcaccccccaacctgctcatggagcccaccccctgcccatgaagcacccccccacctccccatggagcaccccccacttccccatggagcacccctcacctccccacggaatgccctccacctgcccatggagtaccccccacctccccatggagcaacccccctgcccatggatctcacctgcccatgaagcaccccccacctccctatggagcaacccccctgcccatggatctcacctgcccatggagcaccccccaccctcccatggagcaacccccctgaccatggatctcacctgcccatggagcccacccccctgcccatggagcaccctctacctgcccatggagcaccctccacctccccatggagcaccccccaccccgcccatggatctcacctgcccatggagcccaccctacctatccatagagtcccctccacccacctgcccatggagccctctgctgggtgttgttgggcaagtgcatgacctgatcatgtgggcaggagctcccccagtccccaacttttagcactattccctggaccacccttctcatcagctccaggtgcccaaagggtgctcaggcaggcaccttacagggtcaaacagtggttgcctccactcctgaacacagaaaaactgacatggaaaacacacagagaagcacagggcactccacacagatcaggggccagtgtgtaagggttcgtaaggatttcctttttttaggcaatgaggcaagtgtggaggacggagagagagaggagatgagcatctctgaaggcgctctctgaggaggatgcagggaaacatttgctagcatgggcgtgttcaggagagaggctttctatgcaggggagctgctcagcctctagggtttgctcattaggccgccttgagggtccttgtctttctttttctttaattggccaccggttggctggggcagaagagatgaaagacctggaattttttccccagtcaattctgtgatcctttgcttttgttgccttttatcatcttgaaagcaaggcactaggtaaaagtgtgcttgtatggaatgtacatttcctctgttttctctccctcagctcatgcactgtttatctttgcttgcctgcctgtagcatcatccatgctttctctggctcacctattcctcatgcaacagatgcgtatagtgcacctccttctactgtggtctgccagcagcaacattcattgccctgaagcatattagcattcccctgaagactgtcctgaagactgtccagtcaccctgctctcaaggctttccttacttccccattttctaagacctctggtttaagcagctcaactcctctgacacttgttcagaatggtcaactgagaaaattcccagagagtgggggcatgtttaggactctgtctactcctgctcaactcagagagagctcagttgattttcccagaaaacaaagcagaagtttaaatatgcccaaagttatattttacaacgtgctactaaaatgctacgccttcttctcttttccagactcaatgatagaatagtcgtttactttggggcatcaaatggctctttatttctccctgactgcattcttctcatcccagccctctatgcccttctccacgtggagaatttcgggaaggggaggggaggtggtttctgaacatgggtaagactccaaacaaattctgctaatctcagggtttggtgaaactctttgctcagaaactttatggccagtgggaattgatggtttgtgtttgctcttcaaataaagaaaccttgacggtagagaagggcattttctgtggagctgctgacttttgaaatcttgagccctcttccttatcagcctgtttattac

SEQ ID NO: 469578 - DNA, 1630 bp, Homo sapiens
tcgtcaccctccgaaggaaggctcgtgagtctgcagggtggaagcgagcctgcccgggctacagcagtgaagccagccctgggcgcgtccaggtcctcgcctacgtggcccgccgctccccaccaagcagcaggactcagagctaggactgagccgcctcttcaatgactaagttagtagaaaagggaaagtggaccctctcctactccctccactcacagacaggaatgtgcgctccagagaaagatcagcacagctagtattctgcgccacagtgacaggagcccactgcactgcacctggggccagctctccccagcagctcctgctccatcacagcgccgtcccttcctcgcctgagccctgggttgcccgcggagttcaggcacctctcccagcccggcccacggcagaggggaaggaaggctgccggacagcagggtgctcccgcctgaaaatacggtggaggggttgagaaatgacgagtgatgggagcacaagggtggggcagagccccctacacgccctctgtggctctgccagcaggcatcgactggataaaatgtaaataccttagtccttaccattgcatcctggactcatttccagggcagaaggctccaggggccccatggttccatacggaagcagaagccggtctctgccccactcaggactctacgttcattccctgtcccacaccagggaatcagtctgaccagcctgacaagctcagccacctaaccctgttccctccctgccagggcaccctctgcacccaaaagacagctcagaaaggcaggccagaactgcaaaatcacttctgtttgtttctgacaggaatggaagcccatttcttttttggggggcagagtacagagtcttgctatgtcacccaggctgaagtgcagtgctgatggtctcacctcctgcttcatggagttaacagctgggaacactcaagctttcctccccagatccaggaatataacccagccccacacccccaggctttcctcctttctcctggagaaatgatgtggattttctcccatcaagcctggttttcctacctgattcctaatcatttcactttcccagggacccagagtcctgattgcttctgttaaaagaaaagctttagacaaattaaatgtaacagagtttaattggacaaaggaccattcatgaattgggcatcctctagaaccagaagaggttgagagagactgcagggcagccacatggctggataacatttatgggtaggaaaaggagtgtatagaaataggaactgaggtacagaaacagctggattggtcacagctgggtgtttgccttatttgaacagctttaaacagttggtcacctgtgcttggaccaagctcatctgctgtgattgattgagacttggctacttgttacaagagtaggatgcaggctgtttactcatccagtgaggttaccgttcatcatgtactagaagcctttaggttgcttggcctaaagctatgtatggaggcagcttagagtgaaactgaatgctaccctcttcatcctcccatagctttccctcctgttgcatttaggcatgacccagtgttgagcatctagagtccctcaagtcctg

SEQ ID NO: 469579 - DNA, 689 bp, Homo sapiens
tcttttcagtatagatctttgtcatgcaggtgtcacagttaagctggcaacaatggcatctccttctgaagaagctggcaacaatggcatctcctcagacagcccttctggacgactgccccctctgctaccctgggtcccccttagtctctcctggtatatacctacctaacagagttgttgtcagactgagcaagcctagatgcagggaactcagggcagtgcagctacggtggatgccgccttccctggaatatcactcccacccttcaattcattccgccattgttttcagtggtgtctcctgcctcttatcctttctcacggaattcgctgtgttgggatgccctccactaacctggctgacttctttatccttcaagacctttgagatgcaccttaaatgccagtcctctgcggaagctgacctcagagctccagtctgcattcctccctgcatgctgcgtgtacctctttttgacaaaggttacctacatcctcatgttgactatcgttagttctttggatagatttttttttaagttctgaatataagttttctggatttatcttttcctttaataactaaataaaattacatgctgccctcccttccagtcagggaagtcggtgcctatcttggtgctttgaggctttcctgggcaaaagcgtttccagggcagtaagag

SEQ ID NO: 469580 - DNA, 651 bp, Homo sapiens
tgcagtggatgaggtgggattttcttgcccagacacagcgagggtgtcaagacctgagaagataacttcctagcatccctggccacagtgcattccaaccctgagctggcagtgcactaccgatctgagcgacactgcccaaatcaggatgcccagaaaccagtccatgagttcagcctctcttctcattgcacctttggaaatgctggtcaacacctccctgctggccttggccttcagggcactggtgcccatctcctggtgctctgatgcgtctgatattcaggctaagagagggtctcaggattccaccaagaggcacagtcaacagcttctccccatgctgttgcaaatgcctgtgtccagccttacccgagcatccctgaatggtccagccggctttcagctgtcatcttttgcccatgacctcgatgaatctgccatgacagctgtcagtcaaagttggtgcaaggaatcagccagggatcagtcatcctcccctttggatgtagggcccaggcctagagcagccagcaaaaggcctttgagaatatttgcaatgacatcaacaggaaagaactccagaagcagattcctgaggttttactgaggtcctattagattataaacaggtttcaaaattgaaatgat

SEQ ID NO: 469581 - DNA, 586 bp, Homo sapiens
aggaaaaccagagacctttgttcacttgtttatctgctgaccttccctccactattgtcctatgaccctgccaaatccccctcttgtcatctgggctgtgatggggggaagccaggggctagaaggggcaagactccaaatacatattaggataacgtgtggtaaatgtcttccttcatatgagggcaaaactcgggctgtctatgtcccaccagtctattcccgtgaccatttgaaaaggaatggatggactttgacagcaacactaagttctgccctggaaggcggcaggacgagagaagaaaaacgccatgaagaaaccttgtgtcctacacatcacagcactgatcccaccttaggtgtggagtttgggatagtgcctgaaaagcgcatcgccaagatcagcagcatgcctttctcaacattcagcgcagcctctcccacctcctcctggggtctgatcctgagtttcagaaataactcatgtttccgtgcaacctgccaccgtgtgtcctgagtaagctgttaccgacaatacatgctaacgcttgaattatttaaacccgtgtaaaacagattcaaggtt

SEQ ID NO: 469582 - DNA, 613 bp, Homo sapiens
tggcagttaatgcgatgggcttcccggtgggatctggtactgagcagtcgtcgcaggtcacctgatacgggacagcagctgctctggactggcgctcgctctcaccgtctctctctctctattgccctcgggtgggaggagccagctgagcggctggcagtctcaggcttcgaaattctaccactttcacttagcctggtgtcttcaaagctgaaccagtttttgatctcagtcagaattctgataccagattggtgtagacagagcttgggctttggactcatgcatctgaatcctgtctccaccttttctggttgtatgactttggacaatttacttactgtctcttggacctcagtttccccagaactaaggcaagtcttatactatttgtctcataaagttgctgggaggattaagtgggacagcagacataaagcccttgacccatttaagtataaagccatgccagggcttcccagtggtgaggatcccggggacctgagcccaagctccctcatccctcaggagggcagcgggcagggtaggggcatccctgctccagggctgtgtgtgccagagtagagaacatggggaggtcctggtgctttac

SEQ ID NO: 469583 - DNA, 572 bp, Homo sapiens
ttgaaggagggtgtttagggaggcaggaagcagggctggccccatgggtgagggcagccctgcgctgcacaggcctcctccaggagcatgcacggggcactggctctacaccaggagcatgcacggggtactggctctacaccaggagcgtgcacggggcactggttctacaccgggcagaggagtagggacagaggagtggctgttttggagagcggctgctggaagggagctggggagtctgatttttcagccttggccccctcgaaggagtggcgtcagcccccgggctcctgaagaggacagggcgcttctgagctctgagcctgcggttcctggcgggtggattttacacaaatgtcagaggcccctgcgctgtaaaaagcagggcgcccttctgcgggtctgtggggaaacaccgccctctggtggccagatgatgaattctatcagcctttccttcacatacttttatacctgtcattagggtttgtaatttcgtgtcctatttatgtagtgcctgctatgaacacgcacgccaggcattgttctaactgccttcgttacatact

SEQ ID NO: 469584 - DNA, 869 bp, Homo sapiens
ctcatcccaacccactgggtgaagttacgctaagaaggtgagcatgaaagacaagtcaacgaaagagtcccaagtacgtccatggtcagccttgcgaagagagggagttggagcctctacagaaaatctaattacgctatttcaaacagcagaagatagcgtttcagtttctgatgccccttataactgtgtaatagattgtgaagaaaaggcagggacagaatctgggaaaggaacagaaagttcacattgtaaatatgtagcagagtctgtaatggcttggtcaacacaaaatgttgactacaatcaattacaggagagatatcagaatctcaaggaagtttggaagaaaaatgtgcattcctttgtgcttgccacagcatctctaaccctcgagggggaagccatcaaggaagaaatgaaatgtgagcagtggcatgaacatttggttcgagagtttctgggatattcttggctgaaaactggtgtaactgatgacttacagataatccagctctctgactactctgacattctggcccaatggcctcctcatggtccactccagcataagccatttgatcatttagcattccacaggctttccaaaatactttccaggcctctgcactgtgcctcagttaaaaccccagttgctttgtttgacatgccaccatttgtcctgctcccaagagctgcatgtgatagctcccctctccctgttaacacagtggaggaacaattatcttcctggtgaaaattgttgggactgtcttcccttctctgtttgcaggcagcaccaagttgggacgaatgaaataagaacgtgagggagaacagcccgggctgttcgctttcacaaacccctc

SEQ ID NO: 469585 - DNA, 665 bp, Homo sapiens
cctttccgagcacctgaccacatcaagtcctaaaacggtcctttaagttcagctttattccccttttacaaacaaggaagcagaaatatgagagtttcacgtatgcaaagcaagcgcattctaggagaatgtttgaagctacatgtcccggtacctgccttgctggcctggtcccaagcctcttctatgatgatgcccctcaacacttccttgctagcttctgcgtgtgtctgtgaactcttctggctacttgtggtcaacttttggcccctgacacttccctcccccactctgaacacaagcccacagcaccacttgctcatgggagcctgtgtggaaggaaagcctgtggctgcctctgacccagttggtcatcttgggacgggtgctatggtcccagggggctttgtggagcaggtcaccgccatcatcatcatcacagaggacttttgtgacatgaagctgaagtccacagctcaatggggacctgtgatgagctctggagacccatgaagagggaaaagcaaattaaagattaaagccattatgagatactagtactcactcaccaggatgtctaaataaaaatcatggacaataagtgctggcaaggatatggagcaataggaagcctcataaattgctgatgggaatgtattaaaatg

SEQ ID NO: 469586 - DNA, 860 bp, Homo sapiens
gcggtctaggctctgctgcccactcccggagccactgggagtcgggaactgggccagtggggcaggccagccgtgccagagaggccctcagacccactctgacctgctgcagtcagcagaggtaggaggagggtacagcagctgcaaaagtttctgagtggtgctgatgctactggtcccagggccactgcgtagccgactcaggtcagtacttcccacttcacatcatcgggacccagcatcaggccaaggccaaacatcgtgtcttctgtcccccgaagctcaatcctcttggttaataccagcttggacaataaacaccaggagctcctgtgccccaccctccactggtgtttaccaagctccaggcaccaaatgtgagcaaggactcagtaaatttacaaacagcgtaatgctgttggcagaaagctggcttcccttctgccatttgctgctaccatttcatggatactggccaggtggcagctgcggggctcagcactggaccatgttctctcgtccaataccagtgataaccctgagagatgaaaatggtgccctgtggcatgggctggctagtgggtgcccgagcctctatttgttgttgctgttttaatctttttaattgacaagtaaaaaattgtatatatttagtgtgtacaacatgttgttttgaaatatgtatacatcatgaaatgactaaagagagctaatgaacatgcattttaattttttattgtgagaacacaaaatctactctcagtgattcaatacattgctattagctctagtcactgtgctgtacaataggtctcttgaacttattcctccaaagttgaactgaaacattgtaccctttg

SEQ ID NO: 469587 - DNA, 575 bp, Homo sapiens
cgtgggggcaggtcttttccatgctgttctccaaggttaccagattatcggatgcagttggtcctgagactggcatctcagatccactgtgaagatcacatttgtgcttttcattatgatgagtctaagggtcgagaaactgttcaaaatattacagagtttaaaaggctaagtttcaaagctcctcattcctcaacaccaagtcaggatcgcactccttttactgaacgagcgcaaagcagttgcagcaatagctgcaataacctacaagttgggacacaaagaggacagacagaggaggaagcatccaagagcttagatgtccctggagcacttcgtgggaatgaatgtacattcagaggtctgaaataccacagcagctgcttagaaccattgatgtccatgaaatccatccatgataaatccagggccttgggaggatttctgcatgaatttggaggccaaacaaggattttctaatatcaaaggaacacaccaagtgagtcagagactctctggtgtttgtgaaaaagcaaaaacacgtgtagggtcctgccggtccgccatctgcagga

SEQ ID NO: 469588 - DNA, 570 bp, Homo sapiens
ctctctctctgcatcatccatgggctgccaggaaacagaagaagccaatgtcaaggcttggggtgatgactcacgatattactaaaaccacccagtccatcaaccaggagaaaagctcaatcatccaaaatgaagacaggacaagagggcacattaggaatgccacagaaaagcagataccaccacagaaagagcagaattggccacagctccagggtatctgccccagtactatggtgaacaggagtgctgcagctctggagaggcctgataccctaattcctccaggaatccccaccctctttcatccacagagaagtgggtggaccctgtggccgcaaatggactttgcaggacatgtcacagacctgatgggccagggtggtcatctgtcctatggagactcaatcaagatatctgtctgccttaagacatctggtgcttccatcttgttcactggctgtacttgtcccttaaatgaatcatccaagccactcattagggaaaccagttctttatggatccaggaggagcctcaggctctctacccttgagggctggattgctgtg

SEQ ID NO: 469589 - DNA, 575 bp, Homo sapiens
actgttagaaggaaaactaacacaccgaaagcaatagtatcaatatcaataaaaaggatgaccaaacaaaaactccatctgaaggtcaccaacagaagaccaaagaatgcctcttctcctccaaaggatcacaactcctcgccagcaagagagcaaaactggatggagaatgagtttgacaaattgactgaagtaggcttcagaaggtgggtaataagaaactcctctgagctaaaggagcatgttctaacccaaggcaaggaagctaagaaccttgataaaaggttagaggaattgataactagaataaccaatttacagaagaacataaatgacccaatggagctgaaaaacacagcaagagaacttcgtgaagcatacacaagtatccgtagccgaatcaatcaagcagaagaaaggatatcagagactaaagatcaacttaatgaaataaagcgtgaagacaagattagagaaaaaagagtgaaaaggaaggaacaatgcctccaagaaatatgggactatgtgaaaagaccaaaccgatgtttgattggtgtacctgatgagtgacgggg

SEQ ID NO: 469590 - DNA, 549 bp, Homo sapiens
ctttcatctcctgctctacattggccaggccttttcttccccaatgctggaaaatgtcttcattcaatctcacttcccgatttatatgatgaaaaacccccctgtaatgcacagcagagagctaagggatgctccacagaagcacctgtccttgagaggcctcaactggtgggcagaggcaggggagcagggggccttgcagttagaacatgggaagccggacttgctagcgatctggaatctcaccatccgagggagcttcagctttggggcctctgccatgctcttacgtgctgctcttttaagtagttggggcacccaccactacctccggaccttcccacagtccagcaatgaagaggtaatgctggccatgggggcctccttaccatataacactcttactctaggtcctgttgctgtccacacaggaagctatttgtttgttccagcgggtttgtgatctcgctgacttcaagaatgaagctgcggaccttcgcggatcctgctgattggtgcattttataatcctcttgctagctacagagc

SEQ ID NO: 469591 - DNA, 575 bp, Homo sapiens
cgaagcaaagactagcatctcaggactgagtgactctacattctgaattgctgagctctcgtggcggtgatgataaaaagcaaatgccttgtgaaaatcaatgtggaataggaaatgagcaaggcagcagctatgcttaccctaaagttcgagaagtcgtgcagcgctcaacaggaggccatcacttaatctgcaactcctcttatgcatccatgaaagtatcacaagagagcgtaaaacaggaacttaaacaggactcagcaggcctgaggctgcgactcctccttaagtccgtatgtcacccaactgatcaagaaagctggtctctccatcagcaaattcaaggtggtctggagagaaaggaagcccacaggcaaaggcttggccacttcacactgcagggtgtcttaaagtgtactgcacctcttacgttggatgttaagtcctcaaatataaagaattttaagactagctattctgtttacctgaagatacctttatatggcgtctaaattctgatttcaggctctaataatgtccttgaaaaccaaaaatttttaaagggaagaagccat

SEQ ID NO: 469592 - DNA, 651 bp, Homo sapiens
tgccctcctccaacaccatcaaagtcccagagttacaggtgatggctctcctccatacagtgtctcagggacccaagtccttccagtttgtggcatcaccatctgagggtagtggttcccagccaggggtgactttgccccctggggcacatttggcaatgtctggaggatggcccctacgacaaagtatttttttggtccaaaatgtcattggtgctaaggttgagaaacgctgcccaagggatgtgtcatcttctggagcaagaacttctggtgaacatctagtcagtcatcctgtcatggtggcactggtaaaatttgaaccatatatttgcctgcttgctcacgacattgctgaagcatcaatggggctaataaaactgagaagaaataaacacagccctaacctcctccttaggctccagattcttctgtccagtgtcctattaaatacaccgttaagtgtcaaaaacaacacagccaaatagaactttttatcttcccaccaaaattctattcctctcatctttcctctctcagcaaatgacaacattagtctaatctattccctactttcctacaccctcattcagttgtttagcaagacttcctagctctacctgcaacatatgtccctgcaagtatgaccat

SEQ ID NO: 469593 - DNA, 835 bp, Homo sapiens
gagcaccgattatgtgcctgctgcttactcccgggcatacaacatggcacaaagtgtagtagggcctcatcaaggcattcactcagccttcctgtccttgtcctggaaccttttaaggcctcatcatctgcttttaacagatctttctgaccttttgcccacacaaaaccttttcttccagcctagcccattcaccatgataacccacctggtgtctttcttgtcaccccaacttctggatagactatccttattcggagcccatctctcctgtgaagctaacacaatggagagaactggcagctgctgtgcctgccctgacctcctgtggcctcactcgccgtggacaagtcctgagagagctggaacctgtggacattctttccctgtccgtgctctgctgtggatgatgacaggggcagctcaggtgtttgctggggcttccagagcatttgacaccattaagaagacggagagtatactgaatgtctaaacttaaagggggagaggctttggggatcatttaataaaacgaccttgttttgcagatatggaaactgagaaccagagaaactgatttacccaaaaccacaaggtgacgtagtagcagagtcaaatcttgtccactgttaagtttagcctaaagctccctccttatatattttaagttcatcctaaaggtttcttcatacatagtgagctgtaacctaatggatgtgtgaacagactgtaacttgctgttgtgccaatcatcaagttttggccagtcaaggccgtccaactgtttaaatggtgttcaataagggtatgggcttaatttgcaaaaggtgagttg

SEQ ID NO: 469594 - DNA, 909 bp, Homo sapiens
cccatggggacccatggagcatctcaatcacatgtagaagggaattgttggagcatttgggctgatgatggaggacttgcgaggagggttcaaggagctgaacactcacgagtatgcacaccccatttcacacatccgagctgatcgctcgccaccacttgggcctagaggtccagtcacactggcagcgatgtgcatccttgggaggatgatctctggagagaggcctccacagacctgtggtggttcacggaagttttgcaaaggagacgagagccttgaggatggggagccttgtggctggccatcagaagttgacgatgaccagttaagaacaatcatcaaagctgatcctcttacaaccacacgagaagttgctgaagaactcaaggttgactgttctatggtcattcgtcatttgaaacaaattggaaaggtgaatgagcttgataagtgggtgcttcatgagctgagaaaaaatttaaaaaattcatcatttgaagtgtcatcttctcttattctacacaacaacaatgaaccatttctggatccgattgcgaggtgtgatgaaaacgttggtcaacagaaagggcccaattcttctccaccacaacatccaaccacatgtcgcacaaccaacgcttcaaaagttgaacaaagggatgtgaagttttgcctcgtctgccatattcacctgacctcttgccaatcgactattacttcttcaaacatctcaacaacgttttgcagagaaaatgtttccacaaccagcaggatgcagaaaatgctttccaagagtttgttgaatcctgaagcatgggtttttatgctacaagaataaacaaacttatttctcattggcaaaaatgtgttgattttaatagttcctattttgattaataaaaatgc

SEQ ID NO: 469595 - DNA, 747 bp, Homo sapiens
cagacagctcctcactgccctcgggcgctgatgcggggtctgggcgcaggatgcgcttgagctgagtcggaaggacaacttggagaccccactcaaaccaggatggagggaggcttttccaggcttggggtacagggtattttcagacctccagaaagaattcgagaaggaggcagacgttggttgtgcgacatgtggttggatgttgtggtggagaagaattgggccctttctgttgaccaacgctggctgcaggtgctgcagttttctgtgcatctcatggatttgctgaggatacttctcagatgtaatggtttcccagggattcagaaagctgtagtggatcagaccagcagcagaccactaaacagtgaccatgacctttttttggtgcaagtttggctttgggaagtgccttggagcttcttctcagtccaaccactgagctgttcattgccagttttcagtcgttgtataaaatccacttttcatcacacctcgcaatcggatccagaaatggttcattgttgttgtgtagaataagagaagatgacacttcaaatgatgaattttttaaattttttctcagctcatgaagcacccacttatcaagctcattcacctttccaatttgtttcaaatgacgaatgaccatagaacagtcaaccttgagttcttcagcaacttctcgtgtggttgtaagaggatcagctttgatgattgttcttaactggtcatcgtcaactt

SEQ ID NO: 469596 - DNA, 947 bp, Homo sapiens
gtgtctgtatgaagtgttttgttttgttctggcatctctctgtgtgccatctgattgttctgaaacttttaagggatgtggaggaaatactggtacctgtgcacaatgtcaccagatgtgggctcttcaggaatcacatttcattggctatgcaattttaagaaagcaacagatgaagaaggtactcatccgacaaatggtaataacgaaacatatgctaccatcatgtctaccatcatgaggatgtttcaagaagccaagagtcataaatatttcgatctggaaactgagtggtcagctggccccacccatcaccttatggatgaggacaatgaggtgtcaaagaagagattaagaagacatccatatcacgaattggcccctgtggccacaaagcatagatgcattcccttggtgtgcatctggagcaccaaaatgaaactgagactccaggacaacgcagaattcacacagcatgtggctgtcattcaaaggcaaaactgctttagaaaactagggaaggaattccagctttaaacggaatgctttactcttttggaaagctccaaaatgaaaattccgcccctcaaaatgtaaatgcatgcacttttacaaatagtataatcatgcaaaactactcagctgcttcagatgtttttggcaagctggagtacaagttgacaggaagtacttgatgtgtatgtcaatctcataaaatttacaattaaaaaagtagtttcgagtgcccaagtttgttccaaatatactaaaaagtctgccaatcactgagtcaagtattcatttctaaattcaaacctaaatgaattaaaataagataatattaaaattccagctccttagttctctagccatatttccagtgttctgtagccacatgtggccagggggacagtactggacagcatagccacgagcctgtatgcctc

SEQ ID NO: 469597 - DNA, 686 bp, Homo sapiens
agaagagcaggtttctcagcaacatgggacccgccccatccctacccacgggacctgccaacctctgcagccccactaaccctttggttaccctgtgcccagtttctcctgcctcctatggcttgggctgtggcctgccacaaaaggctcctctcaaggaagaggatatgcgtccttctgttcttccccaccgaccccgccacgtctacaggttctggccctcactgctccagggctccttctttatcgtgccctttaagtggagcatatcaagaactatgcctggagaacttgaatcattagagctccttcggcacactgtccagacgtttcctcccttgcctgtgctggttcaggctgaggctgtggagtcagccctgagggaggaggggtgtgaggaagagaacggccgggagacttctgctgaggttgctgatgtcatgacaaggacccaactcactgctgctggctttgaagatggaggatggggccaccagccaaggaatgcaggtggcctctagaagctggaaaagaaaaggaaatggattctccccggagcctccagaaggaatgaagatctgctgacaccttgattttagtccaggaatatatggtaagcacagcagagactgtgatttattactgtaatataacaaatttatgtctttaaaaaaccaacaatgttc

SEQ ID NO: 469598 - DNA, 919 bp, Homo sapiens
cagccctgcccccttctctgtcctcatggaactgaagtcaactataagctgttattttactcagagagctctctccagccacctcccgcctctacaaacccagttctcctgtcccggactccaactgtgtaggccccaggacttcagagggacccggctgagcctcatgtttagaactttctgctctcatgctttctaccgtggtggttttcagtgggggatggggcagcaatttctcctcgcaggggatgtttgccaatgtctggagacatttttggtttcacagcagcagttgaaggtgggagtggtattggcatccagtgggcagacagagatcagggatgctactaaacatcctacaacgcacacagcaacccccacaacaaagaatcagccagccccaaatgtccacagtgccgaggttgagacaccctgttctactacagcaaactgtgtttttatcctttcagacaaatgcttaggtctatattgttagtgcaaagctaagcttcacagaagttataatcctctatttgtgacatcataattagttgccactggagaagacgatcgtgtcacaaaaggattaggacctaagtcttggagtccagccactatgctgtggggaagcaaagaaagctgtggagaggccacgtggggaggaatgccatccttagcatgggctgagctcccaggcagcacccatctccagacatgcgagtgaacaggacttccggcaattccagccccagccactgagtcacttccagtttctcagtgtttccaggggaggcctcagacactatggagcaaagaaaatctgacccagctgtgccctgtccaaattcctgacccatagagaatacaagagagaataaaacgatgttgtttaaaccattaaattttgaagaaatttgtt

SEQ ID NO: 469599 - DNA, 534 bp, Homo sapiens
agcagtctactgtttgaattagggaaatgcaaagagtcagccattggggatagccggcggagaggagctgtggctctgcagaaactgtgttaatggaagtctggggacaaattgtggaagtttcgaacagttcaactagcagaggacactttgaagcccacttaaaagctaagatcactcctcacacccccaactgccgcagggacttagaaggtcctccttctccctctcaggctaaggttcatctggctgactccttttctcagtggtactctgtgggtttctcaaaggcttccctgggcctcttggacagggcctcacagaagggggtagcagtgtttgccccgtgtgggcctcagatcactggtattaggatcgtcagtggcttttttcacctgcagattcccagccccacccacccaggacttacaaatgagaatctgaattttcacaaggacttccccctccaaatgattctgatgccagtagagtttgagcaacaatgaaccacacgacaataaatccccttcagtc

SEQ ID NO: 469600 - DNA, 666 bp, Homo sapiens
agctccactcactatctggattgtgaacctgagaactgcacgactttcctggaaggtgtccccttcctccctcacggctccatgtgcgtccctccggaagctgtgtgctcagtcaaaggggacgaccatccccaacagaggaggactggtcttcgcttaaatgtcacttcatcaaagaggccttccctgaccctctctcaatccaaatggcattctctcctgtccccatacgtctctgtcacagtgcttatcacagtttttcacggtgtgtctgaggactgcccgtgcattgcctggccccccagcccatgtgtgagtgtggaggaaacaggaaccctggctcctgctgtcagtgcccagcagagtgcttatggcaaagcaggggctcaggattttttggatgaaggagtgaattgtccatatctgtgtttcgtaaattttgacttcccctgtctcagacctctagacctagacacagatttaaagagctcatgtgatgaggtcaggcccatctagataaaatctctttatcttaaagtccactgacttgggatcttaattacatcttcaaaatctcttcacagcaatgcctagattattgtttggtttactaagtgggagaaagtgtgtgtacacttggggttaggtatattgagagctatcttc

SEQ ID NO: 469601 - DNA, 507 bp, Homo sapiens
tccctggaatagtataattacagtctagtgcatagagcggtatggatgagggggatgtgtacattcacagaggagaacacaagggccctagggccaataaatatttaccttttattccaaactggagttactgtttggtgtgtttgataaagacaaccttctttactcactatgagatttccttggtccccggcttttcatacccgttaatggctttatggccatttcctgaaattcttgaactctcctacaagctgtttgttcatggccaggaaaaccctaccaccaaacagccgtttttattaattttctggttgaaaatgttttatgagtgcaatggttttcagacctgcttgatcatcagaaataactgtggaggtgtggaaagttactcaaaattgctttctcaaacatttggtgaatcatcaaagcagaaatggcttctccttcttcggtgacactcatttcccaaatttgccataggcatacatatgcctcactccatgc

SEQ ID NO: 469602 - DNA, 1626 bp, Homo sapiens
actgactggcactccctaattctgctcctcggatttctctgaaccacctggggccgcgacgaaccacctggggccgcgacgccgtaagagttgggacgataggaccagtagaagcaggaggaacaacacaggaagcgcgcccggagaggcggccagtcgctgggttccgtccgcggtgctccagggctctcctggctcttcctccattcactcttctcgaccctgtggccggggagcgcttgcagccagctccgccgccgtccttcttggctcgcgccgtcccctagccgtcctcacgccgtccccttacttagggtcccctttccgcacccgcgccatcccctcagcgtccctcacggttccctcaccgcccgcgcccgttcgaaaatgcccagagccaccgctctcgtcacggtccgcttcaggcctccattggccagcacacgtcacgtgcggcgtgtggcggctgacattggcgggcgggcgcgctgagggcagcgccggggacgcggcctcagcaggggcgccccgccacggggagcagcccaggcgctcgccccaggacgttgtccggcgggctgggctgggacccctctgcctccagggcgcgtcgggagcagcagggatcggtgccgcgccgtgagggtgcgcagaggctgccctcgggcccgctacccacagaccctccgcggggcagcgtctccgggccggccgcgccctggtccgccgaccgcagacgacttgtgacacggacggcgcgtcctgctgaccccagccggcgccgagggcttggaatctcgagcgggaaaagagagtgggacgtccggcttcggggtaggaaccttcgttgcgccagcgacaaaaaagaattaaatatgggtgatgttgagaagggcaagaagatttttaagacaggtcaggccgttggattctcttacacagacgccaataaaaacaaaggcatcacctggggagaggatacactgatggagtatttggagaatcccaagaagtacatccctggaacaaaaatgatctttgctggcattaagaagaaggcagaaagaaaaatgatagcttatctcaaaaaaagctactactccacttctaattctacttctcttgctgtttacactacatgtacagatacttcctccactgaagtcttgaacctctccaagtcatccatgagggctggaatcagcttcttcctaactcctgttaatgttggtattttgacctcctcccatgaattgcaaatgtccttcatttgtgattcataaaggagagttcctgttactctccatccttgccactttgatattgctagtttttttaaaaaatccattctaatagatgtgtaatggtacgtattatggttttagtttgcacatcccctatactgagcatcttttcatatacttagttactatctacatgttttcagcaaggtgtctgttcagatcttgtgcctatgttttttagtagaaattttaaaatatagtatcaaagttttatttataatttaaaaataattataaagttcaaacaatacagaaatgtataaagggaataaaataggatatacccttcctctttgctccacacctaaatttctgaaaatga

SEQ ID NO: 469603 - DNA, 884 bp, Homo sapiens
gttacccatggctgcttttggactacaaggcagtgttgagttgttgcaacacacactccatgacacaggatggcccacaagcctaacgtgctccactatctggacctttatgggaaaaatttgctgacctctgactccacacagcagccagtcatcttttcaaaatgcaatggtgatggtgacagtggtgatggtggtggtgatggtaatggtggtggtagtggtggtgttgatggtggtagtagtactaccatcatggtagtagtgatgatggtattggtggtggtagtggtgatgttggtggtgatagtgatggtaaagttggtgttggtggttgtagtgatgatggtattggtggtagtaggggtgttgatggtggtgatggtgatgataatggtggtgttggtggtggtagtgatggtggttgtggtggtggtggtagtgatgacagtattggtggtggtgggaatggtgatggtggtggtgatagtgatggtaatggtggtggtggtggaaacaccccctgacagcccttgtcacccaccaggctcagcccagggccattcccgggtgctcctaggacaccctgtgcatggctctgtggttgcacttgcagctttaaattatgcttttctcttcatgtatgcatcttccccaccagactgtgaacttgtcatggtcaagaagagttgtccttgacgtttacctttctctcatccccaacatgctgtctgcccatcctgttggctttacctccaagacagctccagaatctggctgctgctcccctcctccttgccacaccctcctccagacctctgctgccatccctgaccaagacagtggcaagaaagcctggactccctgcttccaccccagcctcc

SEQ ID NO: 469604 - DNA, 1036 bp, Homo sapiens
agcccctccctgtcctcctgctcccttgtcaccctcctttgaagaaccctgaaaaatagaacccccccccgccacggggagtggggaggctcaggcatggcgggctgcaggtcccgagccctgcccggcagggaggcagctaaggccctgcgagaaatctaccgcagcgccgccgctggcccgggtgctaagcccctcattccccggggccggcagggctggccggccgctccgagtgcggggcccggcaagcccacactcacccggaactccagctggcccggcaagcgccgcgcgcagcctggttcccgctcgcgcctctcccttcacacctccctgcaagctgaaggagccggctccggccttggccagcccagaaaggggctcccacagtgcagcggtgggctgaagggctcctcaagtgccgccaaagtgggaatccaggcagaggaggcgccgagagcgaacgagggctgcaaggactgccagcacgctgtcacctctcaataccgtctgtttatatactttgaaacggtttatataacatgaaatttccatccttcaaaaactctgaaaacccttgcacactgttggtgaaactgtaaaatgttgcgactgctatggaaaacagtatggcagttcctaaaaacattaaaaatggaatcaccacatggccgagcagctccacttctggatatctgtccaaaagcactgaaagcagaatctcaagagatagttacacatcgtgtgcaaatatgcacatgttcatatcagctctattcacaatagcctagaggctgaagcaacccacatgtccatcaacagatgaatagataacaaaaatgtagtgtatacatacaagggaaactttaaaaaggaagtaaatcctgtcacgtggtaccacatggaagaactttaaggacattatgctaagtgaaataagtcagtcacaaaaggacaaatactgtgtgattccacttatacgaggtaccaagagtagggatattcatacagacagaaagtagaatggtggtta

SEQ ID NO: 469605 - DNA, 809 bp, Homo sapiens
tgccctctgccctcctctccagtgtggcactgcctgaaggcctgggggtggtggggtgtcctggttcacccttggctgcagccgaagctgcctggggcaggttgtgccaccaagaaagaggccagcagctgtgagcagcgatggggactgaggggagggaaagaagaaatgatacccagtcactcgattaatgacagagggtgtacccacacaaaccaatggaatagcctactgcacacctaagctgtgtggtgtagcctatcgctccgaggccacaaacctgtacagcatcaacagtggagagccacctcctcgctgtggacacaaccgccagcggtcaatccgcttccctcaacaccgtcatgtccacacagggacctgggctgctggattcctaatcagtgacactgagcttttatataacatcaaagagggatttgtgtcatcagggaagtgggggacggcaggagggatgtggcccagtacgcagatgaagacaggtgatcatccgctgggccacacgtggcagggatatgggcagagtgagcttggctggccccaggctccaaagctgcccagcccccgctgaagaaatgttattagaatatggaaatgtgacattcagcactaatcagtttgacatatgaatatatctatacacatatttctccctgaaattggcctaaatactctttcttggaaccaaatgagaagcaaacaacctttacaactaaacattaaaccataagatgaacatcttagttgtctacctagaaattgtacagtatgacaagtgtaaagaaactgct

SEQ ID NO: 469606 - DNA, 515 bp, Homo sapiens
gaccctggcaccctggaaggtcttccatgccggctctccccctgctccttccctggaggttatgtttctggagcgcagctctgactgtgtggatttccagctgcgaaacactccagggcttctcattatccagcaagcaaactctgtcctctctctttctgcttaggggccttccttgctccacccccagtaagaatgtggggctgtggagcaggaggataaagtctgaacttggacctgttgttctcagctattcgaagctttctcaagtggaaaatagactgactttgggtccatcagagggcagaacaaatgctggagagcagatgctagaattccgtcttaaaaccatgaatccttacagcggcctgcgtggcctgcgccatctgtcccagccacgccctccttggccccatctccccctttctcgccctgactctttggcatcctggcctttccgtctcactgggatgcttccctaagagactcgtgtggtttgctgccctgtatcctcc

SEQ ID NO: 469607 - DNA, 536 bp, Homo sapiens
cggtgatcattccacaagctgaaatggcttcaaaatcacctttatgagtaataagtttattccaggaatgtggcaaaatgcaagtctgataccagaacgagaccttctccgaaaaaaacaaaaacaaaaacaaaaacaaaaaccaaaaaagcacttgggcagcagccgaattagaaaattagatctcctcatgtggaagagggtcagtgtgattcctaaagcagaaagggctaacatcagtgatgtgaagtcgtcagcctgtggttctgagggaatgggccacggtcctggaggatccccatgcctgcgcccagcccgactgggcaagatgatccactcctcaccacccctaggtacaagaagagctcctcgcctcctggaggacagtcaaaccacaaaaacatgccttttaagaagtataagcacaaatccctctttgatgttatataaaagctcagtgtcactgattaggaatccagcagcccaggtccctgtgtggacatgacggtgttgagggaagcggattgaccgctggc

SEQ ID NO: 469608 - DNA, 528 bp, Homo sapiens
ttaagatcttcacagcagcccagaaatctggtcgctgagggctgtctctgggggaggttggagtctgtggttcttgggaagctgtcccgcatggaattctactttggggaagacagtcgcggcctgtggagggaaatgttaaacagtcccgggccgcagcctatgggtcccttgctcactgcgggccagggcggcccggaccctggggacagtgcgcgggtggcactgacgagacgagacgggccgtggaccgtttccctcgggggagcgtggcgaggaaacggcgcagacctgagtctgagcctgggttggctgggccgctgcgcagggcgctggcacacctgggaacaagtgcgctccgcaaatcgcggcgggaggccccggagggacgccggggaaccacagcgcctgctgctggcgccacaaaacccaggctggccgagcgtagaaagagacgctttctgtgggctttatcgtctgcacggtcctatccattagaagggagtctcctcaccaggaacccgtaac

SEQ ID NO: 469609 - DNA, 816 bp, Homo sapiens
cacttcctaaaactagaggctccgtggttggtcgtctgacatttttggcaagatgaccacagaaatgaagtgtgcccttctcagtgcatcacaccaaggggtgcatgataccatagtgactttgttaagcacaccttggctgtttggttacggggcatcttcccagtttctctactataaagctaacaacttggggaaatactctgagattatgcaaagcctgtctcctcacaatttccccctgggttttagcatccatcagttgctcttgcccacagcatttttcctgggggctttgcccacggctgcttttctgttgctctctttccttctgtgtctgctcaccggaccactccttctcagctgcctctgtctccatgtgggctcactatgggcttgtagacaacgaaatcccaggacttttactgataaaatatctaacatttgtaaatgcacagtttacaaactgctctcacttacactatctcatttgatttcctcacatgaacagctgcccagaaaagcctctgcattctgggacccctgcaatgggcatttttcatccagcctcagtggaacatccaacactgtcctcgctgaatcatcttgttaattgggtgccagcccaactagttgagtcatttactgtattaacttggcgtcactggaaaatgaagtacatggactttctctgtcattattcaagtcattggtaaaaatattgaacaggacagagctaaaaacctgtaaatttttattttcaataacactttactattaactggactacccaaagagataaagaaaacgagtagt

SEQ ID NO: 469610 - DNA, 676 bp, Homo sapiens
aggaaaattgatactcctcacccccgattcaatagagctattttcactggctgatttagaatacagatgtgcattccattgtcccccctcaccagccgctcaggtcttccaagaacagtgttttctccagggtgggcccaggggctgtgcagtcattaccacaatcaaatcaagaacatttctgtcaccccgaaagtttccctgtgctccttgtcaattctccttcactgtcaggcccaggcaatcactgacctgcttttgggcactatcacctttttggaacctcatgagcgggatggctgggtgaaggatatgaactctgttaagggttttgatgcatattgccaaaccactttccaaaaagcccgtgatgattcctccccgatcggcagctcacaggcgttaacatctgagctttttctgactcaattcctgttaaatgtctataactgcgggggagtcttccagttctacagatgcatggaatctgcgttgtgtggtgaggagaggcagctgatggacccaccctgcctggaagaacagcaccgtggggaagcgcaaagggctgggcgccagtgacccctccacagactattttggaagaaatatgggtccaaatgaactgccctgtgacaactgaagtgccagcttctaggacagcctcaaaagggaaatc

SEQ ID NO: 469611 - DNA, 585 bp, Homo sapiens
tcgaaatcagatgcttggaagaactcagaaatcaagagttgcagagggtggagccaagatggccgaataggaacagctccattctacagctcccagcatgagcgacgcagaagatgaatgatttctgcatttccaactgaggtaccggattcatctcactggggattgtcagacagtgggtgcaggacagtggccaaggagaggggtgacagacggcacctggaaaatcgggtcactcccaccctaatactgcgcttttccgacggtcttagcaaatggcacaccaggagattatattccccacctggctcggagggtcctacgcccacggagcctcgctcattgctagcacagcagtctgagatcaaactgcaaggcagctgcgagtctcggggaggggcgcccatgaacgccgaggctcgagtagacaaaactttcagaggaacgatcaggcagcaacatttgctgtgcaccaatatccgctgttctgcagcttctgctgctgatacccaggcaaacagggtctggagtggacctccagcaaactccaacagacctgcagctgagggtcctgaatgttagaag

SEQ ID NO: 469612 - DNA, 692 bp, Homo sapiens
aggtgacacctgctccagcgtccccagccttgcacggagccaagctattcaattttgccaaatttccataacgtccacttgaattgcgggcaagaagattgaacataatgcgaagattctttgcaaataaaaggtcccagctccacccagccctgctccttcgtgttggtagcagatcctgctcagagacaggcattgtcactagtgttaaagacatagtggcccatgtgccggacagtcagctcacgctgggccacatggaggagcacagcttcaccgagcccatcctcatccctaagaaagacgggctgggcttggctgtcccggcccccacgttccatgtaagcaatgtcgagaaatacgtggaagtctcctcctcgtctggattccatctgggttctagccagtgccatcgccatcagcagtgcccattttatgtccccttgcagctccagatctactgggctcagtgcagtgtggctgggacagatgtcaccaagcagaaggactgcaagatgaagctgcaggagtttgtggactatgactacatcaccaaccacaagcgggtcctcaccatcaccaaccttgagttcttcgacacccagtgagcgccgacaccatgggggtgtgggggatggggttggggcaggggctctgtgctgtccttggcagtcgcctgagaagcacaggac

SEQ ID NO: 469613 - DNA, 3284 bp, Homo sapiens
gttttgccctctgtgatcctgtgtgctcctctgtgaaacgggagctgtgacctgtggcccgcaggtggtgagagagtgtgggacatgcctcacagagcatgtttcctgctccaggggacatcaaaaagggagtcccaggttccctcaccaccttcctgtcccaccccaagaatgtccagcttcgtggagccacctgacaccatgaagaaactgttccgggtagaaaactggccagatgatgcattgctggccaagcccaaagtgaccaagtcctgcctgatctgtgtgaaggacagctacaccgacttccacatcgactgtgggggcgcctccgcctggtaccacgtgctcaaggtgagtgcaggcagctttggggaccgtgtcctagggcttgcgggccctcgtcaaggttactcccctgtccctcgggccgtgtccccaccacgggatctgtctgcatccctgacatgcctgctcccttgtccggagcttaacgccaccccggcccagtccctgcagaggggcccgcagtggagctgtctggtcagcatgggcactcctcaccaccgaggccaccttggagctgcacagccagcactgacagagctctcgtgggccccgagccctgcagcctcccagggcggttgtcccctggtccacttcagctatgcagggcccagtggggaagcctgagctggtgtgtctggggcttggacccacccccatcgtcgcctgcttgatgtttgcagacggcctgtcgtgggacttcaccttgtgattgtgtgagttaatactcttcaataactctttttatatatacattacctattagtcctgtccctctagagaatcctgactaataaaacaagaggcaggccttagtcatagtaagaggggtggacgttatttagaagcaaagacagttcacccatatggaaaagagagataacagaatgtaggtatggatttatgaaggtgagcagatgtagtgactggagactttgaagttcttctcaaattaccacttttttttacaagtgaaatagaaaacaaagtcatcagcaaagagtgaaaatgggaaggagagaaaataaacatgaactgttactctgggaaaggatgagagtgaatggagcagggaatattatttttttctaggaaatataaagacatgagctttgtgatcatgaatttcagttgaaacaaatcaacctgattccctcttactctattttaaattttagttttatttattaaaaaatctgaacataatatccataattagagtattgtacagaagagtttcactgccctagaattcctccgtgctccacctgctcatccctctgtcccccgttactcctggcaaccactgattttttttaactgtctccatacttttgcctttcccagaatgtcatgtagctggagtcatacagtatgtagcattttctgattggcttcactcagatagaaacatgtaattgagattcctttatttctttgtatggcttgacaggtcattactttttaatgttgaataatatttcattatttggatatattagtttatccatttacctaattaaggataccttggttactcccaagtttggcaattattaagctactataaacattcttgtgcaggtttttgagtggacatgctgtcaccttctttgtgtaaatactaaggagcatgattgctagattatatgagaagagtttgcttcgttttgtaaaaagctgacgaattgtcttcctaagcggtgtagcgtttgcattcctaccagcatcaccagcatttggtgctgtctgcctttcctattcatcaggctccatcttcataatttttctgcacttaaacttttaaaataaaagtcgtcatttcatcccctgcttcatttcttaaacatcctttaatgagtaccttaaagtcagaaatctccagaaaatgaaagtgttaaccatatattgagagctaaagactgcagagccaaggggtgatactaagttggtgatgatttaaaaccccagttgaaaaattcttatagctaaagaagaggtatgatattttcatatatatttccttctctttcacatgtgtaaacttaagatagtctggagtattgtattcttgggaaaatcagagctgtttaaaaaattgttgtttataatgtttagaaatttagacctaacattttcatggtaattagactagagtagacttagctaaacagagccatttattagccttttgtacatactgctttagacagatatattagataataaaatactgaaggaaaataaaatagtgtaaaactactttgaggaagtatccaagaaaataagataattgtggcatttctactatctacactcaatttagaataataatagggtaataaacatcactggtaggtaaacccactgtgataagaagcatgaaagtataggtagcaaatttcagtgaagaatattaatattcattaatgagctcatacaatcaaatgcttaaaaccaaagtacttcagtatctcagagatttaaaggatttttttgtgtgtgttttgttttgctttgcttcttgccagcagccttctccttattaatataacagtaagaggccagtgaaaattcatatgaataattctgtaaacagatattttgtagaactaaatatcaatgttcataatttattattgtaaattattcaccaaaatgaaaatctaaaaaagggtgatttgaaaggaaggaaatattaagggaagtagaataagtatttacctaagtcataaattagatgaaaaatatttgcaaccagtaagagttcctcagacatttcccaacaggaacaaaatgggtatacagtgtggatggtaagaatggttaccgcctgcttgtgtaccttttggaaagcacaatatggggaatgtagtagctcggtttagagcatgtgaatgtctatctctttctaaaagtgcatcgaggagtttgggaactgattttccaagacaatcaagcacaaagcaaaaagtatgtatgtagaagtcatagtactggattttagttcttatttcatcatttaactgtacaagactccagcagctaactgaacttgtgcaacttcatcctctcatctgctagtatgaatattaataactatttcaccaagttgtaagaatcagtgtgttagcatacataatgggacttgggcaatgtttgaaatatagaaaatgctcaataaatgagacatactatcttattaaactccgaccatc

SEQ ID NO: 469614 - DNA, 670 bp, Homo sapiens
agacaggatcctacctgcaggcggtgcttcagagcacagctttactgttcgtagacagagcacctgggggaaggagcagctgtgggcgcagcttcagtggatttaaactttcctgcctgccagctctgaagacagcagctgatcctgacaagtgggattctcccagcacagtgcaccagctctgctatgggacagactgcctcaagtgggtccctgacccccaagcgtcctgactgggagagacctcccaacaggggtcgacagacacctcatacaggagagctctggctggcatcaggccagtgcccctctgagatgaagcatccagaggaaggagcaggcagcaatctttgctgttcttcagcctccactgttgatacccagcaaactgcagcagacctgcagaagaggggcctgttagaagaaaaactaagaaacagaaagcaacaatatcaacatcaacaacaacaacaacaacaacaacaaaaaacccacagagaaacctcatccaaagaccatcagcatcaaagatcaaagaaggtgggaaataacaaactcctctgtgctaaaggagcgtgtactaaccaaatgcaaggaagctaagaaccttgataaaaggttacaggaactgcaatctagaataaccagtttatagaggaacataaatgac

SEQ ID NO: 469615 - DNA, 616 bp, Homo sapiens
ttcaggtcttttgccttttttttttcccattgggcactctacacttttcttactgactgcaaatgagtacttaaagccaaagccagtgggagcagcggacaatgaggaccagctctctgaccttagtgtcttccgtagcttctctctcttattctgctgtagctacaaaaaccctctttctagtcttcaaacattccaagcatgttgtagctgcagaccttggcatttgttcccttcaccaggaaagctcttcctcacagcctgagcatccacttcatctagagttttccttccaacagtcaggaccctcagctgcaggtctgttggagtttgctagaggtccactccagaccctgtttgcctgggtatcagcagcagaggatgcagaacagcaaatattgctgcctgatccttcctctgaaagctttgtctcagaggggaatttggctgtacgaggtgtcagtcggtccctactgggaattatctcccagttaggctactcggggctgtcagacaaggacgtttaagtctgcagaagtttctgttgccttttgttcagctatgccctacccccagaggtggagtctacagaggcaggcaggcctctttgaactgc

SEQ ID NO: 469616 - DNA, 727 bp, Homo sapiens
gcagccttcgagtcaatgaaatgtcaccgtcctggataaaatgcactacatttcatcaaaaacgtcaaactagaccagggacaccatgtttctgccctcatggatgttacatttcagacacagaagtcagacaacaaatacatacatctataataaaacgtcaagagagtctatactgggggcttgtgagctcctggctcaactctcaattcctcaattgctgctatcatgcaaaagcaaccacagacaatcagtataaggtcctgggtgggccagtggagaaaaaagaggatgatgaccattcccaaggacatgcaatgagccctttccttcacttacaattacttcaaaaccaagaggaaagggccattttgttctcttctggctgttacccatttctggttgtctgtataaaagaacaaaaagatgaagcccccttgttatttgcctgggagtctaggatacagcaggctctgggtaaatacatactgtaaagttggcaggtagaaggggtttttggctgttgtttttcaaacatattatgaatatgttgacattattaaaaacacatgcacatgcacatcaccattgccccagaagcctctccagctcacgagtgtcaagcccactgatttataagattgcttgcacatattatattttaaagcacatattgcttttgtgaaatgtgtatttattatgcattttggaattgataatgtatgcc

SEQ ID NO: 469617 - DNA, 703 bp, Homo sapiens
gagagggagggggccaaagaccaagttgtgtctaaatgctgtatctatgggcactggcctggaaccaaaggccatggggttctgcccagtgctgtcctttactatagcagagctggcactgggctccaagggaaagtcccgtggacccttccttgtcccccctgcaagaggtggacacattctctgcactgcactgactggggttgagggaggggcagtgcagtcactgcaagatggtcttttcatcctctttaatgtgttttctcttgtttttaagctaaaacccggttctgtgatctgtcacctgctttctttagctcttgtgaaggtactatcttgcttggattgttggacggtggttcaatgtaatattcttgcagagacacagtcactgagattctatcctccatctcgctccacctcttctcatttatttagttcttcttcagtttatttcaacaatattttggaggtttcagagtattcgttttgaactgctcttgttaatttctaaatttattacttcagcagaaataaaatcttagcacttgatttagtaaattcctccatttaaaataagatgttactttagcagaaacaaaatttatcttaatgggataataattcactagtttacctctgatgagcatcagctagtatttaatccattgtgaaattacacagcatcaaaataaaatataat

SEQ ID NO: 469618 - DNA, 765 bp, Homo sapiens
ccagaagacttcaaagctgattgcaaaagcttctgatgtttgcaaaattggtagtcggttggcgagaggtcatttgaatatggtggatgaggcaaaatttcatagcccagttcattcaacttttgaaatgttggttgtgcaacgtgttgtcggttgttgtcgtggagaagaactgggccctttctgtggaccagtgccggctgcaggcctggcagtttttggtgcatctcattgatttgctgagcgtacttctcagatgtattggttttactgggattcagaaagctatagtggatcagactgggagcagaccaccagacagtgaccctgacctctttttcgtgcaagtttggttttgcgaagtgctttggagcgccttcttggtctattgtaagaggatcagcttcgatgattgctctcagttggtcatcaccaacaacttctggccggccactacactcctcgtcttcaaggctgtcgtctcctttgcagcacttcttcaaccaccaccgcacagttcctgggccaaatgtgtagttgatctttctgtggttttgaaattacggaatctgctcttctctagcaagggagaggggtcttcttctgctggcccatagcactcagagcaatctaggagctcagatatctccctctgagactcgtctctatttttgacatagaagacttgcaatggctattaattcagctgcttcttaactcctagcatccttacaaacaaatattaatcctgattttcagcatatt

SEQ ID NO: 469619 - DNA, 784 bp, Homo sapiens
ttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacat

SEQ ID NO: 469620 - DNA, 459 bp, Homo sapiens
cacatcacaattttaagtcactttcctccatcacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaaggaaatggtccaacatccactggcaaaagatatgttgcagaattagctggcttaccaggcatgccaaatatacgatactacacaggatggttgaattttattaaatgtcattccaaagccagacttcactggcacagtgaaaggaggcgttcttttgaagagaactgtgtcttacagttttgttgccttcaaaatggccttttgttccaaattataaattagtatttaaaaaagtatc

SEQ ID NO: 469621 - DNA, 614 bp, Homo sapiens
gcctcttaagctgcagccggcagtgcagaagggaaatgtggggtcagagcccccacacagagtccctatgggggcactgcctagtggagttgtgagaagagggccactgtcttccagaccccagagtggtagatccaccaacagcttgcaccatgcacctggaaaagacgcagacactcaattccagcctgtgaaggcagccaggatgggggctgtaccctgcaaagccacaggggtggagctgcccaagaccatgggaatccacctcttgcatcagcatgacctggatgtgagacatggagtcaaaggagatcattttggagctttatttgactgccctgctggatttcagacttgcatggggcctgtggccttttcgttttggccaatttcccccatttggaatggctgtatttatccaatgcctgtactcctattgtacccatggaggaaactaacttacattcgatttgacatgcttataggtagaagggacttgccttgtctcagatgacactttggactgtggacttttgagttaatgctgaaatgagttgagactttgggggactgttgggaaggcatgattggttttgaaatgtgaagatatgaga

SEQ ID NO: 469622 - DNA, 563 bp, Homo sapiens
tgttcatctcggcctcatgcctcttcaggaagttgcctctgcccagtttcacgggccaccaacacctgcgattttgcatattcctgctcagaccacaaaaatctttattataacgtttgagtaccctggagtggataactccaaactgacccaaacaccgtccttccatcttcaaggtcacttggtaagtaaaaattggaagacaggcttccaggtctatcagactccaaagatctgcactctgaacccccgtgtttctcagcaggtggaacacctgacttttatgagtgacacaagtataaagttggaatgcaaatcattactctggtgcatccctgggcccccagcagtatggctggtttggttcagggcctttgttgaaggttcaggtctgcttcgcagatggcttgaaaaggaggatgaagaggaaggggaggaagaggaggagaaaaggaacctaacaacatgtagttgaggcttctgcctccaggaaagattggagagatgaccctccagacctgtttccttatcactacaaatgggcttaggggtgcaggcagacc

SEQ ID NO: 469623 - DNA, 718 bp, Homo sapiens
gtcaccagcatcaaagaccaaagagaagaatataaatgacctgatggagctgaacaatacagcacgaaaacttcgtgaaggatacacaagtatccatagccaaatcgatcaagcagaagaaagggtatcagtgattgaagatcagcttaaggaaataaagagagaaaacaagattagagaaaaaagagtgaaaaggaatgaacaaatccttcaagaaatatgggactatgtgaaaagaccaaatctatgtttgattggtgtacctgaaagtgccgaggagaacggaaccaagttagaaaacactcttcaggatattatccaggagaacttcccccacctaggaagacaggccaacattcaaattcaggaaacacaaagaacatcacaaagatactcctcgagaagagcaaccccaagacacataatcatcagcttcaccaaggttgaaatgaaggaaaaaatgttaagggcagccacaaagaaaggtcgggttacccacaaagggaagcccatcagactaacagtagatctctctgcagaaaccctacaagccagaagagaatggggccaatattcaacattcttaaagaaaagaattttcaacccagaatttcatatccagccaaactaagcttcataagtgaaggagaaataaaatcctatacagttaagcaaatgctaagagattttgtcaccaccaggcctgccttacaaaagc

SEQ ID NO: 469624 - DNA, 3040 bp, Homo sapiens
tcctcctctttttttgtgttcttaagctcggagatgtttgttattaccgaccttctgaagcctactgctgtgaacttgtcaaagtccttctcagtccagctttgttccgttgctggcaaggagctgcgatcctttggaagagaagaggcgctctgtcaggaacctcagctgcaggtcttttggagtttgctggaggtccactccagacctgtttgcctgggtatcaccagtggaggctgcagaacagcaaatattgcagaacagcaaatattgctgcctgatccttcctctagaagcttcatctcagaagggcacctggctgtacgtttggaaaagcacagtattaaggcgggattgtttcaatattccgggtaccctgtatggcttcccttggctaggaaagggaaatcccgcgaccacttgagcttcctgggcattgcaattgatgatgaagatagtaacagtgaacaatatagcatgaatcttgactttgatggagtttagatttttttgataacccaatagaaataaataatctattttttcaaaaagatatatgaaatttagagtagtagaaatatatagtactatataacatagacaatacttctaaaatagctttagcaggaataatgtaatattcatggaaaaactgatattgaaactaaaccctgaaaaacatttccttattctggaaccaagaaaaatgtatacataaagattcagaagtaacaacttgtgttgatatccttgaataatattatgagcacaggagatatacctaatgtaaatgacgagttaatgggtgcagcacaccaatatagcacatgtatacatatgtaataaacctgcacgttgtgcacatgtaccctagaacttaaaatataataaataaataaataaataaataaagtagcctgagaagcagcttctgaagtaacctgttttgtgatcgccaacaagaggttctcagaataagagtgagcagagtatgacattctaatagattccaatttctttgacattttaactcaaataaggctcaatattaattttgaattttaatttattcatattttgttattattatattttcatctgcaaaataattgaatttttagactcctccttcccaggaatttgattagaagtcttatattaaaacgtgacaataacctatggatgacattttattattggaataacttaacattgcatttgatgttttgcaaatcctttgattaaatatattggacaatgtggtttgacaaaatttggatgaaagataaaaagagccatagttttgactttggatatataattacattggagaaaattgtgagttaatacgttattctgccctaatttaagagacatttgcactggccataagtagttttcggggaaaatattaaggactagtggaagagattgagagaatccccttgtaaacacatataaaggatgatctaattgattgctattctcctgtgaagaaatcaaccacattgctagctgacaaccaattcccctttgattaaataatcacaaaagttataatataattaatatataatatgtgatatgaagaacatttaggtagtacagtgagaatattcaacaaggagagttaattataagcatatcaaggaacactcccttgaaaaacgggcttggctgaaatctttaaattaagtggaaaataaaaagtgtgtaagtatcttaaaagaatatctggaaacatatgatgagaggagtgaatgtgtcatcctgggaatcttaaggaaagccaatataccttaaatacagagggaaattggaggaatgatgtgtgaaataaggcaggatctagaactacagggcttcacagacaattagaaattttgatcctattttagaaaaaacatgaactgtggcagctttcaataattgcctagtaattatccattctcatcttgtgtcttaatgaaacagattgaagatttcacccaatgttgcttgtaatattaagtgatcatatgactaagtgttggtcaatggaggtaagaaaaagtattggtgcaaaattcagaatatctgtttaaaaggagctgactcagctctgaagagcacactttcttctaccagctgcctagaatatagatgtaattgctaatggtatagcagcggttttgtattattaaatggttttagagaaggcagtcagtactgaagatggtagagtcgaaattaaaacttggtttctcgatgacaccatgaagttatcaaatcaggcctatattcttacctcaaaacttactttatgagaaaaaaactaatattgcatttcattttagacatgacaattcttatttctgtggctatatttggccaaacctaatttttattgctatataaaccaattaaagtaaaatggggaaagtgggagcactgagatgaaaaaaaatgcagtttgcaaatatcactctgatctatagaaaaatactagaatggagtaagaatagatttaggaaaactggttaatagtgctcttacaattggttaggtgagaaattagggttacttaggctatgaagatagaagtggagggagagaaccggatgtattaaagagttgatgagaaatttgacatgaacatccttctgactataagccagttctttatgagctaatttcaacacccaaactcatattaatttccatgaagaagtgaatcattttcagataattcccatgttacaaatcttataaaagttatataatgtgcatttcaatgtcattttatacttggagttgcaaagtatttttatggtcaaatcataaaataagagctagcagcattattctagtggcatatagtgaaataataagtatactttggtatccattagtaaaagatttattcttctcaggatctttgatgggcatatttaaaaagcaaataaagtctcatacattttcaaatatactaaggataaaatttaatagatagaatcaaccaaacagatcacatatttggagaataatatatttcagcttt

SEQ ID NO: 469625 - DNA, 601 bp, Homo sapiens
aagttatagcagtatatgaagactctcttctcagaattgggaaatgtcctgaggataatagttgctgcagaatgtcacgccaaatttcagcacaaatcctgtttccttggaattgtgttctttcatgtcctgattgccttaaaagctctctgttgccttcatgtatattttatttgttgggttggctgtttaatttttacattaactgaatttgctcgctattctcttcgggaaagttgtgcttgtgatatggtacaaaataattcaacttttgaaaaaggagaattaaaatgttctttcaggcatggtccaccagtgcagaggctatggtgtggcccccaggacacccaaggctgcctgaaagcagatgtgtccagggtggggcaccagaagaggcagcagaccaatgagtgctcagatgtataaatttgtcggggccaaattgaaaactttacaatgttaagtgttccaaacaatggacatgatatgttcctccattatttacatgttctaataattattttaataatattttacagattcttatgtaagatcatactcattttcatttatatttatttttagatatttgatatgtctt

SEQ ID NO: 469626 - DNA, 1079 bp, Homo sapiens
gaatatttgcaaaatggaaaagtcggatgaattcacgctataaatcaatagacctttaaagcacaaagagaagtcaaagcagggctggagccacaccctttggtccccaatccagtgcttttcccaacttcgctatgttcccccttagtcaccctgcagccgctcctcacccacaaattcacaagcagccaacccaaactgtacattttcagaagagctcattactcacagctgtacagcacgctgaaggccctctcgtctctgtcctctccgaaggcgggtatgttaaaggaaagtggccccttacctcccccaagcagctgcagtggccgagccctggtttcccaaggctcaggggacggatggccaacaacaccatggagcctgcccgtccccaggccgctcctgcagctgccctcgctggccacccagctggaaccttggacttactgggggctgtgggcatcagggtctctcggcctttgttttcctccagtgccatcagcagttcccagcgtgactgtcccgcagccgcactgggtccaggcggctcctgccgcagtcagtcgctccccctacccagcagcctttttttttcttcttaaagagacaggactgtcatcaaccttaggtgtcaataatgctgcaagtgcagcattgtcgttcattgtgggggtgacaaccaaccacacgtttttgttctcttcacttgcaaaggctaatttttagcagtaggtatggctaacagaagactggctctattaaacaccagttgtgtgaccttagacaagtcactcatgggtctcgagtacctcatgggaaatgaagacctgtgacctggtaatgttgtagctcacaatctgctttttgtatgttatttggagttgtttatgaggttccaatggttaaaaaaaaaagcattcactcaaaatgtgtggtaaactgtgaaatgctatacaattgatcctgttctaagttgaaattgctagtctcaatttaataatacaaaatattgtaactctattttcttgcttcctctgatggggtatgtgaaataccaccagcatttatttcatttc

SEQ ID NO: 469627 - DNA, 518 bp, Homo sapiens
gcacaatgtcatatgtccattccttcatcatcttccctgctgagaagtggcgatgctattcctgcccaaccattagggtctcttgtattcagggtagagctcagtcagaaagcgtcagtatggcgagggccattcaacttttttgagttccaacaaaaagttttatctggaagattaacaagtgttcaatttaagacaacatttaataagcttattctgcattcctacacaaagagtacaacagcaagatatttcacaataataaagcaaaacaagttccaagataacttggggctcctggacctgttagaaagtgacattctttacttaccacagaaacctgcatttaagaacacctgtcaaagccctgtagttgattataaaccaccttctaaaaaggaaaaaaacaagacaacacttgtttgtggatgacaaaatgtcttaggacagccgcggtcaaaaatatgattgacaaagaaatttggttacctctgtggcatacaatgattttatgtaac

SEQ ID NO: 469628 - DNA, 686 bp, Homo sapiens
gttgctgccaccaaccacagcgatgtgagccacagtggcacaggctgcagcatccagcagcaagcctgaggacaaccaattagatcatgaaaataaagtccaatcagagtaggtctagaggtttactctcatccaatccaaatttggagaccaggaaccacattcccataacctcagtatataaggctcttctgtgcctgtgggactacattctctgtgccgggcttagagaacacgaagagggagccatctgccacactctggaggctgaagcctgcaccagtgctgctcgcctcactgtggtaggtggtggtgatggaaactgcagatcggccagagtggtagaaaagttgctgcagggtttttctggctttgcctgcccagctgctccatgcctggctagaggagaaggaggagccacatgtggtacactggaggctggagcctgcagatggcatggctctgcggctcaccttgctgcagttggtggtggtgacagagactgcagcttgactgtagtggtggttaccaggagctctgccactgcatgtccactagtgacgggttcgctccaccaccccagctgggtagccgctgctctcacataaggggtccaattaaaattgccaggaataaattcccccggactttgacttctcaagagctaagaaggtttgctgagtatt

SEQ ID NO: 469629 - DNA, 857 bp, Homo sapiens
gctgaggttcagaaagagtgagctactctctcataagcactcctcttgcaggccgtgagtgacaccagctcttgccacctgacaaagggcacagacaccaaaccctgccccgcccacaggagtccatttcaactctaccccatgggcaggaggacccatctgcttgggtgacagctgcggtcgaagaagacaccagggagagggctgctcatagggaaacgtgggcagtcatcctggcatgaccacaaggacctgaattatgggaaaaatatgaaagaaaggatgaattcaaaagacaagttcgatggctgggtctgtagccttggggactggcgagaaggtggaatagaggaggcagaggcagcaaggatgagttcaagggcaggacccatagctgggaatgccacagaagacacagttcagaggaagagtggctgcacaaggaaagaaggcagactcccgagttctcttgaaaaccttttcatagtagacactgagtgggaagggccagccagcagaagcgggtgcagagcggaattccaggagggagaggggtgggagctgttgacatggccctgggtagtggcagcagctgaagccagcaatgaagcagatgcctccctccagggtcagagtggagcagcgaggtcagaggagcagcccaggagggaaccaggagaaggctgctgcttggcaaacagacccggtctctaatctgggctaagaagtgaatctggtttccctgtggcccaaagtattaggaacgttttctttttttaataaagcagaacagcaattgtggagaaacagtggcagttgctctcatggggtccctcccccagtcacagtgggcttgg

SEQ ID NO: 469630 - DNA, 1481 bp, Homo sapiens
gcccaggctggagtacaaggctagcatgaggtttgtaaagtggaccaatcagcaccctgtaaaatgggccaataagcaccctgtaaaatggaccaaacagcaggacgagggtggggaaaaaaaagggaataaaagctggccaccccagccagcagaggcaacttgctctgctgtaacactcatggtgaaggtccgtggcatcattcttcaagtcagcaagaacacgaacccactgcaaaaactccagacacgtctgaaggaacaaactccggacacaccacctttaagagctgttaacactcaccacgaaggaaatgtacagctagaaatcttaactgttctcaccaagataaatcaatggaattatatattaaaccactccaaaagctgcatattgagagccttgatcagatttagcacggaaaaatgctagttctggttgttacttgctttcattatttatctgcatttctctatacaagtgtctgaattacaaagagcaagtttaaaaagtaatcagcccaacaaaccaacacagactttgcaattcatttggatttgcattcatagttgtaggatcagattttaccaagtgaagcaaactcggccagttaaaaatacattgacattgtattagtaaatatgccttttttagaattccttttgggaaagttagtaattctcctcttttaattctaaaatttgcatataccacaggtgttggtaactgatggcatattcagctcagcagaactagatttacgttgggggtgcatcgtgttccaaacttaggccggtcaaaggataaaagacagcgaaggagtagaaataatagaaaagtttactctgaatggtaatacagattcagtctccagtcgttcttctgtggaggaggtactttcctcttcttttctattcacatctgggtgggcatttgtactcattgcacctctcagacttcagtgctcagaagcacaatagttcattagataggttattatatttggctctgggaaattaggcttgtgaattttgaactactcagtccagtagagtccacacataagtgagtagattttaagtattctaaatgcaaatagataagtatatgaggcaatgattatgttaattagcttgatttagccattccacaatgtatacatgttttaaaacatcataccccataaaatatgcatactctttatttgtcaactaaaaaataagtctgccctcagtcacacattaagatatgacacactcatatcattctaaacatatttcttggtataataaccccacattaaaaagattggccaaaattgtaaagctcttttgaggacttttaataggaggtatggactaaaaataagtaggtaaagcctacaattctgaaagaatgttcagggaacctgagtcttaagtaactttttaaaagaaggttctatggtcaaatgtttagtaaaggttatttatccctatat

SEQ ID NO: 469631 - DNA, 636 bp, Homo sapiens
aaaaccaggtaatatggttgttcatctgatttttggtacttatgaagcctcatttgtggattcttggccgtcttctgcaggtttcttagatcccagtgttgctgaaggagaggtttggggaactgataaaagaaaagatatgccaagaagcaatagcacacacaagctttactgggtgatggctggatgggtgtgcatgtgggtgaagtccctaacagtagcagtctgtcccaatgaatggcacagatgtcccaacacggaggcggtagagggcaaagaagcctctgggggcgaggcagtctggaccaggggcttaggtgacaataatgcaggaacaaggagaaatgctaaggaactaaagagatgcccagggtccattcctggaactctgaattctagatccgggctccattacaaggttggactgatttggaaattcagctaaagctgagtttgaaggtggagagcattggtgactgtatttggggtcactgagaagacgaaggcaacagagttgccaatgagttgtaaatttggtctctttacacaaacccatatttctcagaggtattgttcattcttttctaattcttttttctttatttttgtctaagttcagagaactagtctttgagc

SEQ ID NO: 469632 - DNA, 912 bp, Homo sapiens
ttttttcatgtacttgttggtcattcgaggaaggggtacaccatgccacacctggccaccctggggaagcgctggcatcaggaggcagagggagtgaggggaaaatgtggacaaaagtctttattatggtttccacaggaagtgactggcaaggaagggcaaacaggtttggtattgatgagttcgagtaatttcagcacgctatgggatctaggggctgtccctagttgtctggtatctgggtctggggatgcatgggaggctgcaagaaatccagaaaacttgaccctcaagtactggggtccctatgtgtccggaattggttccttccggtgggttcttggtctcactgacttcaagaatgaagccacagacactcgtggagtgaagctgcagaccttcgcggtgagtgttatagctcataaaggtggcgcgtctggagttgttcgttcctctgatgggttcatggtcttgctgacttcaggagtgaagccacagacctttgcagtgagtgttacagctcttaaaggtggtgcatccagagttatttgttcctcccagtgggttggtggtctcgctgacttcaggagtgaagctgcagaccctgcggtgttacagctcataaagcagtgttgcttccagttcctgctatctccagaacccaaagatgattccaataaagaaggggactcttttggaaacaaacgcagcagttacgctgtacttaaacctacccctgctccctctggttccttcttaccttggagtgaattatttcaagaggcttctcaactatcatgcaatgggacttatctgcctagcacggggtttctgagccttagcaccattgatgttttggaccagataattctttgctgaggggtatgtcctgaatattatgggatatttagc

SEQ ID NO: 469633 - DNA, 2363 bp, Homo sapiens
gcgtttcagccacaatgcctgctctctcctctgaaacactaaatagctgctttggttggtaccactcttttcagtgtgacctcccctacctgctcagacaccagctggcccgcagcaacacagacctgcaggggagcccctgtggatgtgaatttccagaaggagctgggaagcagacttccctggctggttctaatggaaaagctgaaggcacaagaacctatgccatttttacagcagatagccacagtcccctgaccgatgacagctatcctgtgatcacagttgcccacaagtgccctgctggggatgaacggaggaaagtccagtgcagcaaggctcctttgccacacagtccaaagtacattggtctccttgcctcctctgttccttgcagaacatttgactcacttgccctttcatctgaccaatctgctcccatacccaagctttggcttcagcctgatccaaacctccaagtaccacccgcttccctgacagtgttccctcctcacattgacaggactcctctgaagcccgttcctcccaggaaacccacctgggtggagaactcagatggttccccctggaaaacagatatatcagggttctctctagtactgagcatcgtttctcggctgcagcacaggagtcttaggggctcccgcaccacaccctccctcccgcaaagcaatggtcctggggtcccagagcctgtctacccacattcctcccaaacgttcaaaatgagaactaattaacatggaagaaaaactcatcattctctaactttagttatgtgctttctctatgttcagaggagtaatatttttcttcctctggaaaccaagtgaagaagtatatattacataatattatgtatattatattatataatatgtaaatataatataatataatatattacatcattatatattatatataataatataatgtataatatataatgtaatataatataatattatatattatatataatataatataatatattataatataatatatgtatatataatatataatatatgatataaatatatataaatattatatttgtagtatatattatatataatataaaatatatattgcatatataatatattatatgttatatattatatatgtaatatatgttttatattatatataatatagtatgttatattaatatatatactatattatatgtaatatattttatattaatagataatatattatatataatatatgttatattaaatataatatattagatataaatattatgtttatatatttatactatacattatatattatgtatgatatttatattatatattatatattacatttatattatatattatatttatatttatatattatatgttatgtttacattatatgttatatttacattatatattatatttataattatatatttataattagatataatatatatattatataattatacataatatatattatatataattatataatttttatatataaattatatagataattaattacattcattacatatattatatataatatattatatatataattatatattatatattacatataatatataattatatatataatatataatatatttataattatatataatatataatatatttataattatatataatatataatatatttataattatatatataatatattatgtttataattatatataatatataatatataatatatataattataaatacgtataattataactataaatatttatagttataattatatataattataattacatatttatataattataattatatataattataattacttatttatatgtaattataattatatatataattataattacatatttatataattataagtatatataattataattatatataattataattacatatttatataattataattatatatagaattataattacatatttatataattataattatatatataattataattacatatttatataattataattatatataattataaatatatataattatatatatacttataaaaatacatttataattataattataattagtatcagtaagtattacatataatatataattatttttatttttataatattaataataatttttataatatatatatataaatacctttggcatgggaccggaatctaaacacaaaatttatttatgtatatacacctattacacatagcctgaaaataatttcatatgatatttttaataatattatgcatgaaacaaaggttgtgcacat

SEQ ID NO: 469634 - DNA, 673 bp, Homo sapiens
aagttcctaaggccaaatttttgttttgttttgcttcgccaaaatgatggttttatcgaatccccgggatgacagcctacacctgatagatatcatgatgcagtcacggtacactggaccagggaacactgggacggaagaagtgaactttgcggtcccccattctctgccggactctggtccagaagtgcacagcatttgcagccacagccactgccagagccagactgtcagagccatgggagagacagtaagtgttcttcgaatggatgcattggaattcaatgggtcttcttgttcaaatcattttctgctacacaggaaaagtcctctaagggtcaaaaggatgctcaagtatagtcacccagtgtcatttccccttgcaaacccatttctcctgtggggcttcccagggcagtttctctcacctgtgatgcttgttatactgaggatgatggagaaagggctcctggaaccacccatcaaatatgtctcctttcgcatttggactttctgtctttaaatctgtgttgcctttacaactgcgaggttgcggtaactctggttttcctgaatcagacaaataatttcaaagacattatttgcatttactaactaattttctcctgagaccaattgcacataatacagtgcattgcccatctctgtaaac

SEQ ID NO: 469635 - DNA, 2047 bp, Homo sapiens
ggaaatgatgttttcttgctgcctctcatggtgaccctgacatgccaatcttcacataacccaacccacacggtgaccaataaaataagaaaatgccggtcatctgatgtcaacagtaaggaattcccagagcactgcagccgggaaccgtggagacgatgtcatctcaatctacgccattcccagcaaaagggaaatttcatcacctcagagaaaaaggcactggtacagcaagatgtcacaatatctgaactgcagatgtgcacatctaatggaaaaacacagctgaaacagataatcatggacaaagtgatccagagtgaaatttatgctgaagtctgcttcctgccaaaatactcaccactgttcaccatgtggtactatggagaacaaaccagcagtactcaaacatctctcaaaatacactgggtggcatttattcctttttttttttaatcagaactggtttacataatacaacatatagatgaatgggttacataatgatagatggaaaaagagatatttatcatgtgcacaaagtatatattacataatattatgtatattatattatataatatgtaaatataatataatataatatattacatcattatatattatatataataatataatgtataatatataatgtaatataatataatattatatattatatataatataatataatatattataatataatatatgtatatataatatataatatatgatataaatatatataaatattatatttgtagtatatattatatataatataaaatatatattgcatatataatatattatatgttatatattatatatgtaatatatgttttatattatatataatatagtatgttatattaatatatatactatattatatgtaatatattttatattaatagataatatattatatataatatatgttatattaaatataatatattagatataaatattatgtttatatatttatactatacattatatattatgtatgatatttatattatatattatatattacatttatattatatattatatttatatttatatattatatgttatgtttacattatatgttatatttacattatatattatatttataattatatatttataattagatataatatatatattatataattatacataatatatattatatataattatataatttttatatataaattatatagataattaattacattcattacatatattatatataatatattatatatataattatatattatatattacatataatatataattatatatataatatataatatatttataattatatataatatataatatatttataattatatataatatataatatatttataattatatatataatatattatgtttataattatatataatatataatatataatatatataattataaatacgtataattataactataaatatttatagttataattatatataattataattacatatttatataattataattatatataattataattacttatttatatgtaattataattatatatataattataattacatatttatataattataagtatatataattataattatatataattataattacatatttatataattataattatatatagaattataattacatatttatataattataattatatatataattataattacatatttatataattataattatatataattataaatatatataattatatatatacttataaaaatacatttataattataattataattagtatcagtaagtattacatataatatataattatttttatttttataatattaataataatttttataatatatatatataaatacctttggcatgggaccggaatctaaacacaaaatttatttatgtatatacacctattacacatagcctgaaaataatttcatatgatatttttaataatattatgcatgaaacaaaggttgtgcacat

SEQ ID NO: 469636 - DNA, 783 bp, Homo sapiens
gtctttacatttgtttacatttctcttgactgccaatgacaccatgtacatccggtctgtgtgtagaaaggaaggctttgcttgggcctgctgtggtgaggccctatgtgaacagggtcccctggaggatgatcggtggccagctgccatcggggctggagccgaccctgggccagtaaggggcgacttggggcatactctccgtactgggcatttctctcaagttaaaaagatctgcatttcttgtccaggacacaatgccctagaacttgtgtatactggatggaacaaagcgtgtacagcacatctccggatgtgttgcaaaggctgccaaccctgctgggagatagcggccagcctctctttcctatcgtggttgtggctgtggcttcccacactggccatcctgccccagcacgtcgcactccagactgtctggcacatgaactgtgatgatgtttttccttcctggatatcagcagaatcccgcctttctatactgagcctggggagcagggagggaggagtctgcattccagattttctggaagaaatggctgttgttgatgttgtttttagcagctcttttgactcgaccatcctcacaccagcgttagctgaagtcaaagtggcaagtgttccctggctggtggaccagagagctccatgggacccaaaagagggagggtgcaggcctgactgggaggaaatctggtagcaacgggtttccgtttctccttggataaatcaagaagacttttccttcaaggacatacctgaata

SEQ ID NO: 469637 - DNA, 615 bp, Homo sapiens
ttccaacaaatagtataattatatgaggtggaggtaattggatcatgggggtggtttccccatgctgttctcatgatactgaaagtgggaacattttggagggctcaaaagaaaataggaaaatgtgggaaagtttggaacttcctagagacttgaatagctttgatagtgatccagaaaatgaagatcaggctgaggtcatctcagatgaagatgaggaacttgttggtaactggagtaaaggtcactcttgctatgttttagcaaagagactggtgacattttgcccctgccttagagatctgtggaactttgaacttgacagagatgatttagggtatccggcagaagaaatttctaagtggcaaagagttcaacaggaagcagagcttcaaagtttggaaaatttgcagcttgacaatgcactgaaaaagaaaaacccattttctagggaaaaattcaagcctgctacagaagtttgtataagtaatgaggagctgaatgttaatcaccaatacaatgaggaaaatgtctccagagtatgtcagacacttccaaggcagcccctaccatcacaggcctggaggcctaggaggaaaaaatggttttgagggg

SEQ ID NO: 469638 - DNA, 526 bp, Homo sapiens
ggtagcagggccggtgaggatgccgctggagcaagccaaggatggagattgtgctggatccaccttggaactgctcttggggactctcacaggcgccctgcactgcccctgctgtgcgtgtctcctgttgcctgggaagctaaagggactgtggtccaggcctgccattggctcccaagaaccccgcctcctggtgacaccccctcctcttgagtgtgggctccccccccgtgagctgccccgtggagaagcccatgaggcatggaacccagaacctaagacctgccagcgccccctgtgtaagcctggacgccatcctcccgagtcgggcctggagagggccccagccccagccccagacccagccgacgctctgaatgacaccccacgaaaggccttgagtgagagaacgcaggaatccagccagggactgggggctggatctgtgaatggagctgtctcagggtaacggtgtgggttggcattgggggtcagctgagccgcgtttcctgttggtggttccagc

SEQ ID NO: 469639 - DNA, 2246 bp, Homo sapiens
tgttctgatttggtggaatatgtcgggccacagtgaccctggagggtttgatgattacaaagaaaaaataaaatttagaaaaaaagaagagaaaggaaaaagagtgctctgggggtatgagaagagcagaggacgagagcagaaacagttttgtaatgaggaagtcacatggccaatggctgtcgaagaagagaggacactcagcaccagggagcctgatgaggaaggagtgagggggagcagggcacctctggctctagcccagccacaccggagcccagctgcttccagaagcctgaaggtggctgcttctgctgatttcctgattctcctgtttttagatggtcctggacctaaagcccgaggagctccctcttcccttcaggcctatgcaagagcagttgccctgtggttcctgatctcctctggatctcctctggagccagtcgcctgtagaggatctggactccccggctcccggagcctgcggcaagaggcaggtcaagtcagcgcctgctcctcatcctactggcaggccccgaggatggaagggtgatggaggggcccactgtgagactagggggagacagaaaagtcaggaaaaggtttccatgacaagccgttttctaggaactcttaacaatggggaaataatatcatccaaacctagaaaagagaagacaggacttcaagaagaaagaaacaatgataaacgatactagctagagctagtatcatgccgggcttaaaaagcaaatgaaacagaaaaggggagagggcagcagctgctagccgaggacgcggcctgattctaggaggtcatgcctttaattggacacaggagtgtgtacaggggttgccccccttcctgcaccttccatgatggcaaacatttgggttttaccaccaccagaagtttctctatcaaaaatcacaagacagtccatagcaccctacaggctccccaccctgccctgggccaggataggcctgaagttgttatcatgaacaggaaccagaatgttccacgacattttgcaaacaatatcgctaaaaaagaggctagtgctacagacagtaggttatatgacaataaggcaagggcgtgggcatgtgtatctgtatgtgtgtgtctatgtgtatgtgcctgtggttatatctgtgtattgtgaatgtgtgttatgtgtatatgtgtgcatacatgtgcatgtgttgatgtgagtgtatgtatatgcatgtgtgtgtgggcgtccatatgtatgcatatgtgtactgtttgcacttgtgtatgtgtgtgcagctgtgtgcacgtgagttttgtacatatgtgtgcatgtgtgtgtgcatgtagggggttgtgcatgtgtgtatgtgtatgggggtgtgggtatatgtatacgtgtgtgctctgtatgtgcagctgtgtgtgtatgtgtttatgtgtgcatctgttgacgtgtctatatgtgtagatgtgcaagtgtgtatgtgtggggggttgtgtatatgtgcatgtgtaatgcatgcatttatgttctgtatgcatgtgtgtatctgtgtgtgcatgtgtgtatgtgggtgggtgtgtgcatatgtgtatgtgtacgtatgcatgtgtgttctgtatgcctgtgtgttctgtgtgcatgtgtgtatgtatgcatgtattctgtatgcatatctgtgtgtgttctgtgtgcatgtatgtgtatgtatgcatgtgtgttctgtatgcatttgtgttctgtatgcctgtgttctgtgtacatgtgtgtatgtatgcatgtgtgttctgtatgcatgtgtgttctgtatgcctgtgttctgtgtacatgtgtgtatgtatgcatgtgtgttctgtatgcctgtgttctgtgtacatgtgtgtatgtatgcatgtgtgttctgtatgcatgtgtgttctgtatgcatgtgtatgcatgtgtgtatgtatgcatgtgtgttctgtgttcagtgtatatgtggatgtgcatggatgtgtcttctgtatgcatgtgtatatgtgaatgtgtgcatgtttgccacgtatgcatatgtgtatatgtgtgggtgcaaatgtgtgtatgtatgagtggaaggattgtgtttaagtgtgtgtagctgtgtaggtatgtattatgcatgtgtgttctgtatgcagtgtgtatgtgtatgttggtgtgtgcatgtgtagatgtgggtgtgtatgtgtgccttctgtatacatagagtaaatgttccttcct

SEQ ID NO: 469640 - DNA, 633 bp, Homo sapiens
aaggacacttgcaagtgtgtcattctaaagtagttgggggaaagtatctctccctcccctctggggaaacatgagttctcccacacagcagcggagaagtccatctagagctgaccctctaacaggagagagaaccaatgagcgaacaggcccaggtcaagccccgtgccccagcttgtatgccccgttctgggctctctcccttgtcctctctctgccccagaagtctgacctctctcacttagacagccacattcggctctctccagccccagagtgcccaaaccgccactgctctctggcctgctctcacctgaaggctgctttggtcacagacaatcaaccatctcaccttcagaaagctggccctggatcccccgtgaccgtctctttccataccctgcctctgtccccatattcctgcattcagcgtccacctttcctaacagtcatgcctctgttttgctcagctctccaaccccagggcccaacctgccaagtcctgtgcccagcacacggcaaatgttccattcacatctcctgaatgaagtctcttacactatctcaaggcaggctgtcccaactgcaaacaagttgtccaaatcagcaaaggagatggaaaggcaagatgag

SEQ ID NO: 469641 - DNA, 711 bp, Homo sapiens
ctttcaactctctacatagcattcaatatgttatttattaacctacatatcaccacagttcttcaaggcaagcatggttatctccagtttgtaaataaaaaagggcttcagagaggctcagtaacttgcccggcatcacacagccagagcgtcaaatcttgcctgcagaggtttcttggggccaggagagtgtgttttagtgccttgggccaggctccccaacttctccacaactgcccctgtctctcctctcccttatcctgctcagcttcacacagttacttacttttctggtccccaaaggcctttgagcaggtgataccaattccaaatccttctgcaagagccactgcagatttgtccgatgttgactcctctgtgtcactggtgctagcttcccagcctgttcattttattccactgccaatgtagcccaaagcaaatgcacacgatttcctatttttctgttatttttcatggtctatcaaaaaatatatgctcccactttccaaaatcagaacatccactagtgtctgcatgaagtaagtcatgagaaagaacactcatggagttcagcttacagtaaacatgtatttgatttccagctctttgcaaaatgcaaacaaactttgtacttgtttgtcttagtcttatgtcttggcatactttcccagatggctaaatgagaacgtagaagttgcagaaataatc

SEQ ID NO: 469642 - DNA, 1087 bp, Homo sapiens
gcttcttgacacctcactgtcgtgtttcctcttctttttacatcaaagttgaaattgagtattcaattttattaccgctaacacttaaaccctgatcaaagtatatgatgcatatactaacaacatcaccaccacaaccactaccaccaccaccaccaccaccaccatcaccaccaccaccaccaccaaccatcaccatcaccatcaccaccatcaccatcaccaccatcagcaccatcagcaccatcaccatcaccaccatcaccaccaccaccaccaccatcaccaccaccaccaccaccatcaccaccatcaccactaccatcaccatcaccatcaccatcaccaccaccatcaccaccaccatcactagcaccatcactaccaccgccaccatcatcacaaccactaccactaccaatactaccactaccatcactatcaccagcagcacttattgagcacctattgtatggcatgcaaagatgttacaaacaagtgccagattgcgtgggctcaggctggaaatgctgtagacattcagagaacagggaccagtgaaggaacctcagtcatcaggcttcacaagatcccagaaaaggtccttcagacagggttcttagggaaaatgaaaacagtgttatacctggccccatggaaactggacttggggggctgtaccagatgcaaaagcattctagtaacaaggcagtcttgtggcctggcgcagcaggtcccgactcacctctcaggctctactgtgagtgttgactgctcgctggtgtttccactcctgctcctggaaggactcctgctctctgtgtcttctgcagaggtttccaagagaggggatcccatcgaatccacgtcagtttttattgtttaatttttatgtgttcttacatgtcgttgactgaacaccaccaaggtaactacctgaccctctgtagtctctcctgaacccataagtgagtttgattagcttttcttcagggaagcacttcatagtctctgcaagctttaaaatacaagatttaaaatatctgctgtttaaaacacaagatttaaaatatgattagcaaacaat

SEQ ID NO: 469643 - DNA, 539 bp, Homo sapiens
gcatacaaagctgctgactcccgtcagcccaggccccggtgagtgatgttcctcaccctgtgtccaagtgttctcattgttcaattcccacctatgagtgagaatatgtggtgtttggttttctgtccttgtgatagtttgatcagaatgatggtttccagcttcatccatatccctacaaaggacatgaactcatccattcaggacataggcatgggcaaggacttcatgactaaaacaccaaaagcagtggcaacaaaagccaaaattgacaaatgggatctaattaaactaaagagcttctgcacagcaaaagaaactaccatcagagtgaatggcagcatcgtggaaatgtttaggctttactcaaccagtgtcagtcatgaagtatctcctgaagaatggagagtttctttgtttgccaagatgccctgctttgaatactgctctgattcaattcactcttatttcctaagccaaatttaagatcataagactcttctgagaaaattctaaagaccatccatcacactctgtcc

SEQ ID NO: 469644 - DNA, 487 bp, Homo sapiens
cgtcgggccgagtgcgctgcagtcagaagaggagctgtgtcccgcatacggtgattgtaagccaggtccatgccaccaagagctggagctgtggaatgtggagaggttgtcaacgatgctaaaagtaaaatgagaaaaacttgttttccaacccttttgttaagattcactggaaaggaacattgccttctggaaatcacttacgggaatgcaatttttacagcatttcttggactcatgccctcgttcgtttcatgggttgaaggaagggcaaaaggcagtgaaggaggggaaagagaagactacgtggaaaatgggaatttttatcaccatccagcgataatgaggcctcacacctcccatggtgacattagagaccacatggggagcagtaatgaggcacccctcccccgcccagcagaagtgttgtcagtggaagccaactggggggtcccaaaataccactgctaccaacagtaatgagata

SEQ ID NO: 469645 - DNA, 778 bp, Homo sapiens
gacgtgacctccacccctagtgcctgcgatctgactgcccgacatgacctccacccctagtgcctgcgatctgactctgcccgacgtgacctccacccctagtgcctgcgatctgactctgcccgacgtgacctccacccctagtgcctgcgatctgactctgcccgacgtgacctccacccctagtgcctgtgatctgactctgcccgacgtgacctccacccctagtgcctgtgatctgactctgcccgacgtgacctccacccctagtgcctgcgatctgactctgcccgacgtgacctccacccctagtgcctgcgatctgactctgcccgacatgacctccacccctagtgcctgcgatctgactgcccgacgtgacctccacccctatgcctgtgatctgactctgcccgacgtgacctccacccctagtgcctgtgatctgactccgtcctgggtcttaggctctggctgcagccctgcccgcaggctccaggtcctctgcaaggacctaactgctgaggacaagcccacaagtgaggaaacagatgctcctctagctgacactaaagataagatgcctctagaaaaacaaactcctgttatacaggaacaggatgataaatgcgataagctccatgtttgtgacaaagcagtgtttcaaatgagaactattacctgatttgacgatgccttcttcagctccattctccagccactgagattcactgtccaacaagcggttttttgattcactaagtggtttgataggaaa

SEQ ID NO: 469646 - DNA, 534 bp, Homo sapiens
ttgaaaacaatgaattgggccagtgtggtcactcatgcctgccagctggctggtgatgggcttttgaagactctgctctctctcctgctggaagagctccccaggggccaccaggagccaggtgaccgctctcagcctcttcctccaaactcttccaacctctgcacattacccagttccaaagctacttccacatcatcaggctctgcagcgatgactgggctggggaagcaaatgcttgctggccacagagcctcattgcaagttgttcttgaacacctgaacccttcctggtgcccaccaggcactatgacttcctcaccagaatgtggctttgcctgggtgcagacagaacctgcttgggatgctcttggccaaggaagactcttctgtgtgcaggctgtcctcacaccctgtcctcacaggaaaaggcagattgaggctgctgagtcagcctagttctactgtttacgcttctaaaataaacaggacttgatcacacaaaaaaaaaaaaaagagagagagagagctcaa

SEQ ID NO: 469647 - DNA, 1545 bp, Homo sapiens
ctgttttgggttggtttggttgttggtttgagacagtctcactctgtcgcccaggctggagtgcagtggcgctctcatggcagcatctccagggcttaagtgaccctcccacctcagcttcctgagtagctggaaatacaggcactatgacttcctcaccagaatgtggctttgcctgggtgcagacagaacctgcttgggatgctcttggccaagggtattgggggctctctggccttttgcaactgatccaaagacacccagagccaacttacctcaacctcacccttatagaagactcttctgtgtgcaggctgtcctcacaccctgtcctcacaggaaaaggcagattgaggctgctgagtcagcctagttctactcccgaagctaaagaatgctgttattgcaaactacagacaacccacttggtagaaggcagcaacatcctgaatcctggtcttgcaaagacatacccaagcaacagcagcgatccacccacctcaggacccagttctcagcctctgtgtggctggcttttaaagctaagaaaagccagtaggaatgtagaaatccagtgagaagaaagccatggaggcttctgagcactctaaattcccacctgggaatctggcccaaacaaattaattcacaagataataaaagctgtatgcatgaagatgttcattgcagaattttttatacctgtgacagagacaggttaaatgacaggaagatgattatgtgaattgtgccgggccaacaaagagcaaaacttcatctcaattaaaaaaaaagaaatatatatatgtgtgtatctgtatacatatatatgtatctatatgtgtatacatatagatacatatatgtacatgtgtatacgtaaatatgtgtaaatgtacatacatgtatacgcacacatatgtatatgtgcgtatacatacgtgtatacgcacacatatgtatatgtgcgtatacatacgtgtatacgcacacatatgtatatgtgcgtatacatacgtgtatacgcacacatatgtatatgtgcatacatacgtgtatacgcacacatatgtatatgtgcatacatacgtgtatacgcacacatatgtatatgtgcatacatacgtgtatacgcacacatgtatatgtgcatacatacgtgtatacgcacacatgtatatgtgcatacatacgtgtatacgcacatatatgtatatgtgcatacatacgtgtatacgcacatatatgtatatgtgcatacatacgtgtatacgcacatatatgtatatgtgtatacgtatatgtatatgtatatgtgtatacgtatatgtgtatatgtatatgtgtatacgtatacgtatatgtatatgtgtatacgtatacgtatatgtatatgtatatgtgtatatgtgtatatgtatatgtgtatgtgtatatgtgtatacatatatgtatatgtgtatgtgtatatgtgtatacatatatgtatatgtgtgtgtatatgtgtatacatatatgtatatgtgtatgtgtatatgtgtatac

SEQ ID NO: 469648 - DNA, 989 bp, Homo sapiens
aggtcatgagggtggagcctccatgaataggatttgtgcccttataaaagaagccccaaagggccacagcttgcgagtcgcggcggcagggtcgagtgggtggcggcagctgacaggcactcctctcccgatggcagtggctggtgcccagcgaggcgggcagccaccagctcgcgttcccgcgccccagctcgcgctcccgcgtcccagcccgcgaggcgccagggctgcgccagggcatggaagaggggctaatggacgcgaattaatgagggtacctaccacacgtgcagcgctgtgtctcgctgagttttctgaagatgccagatctgatcaaaggcctgtcatcccttcatcaaggcccagggttgctttctccatgtctgtggtggaccttgacctcaagccctacgagagcattccctatcagtataaactggatggcaagatcatcaactactattcaaagactgtacgtgccaaagacaataccatgatgtcgactcggttcaaggaaagcattgctgctggaggtgtaatggacattaatactgctttacaagaggtgctgaagaccaccctcatccacgatggcctagcacgtggaattcacgaagctgccaaacccttagacaagggccaagcccatctttatgtgcttgcatccaactgtgatgagactgtgtatgtcaagttggtggaagccatttgtgctaaacaccaaatcaacttcattaaggttgatgacaacaagaaagtaggggaatggacaataccgtttgaagattccagccccagtctgtgaattacaaatgaacagagtttctcttatcccagtctaggatacaatcaaggttttcaccaccctggtgaaaggtgcctttgctgtctcatttgtcagctccctttgggtgaacccagacctgtgttcaggaagtgatgatgaagcctttcccttcaccttcacaaaaaactgtgatttggcacag

SEQ ID NO: 469649 - DNA, 595 bp, Homo sapiens
cgcgggaggcgtgaccgggcgtttacacgcagcctgtgagccagcgcctggaaattcctttcagggactgcttttgcatctagaaaccagaaatctcatgaggcttattcactgtcatgagaatagcacgggaaagaccgcctccatgattcgattatctcccactggatacctctcacaacacatgggaattatgggagctacaattcaagatgagatttgggtggggacacagccagaccatatcatcagggttgttcaggagactccttggggagttgacaagtccacattccttaataaggccctcaggatgtggggtgctgtcccctgcccactcttgcagctgcctctctccactctgtctgcctgtgccccagccactctgcccacctcttcttccttgaacaagctgcttcccactcaaagtcttcactcagctatttcttctccttggaataatgcccttcccccttgttgcctggcaaatttcaggtctctgcttaaatgttacttcctcggggaagaaacactctccttgaagttatttgtgttcttttccttcacggtacttaaataattgtttgtgtaagta

SEQ ID NO: 469650 - DNA, 674 bp, Homo sapiens
tttcaattaaagtgttgagggaagatggccatgaccaacaccaactcaaagctgtccatcaatacagtgaagaaaacagcctctcaagtcagctttcagtgtgtgaaagggccaccatttcctcccttgcaaaccgtcatgctagtcagccccggcgtccaggaccgactcacaaggccacgtcttgacctgcgaccctgtccagacccacgaccctgtccagaccttcgcgaccccgtccagacctgtgcgaccccatccagacctgtgcaaccccgtccagacccgcgaccccgtccagacccgcgacccggtccaaagctgtgcgaccccatccagacctgcgaccccgtccagacctgcgaccccgtccagacccgtgaccccatccagaccctcgacccggtccaaagctacccgcgaccccgtccagaccctcgacccggtccaaagctgtgcgaccccgtccagacctgcgaccccgtccagacctgcgaccccgtccagacccgtgaccccatccagacctgcgaccccatccagacccacgaccctgtccagacccgcgaccccgtccagacctgcgtgtgctcagggggcgcaagccaacactgacacctgaagcgagcatgggcttagagagaaagccccccagaaatgtgctcttttcccac

SEQ ID NO: 469651 - DNA, 580 bp, Homo sapiens
agtgggtgttcagtacccatatgttagatgagtaaatgaatagcacactggatgccctcgcagactcatctctggatgtctctgtggtgctgcctgcaaatgcagccataatcttacgcccagtccttgaggagtggcccacgggcaacaaggcctcagtggaacatgttggtggatttcagggcacggcagctgggtccctggggagccgcagcctccaggggctgctcctggtgctgtcagcgttcaaagcagtcgcttcacttctgccgcaattatcagccgattatctccccaatgcccgcgctcagcgcttccctgcaacggctgtgcgttattctctctgccgacagtggggactccctgctaatcaggcaggagccggcaaagcggtgaggtggctgcagctggagggcaagctgctgtgttcagctgctcagatgcaggtgagggatcggtgagtggttggattcacagagtggtgagaaaattgaggctatatgtaaaggagtaagggtaatgattgattacagaatctaagtgggctaagtagaaaagttgtagtggtttaaaaaaatgt

SEQ ID NO: 469652 - DNA, 1169 bp, Homo sapiens
tccagttttgaagcagaggtcagctgggcggtgtaggacactgctcccgggttgaccaatgggccacatcaatgggtctgctgtttggggtcaagatcccaagaccccaggggaagtcaacatccatctgaggctctctcaggtcgtgcaagccatctctggcctcactgccctcccctttagaaatgcactactgagcgcgctcgcggtcgccaggagcggattgggcccccgccgcgcgcaagccttggtgacaggggatggcgcggagctgcctctccgggaaagttggatctgtgcgcccagacatggaaaagggattaggacaccggcagatcttgccctcacagagcggaggtgggggccttggaagggcacaccgcccgtaggcgcgaaatccaagaagaaaatgacactcatcagccagcctcgcgcggggagaaagggcggggtgggggtagtggcaccctgcccgtcctctcccacccccacagtccgggcccacagtccaggagtcacaagggatgtgaatccccaggcataatgtgaacccccaacaaacccaaggcctcagaatgcgcctcacctctccctccccaccagcagaaacatcctcccactctcccaacccctgctccagccacgccaaccctttaaccttgtcccagaatgtctaaactgtatctgcctctgtgcctgtgcacatgaagttgccttggcccggcgtttgctccacagccttctgccaaactcctactgcttgatggctggaagccttcgcaccctggcgctctcctcccaggtcagcagtctctggccttcctgtgcatccagcccagctttgaacagtcctgggccccaacccttatctttttccgagtaattacatagttgcatgattggcttcaccgcctctggatcagatgagcgctactaatgaaggatacaagttgtaaaactaggttttatgtgaactccagtcatcacagtttaggtgcggctagcgattttacagatgcggggttagtaactggcccaaatccagggcttccgggatgctgttttccttttttgtttcttagcagggatggcagatgtttgtagaacagatccgtgtaaaagtcagtatcctaagagattaaattgtaaagcaggacaagatagttaac

SEQ ID NO: 469653 - DNA, 1267 bp, Homo sapiens
ttaaagccggcctagggaggtgatggtgacagttctgagcagggtgcacagaacacagatttgaggcctccttgccagaacacagataggatgcccagaggatggatggatggatgaatagatggttgaatatatggatggatgatggatgaatggatggaaagatggatggatggttggatagatggatgggtgaatggatggctggcttgatgtatggatatatgtaaggatggatggatggatggatggatggatggatggatggatggatagatggataattggatggatggatggatggatggatggatggatggatggatggatgaatgaatgaatagacactcagaaagtctttagtctcctctagatttcatctctgtggctgagacaatggcaaagcatttctcttttccatccccatccctggagctgtcgtttttcacatccatcagcatcaagatacttcccactaaacttcgtggctacgtaagtcgtgcctgcttcttcctcaccttctgccatgattataatgaaactgaggccaaagtgaagatgacaataagcccctccctacgacggtcatgggagatatcaccaagagatcatgcagttctttccttgatcacagcctcagaatccctcttaacacagtgctctgtgttggcagccattcagataaccaatcaggatgaagaattgatcgtgggctcgatcctggggtccctgggacagtcccatgccttgttctctcccatgttcctcatggttatggagaacaatggtttggcgaggactggcagtgctgtgagagatttccaaggtgattcacatcgaaactccccgtttgacagagagggatctgagtgcaacggaggcgaggcctttagtccgcagctgcagtattctcccggtctggcagcctcctgcggggcagcagcagcaactttctccaccatgaaagaggcagcatggtcctgaggctgagctcctcctgaaatctcagattagagtctgttcttcaacaattttgtgagccattttataccccatcataaatccctttctccttaagctagttagagtggattctgttttttgcaactgactgctgactgattctagactctccccttaacaagcatcttcaggacacttgtaagcccataagggagatcccggactcctggcagtagttgcagggcagtactttggggtcagagtatgcatcctagagaatgtaaaagaagatacttcttcagaa

SEQ ID NO: 469654 - DNA, 1387 bp, Homo sapiens
cactgagctgagggtccctggtgcaccgagctcctgaggcccacccaccacaactgtctcatgaccctccctggttttggctttcctcccatccctgttccctcatctatttcctggaacaacttcccagataaactactgacacctaagtctcaggacctgcttcatgggcacctcaaactgagaggcctgagctccttcccttccacctgcgtctgccccatacaaagctccgtttgtgtccctgcggctgaggagaaacggctactccgcgccacctcatccaccgacaggccacaaaagcccaagcacgaggtgaggctcaaaacaggccaggcccaggcgctgccaagccaaacacagaggaaacgggtgcgagcccagcagagaaaccagattcccctggaaatcgctgctccccgccgtgtctggaaggccagccccaataaagcggctccggaagacctgaaggacccccatggccctcatcttgatggagatgccaataaaaatctcagaacatccagcctgcaggccctgtaggcactgccccggggctgtaaacccggatacgagcagctggggagccggagggaagaggcctgctcccaagaaagcccaccagccagcccggccaggcccgcaagtgattagtcattctttgtaagaagaaaattaggtgccttgtatggtatggttgtaacctaaatgcatttaacttgcaaattcatctacaggagcttgcacagacagaggcataacacatgtaaatggtgtggtaatagctcctgctgttccactcagagttgaggttgggagacttgcctctgcgctccctccaccatctcagccccagacaccgccccaaggggagcactggctatccaggcttctctagggcttaaagtcatacatatttttctaccctgtgactctgaaaggtaagccagttccttcatttggggcatcccacagagacagaaatctgtttgaaggggatggaaagaactggtttgaaccttccggatgccagaggaactgaacattcaacacaaagactttttttttccccttcaaaaatggtctgagcttgcaaactcccaaacactaaacatctttcaaggataacttattcaatggtatcactacatgccccacttgatgtaataaacatttcccaggccattccttagccttttcctgggctcagtcaatcctcccacctcagcatccggaatagctgggactacagttgcgtgccaccacatctggctaatttttgtgtatatatatatacatatatatatatgtatatacatatatatatatatgtatatatatatatatatatatatatatatatatgtatatatatatatatattttt

SEQ ID NO: 469655 - DNA, 532 bp, Homo sapiens
gggtcacagacagaggtgctaaatcgatgcaggacgtccgccccaaagacacgcttgtgctccctttggagagtcctgcatccttcgccctctgttcatctgtctgtttgggtcctggggatgagtctaggtggcggccatctccggatgtccccaggttgctctgtgtggggaagggtggggaggctgctgggaactggactctcctggagagaggcagggccagtgggctgtgggtgctggggcttggcacggtgctccccagcctggtggccccctctgcagtggatggagtcgggatcctgggggcactcaagaaacggaactctaccaatcacctggaggatcctggatcaagtggagccccatggagcctccggtgagaactcaccgcagctgacacccgattctgggctacgcagagaacccggccgtgcgggaagtccggcctgcaggttgtattcaggagcagctttttccaggaaagtttccattgctgtcagttttattttgtgttaattatttccaccat

SEQ ID NO: 469656 - DNA, 2701 bp, Homo sapiens
aggagaaggaagagaggtggaggaggagaggagaaggaggagaggtggaggacaggaggaggaggtggaggaggaggagaggtggagtagaggaggaggaggtggaggaagaggagaggtggaggagaggaggagaggtggaggaagaggagaggtggaggaagaggagaggtggaggagaggaggaggaagtggaggaggaggaggagagatggaggaggagaggtgaaggaggaggaggtggagaagaggaggaggagaggtggaggaggaggaggaggagaggtggaggaggaggagaggcggaggagaggaggagaggtggaggaggaggaaaggtggaggaagaggagaggtggaggaggaggagaggtggaggagaggaggaggaagtggaggaggaggagagatggaggaggaggagaggtgaaggaggaggaggaggtggagaaaaggaggaggaggagaggtggaggagaaggaaaggtggaggaagaggagaggtggaggaggaggagaggtggaggagaggaggaagtggaggaggaggaggaggagaggtgaagaaggaggaggaggtggagaaaaggaggaggaggagaggtggaggaggaggaggtggagaaaaggaggaggaaggaggagaggtggaggaggaggaggagaggtggaggaggaaggaggagaggtggaggaggaaggagaggaaggagcccctagatggagggcttctcggcagaggtgggcctcggaggaagagtcgggccttctggcggccccacctcggagcttggaggccctccatggggcccctccccaggggcctcctacagtgccctctcctcgagcctgccctgcttccagcccagccccggctgaggagtccttcaggggatgtgctcctgggctctgagaatctgtgacagtgcctgtgacatgccagtcaacctcacacgacaagctaggccatgcataagccctatcctgtgcgacgtggggacgcagatgcaggcacacccacatgaggggctgacaagcgccagtcccgtgccaggctcctcgcggatggggagtcccgggtccagcaccaaacatggggcgggcctgtgggacaggctcctgcgccagccctgccgaggcctagcagacttgcttgggaacacagtaggagagcctcatctgcttattgacaagatgcgaaaaatttcgtcctcgtctcaggtttttctgaggattgaaggaagggagggccctgtgcagaagaggctggtagatctcaaggtatccatgaacatggaaaacctcaaacctgtggtttcatggaggagcaaagagggccgtgttctggcttcctgtccttaagggtgggggacgtggcatctgtgactccacctgtctgagctcttgcctctgactttcagttcactgaacaggccaccatgaactgctttcagttcttctgctgaaaagccagacccctggaggaaggctgggcaggggcctggggctggaggtggatcaaggacacctgcaggttgagagggtcttgggtgggagagcactggatggggagcagacctgcctctgaacacctctctccagcttcttcctcactgacagcgctggtgtcttgtccttcctggatccaaacaatgcagaatgttgaacacaccctcagaaataatatactagcagagccctccaagaacacactgaggacaccgtgatgcagggatgcgccatgacacaggccgtctgcctcctcgaggagcttctctatgaaaacatcaaggttgagggagtctgaagcatggcaggagttcctcaactgtccactgagtggcccatgcggtgtgaagggaatctgagtgtgccctgtatcttatgtccaccagtcagggtctggcaggaaggggattcttcccagacttggacatcaaacactgattcccccagggcctggtcctgtgcccacttcctttcttctctgacactggagcctgggagagcctggccacagcatggctcttatacccgtctcccttctctctaagccccctccccggccgaaacacaggagccctggccttgcagatccagtgacccacggaccatctctgcctgggtgacccctgaaaacctccaaggttgtccgaccaggctgagctcatcacctgccctggcttgccctgccctctgttccctcccctctgtcaatggaaccccaccagccaggttagaaacctgacttaccatctctctctccttccacacccactctatccccttagacccctgactcaaaccctcatctatcttaaagggaacatggttggtgggaatgtaaactagtacaaccactatggaaaacagcgtggagattccttaaagaactaaaagtagatcttccatttgatccagcaatcccaccacagggtatctacccagaggaagagaagtctttttcgtaaaagaacttgcacacgcatgtttatagctcacagttcacaattgcaaagatatgaaaccaactcaaatgcccatcaatcaatgagtgaataaagaaactgtggtatatatacacaatggaataccagtcagccataaaaaggaatgaattaatggcatttgcagcaacctggatgggattggagacgattattctaagtgaactaactcaggaatggaaaaccaaacatct

SEQ ID NO: 469657 - DNA, 888 bp, Homo sapiens
tctgcgcttgttcagagcccagacctggcacctgcctgctaaggtgactgtgctgtctcagcatcacacgcagacacacgctacatgccgacgtgcaagcacagacgacacacgggccagggattatccagatttgggggccaggcactgggctcggtaatgcggctgcttaagtaacggggatttgccgttttccaagaacactaatacgataaatgctctcgcagctaaaaccgttctctgcgctgtctaatcgtgctttgacgacgccaaaggccttggaggctcgcgcagcatttcaggactgctgtaaatacccattgttcccgtacacagcacctctgagaggggcatcctggtacgtgcccctcaccattagaatacttccaggaaaggattcctgcacacaggacagcgaggaactgctgagggtgaggaacaggcaatgggaagccggtgtgaacccagagggcctctttgaagccctcacctcctgccagggcagaatagaggaggtgaggacccaggagtccgaatggctgaagtttgaagaaggctacaggccctgcccaggtgacagcgagaagatggctatcaatgaggaactggccctcatcagacaccaaatctgccagcaccttgatcttggacttcccagcctccagaactctgagagagtgtggtcatcagaacgcctgcagctgaagctcctccaggccctgcctcactgcagggagctgcctctcctgatgtcggctcttcctggcagtgagtgagccagtgctcactgtaaagtcctggccagtcgggcccagcctgtgctgcagctcagcttctccccatgacccatcctgcttcctcctcttcctttcgcagctgctgagccct

SEQ ID NO: 469658 - DNA, 1727 bp, Homo sapiens
gaatctgggaagaccaacaggagggtgctggggggctgggacctgcggtacacatggagcaggagcctggtgctgtcctcactgctgtgcatatggagcaggagccgggcgctgccctcactgctgtgcacatggagtcggagcctggcactgccctcactgctgtgcacgtggagctggagcctggcgctgccctcactgctgtacacatggagcaggagcctggtgctgtcctcactgctgtgcatatggagcaggagcctggcgctgccctcactgctgtgcacatggagtcggagcctggcactgccctcactgctgtgcacgtggagctggagcctggcgctgccctcactgctgtgcacgtggagctggagcctggcgctgccctcactgctgtgcacgtggagctggagcctggcgctgccctcactgctgtgcacgtggagctggagcctggcgctgccctcactgctgtgcacgtggagctggagcctggcgctgccctcactgctgtgcacgtggagctggagcctggcgctgccctcactgctgtgcacgtggagctggagcctggcgctgccctcactgcagtgcacgtggagctggagcctggcgctgccctcactgctgtgcacgtggagctggagcctggcgctgccctcactgctgtgcacgtggagctggagcctggcgctgccctcactgctgtgcacgtggagctggagcctggcgctgccctcactgctgtgcacctggagctggagcctggcgctgccctcactgctgtgcacgtggagctggagcctggcgctgccctcactgctgtgcacgtggagctggagcctggtgttgccctcactgctgtgtttggcagccctgagctctgcccagagcatcatgattgggcccagtagttccaaaaagtggaggaggaagtccaggccagagaacacagggctgtggcccagatagagctgaaacccagcatcttccttcaggtgattaggccatcatgatgtagcagcagcccctcagcacagataccctcctccttccccctctgcttatgtgtatggcgctttcctatctctcccctgggccttcaaggtaaagggtcaactccacacagtgccttccagcgtcaccttttgtccatgccctctccctccctggtctcgtggacttcactgccattgcccacacctgccaggatgaccctcactgccaaggcaccatacatgacatttcttccattccggaggttttcccccaattcttcttcatgatacagctcctccaggaagccctccctgacctccctccttgggtttcccacctctcaggctttctgtgttgttgatttctttttctccagctatcctgtctgctctgttaggatggcagtggggacagggacatgcctgctgagcatcaggggctcagcaaggctgtagagagtgatggcgttgtgtggtatacccccatacgttctcacacacacgtgcacagacatgtacacgttagacatgacacatcctcacacaaacacacatgcagacacacatgcatcatcacatatgcacatgcacaaaagcacatacacatgtgcagacacttgcacattatacacatgaacacagataacacacacatcacacacaggcacacacctgcattacatatctgactgaatgatgtgttttgcagtttcctggcctttgcat

SEQ ID NO: 469659 - DNA, 613 bp, Homo sapiens
cgtgtttaaggaatacaaatccttctaccataaagataggcatgtgtccttgcggcactattcacaatagcaaagacatggaatcaaccttgatgcacctcagtggtggactggataaagaaaatgtggtacctatataccatggaatacgatgcagccataaaacagaacatcagacatcaggtcctttgcagcagcacggatggagctggagggatggagctggaggccgtcatcctacgcgaattaacgcaggcacagaaaatcaaatactgcatgttctcacttataaatgtgacctaaacactgagcacacatggatacaaaggaggaaacagggaacactgggacatactctagggtattattcggatgacctgggtgacaaaattatctgtacaccaaaccccatgacatgcaatttacccatgtaacaaacctgcacatgtacctttgaacctaaaataaaagctggggggaaaattgtagtaaatgtccctaagtatgaaataaataaataaaatttaaaaataaaaaaattaataaatcttcaaatgcttccacatatttttttctggtttaagcaaagttagagagatgttcttgggcccct

SEQ ID NO: 469660 - DNA, 1181 bp, Homo sapiens
gctcctccagctccattcattttagcccgatgcaatgaggcttctttctgccttcaggaattgcttgggcaatggttcccaggaccttctgactcagaggattccacagacttttcagccctttcttctgggaggtctccgtggccttcccaccactgcctcagtcttgtggtgtcctgcctctccagtgcggctagactgtcttccccagctgacgcccatctgcggttccccacggccagtctcaacagtctcctgcctgcacccactcctcagccttctccattggaggctcccctcctcagacacacaggcctgtctgctgccccatcgtctctgcgcaggctgctctctcggtgtccctggcccatgcccactccacgctccagggctcagcctcctctcccgctctccaccccacccttcgtctcctgccctccaccccacccctcctttcccgccctccaccacacccctcctctcgggctcctgggcacccccccgccacctgcgtctcctgtcgtcagcaaaatgcactatttgctcatccagtgcccacagtttgcccaccggacggccctgctaggtgggaagctccttgcaggcaggaaccccatctccttgactttactttggaatccccgcagcctcatacggggctgaggcaggtccttccgtaaaatggaactgaatgagcggcgcttaatccatccgccaaaggccagtctcccttgggttttcaacagctggagaaatatcaaaagaatctgaatatcaccatctggaagttgtgccatggactccagtgggcaggattcgagctgggattctcttcttcctctagcagtgtatttcttctgcttaaaatgagcacaaacacatctaattccctaatggaccaactcagacctaaaagtctcttattctttgcccgccttcctctacccacatggattcctgggattctctaaatgcagatggcaatggggagggctggggattcccatcaaggatatttgatcatcggtgacttcacttaaccaataaatcaaacgtgttgaaatacacacatgtcagaaatgtgccgttagttagcagttcacattgtatgtggagtctgtatttataatataacattagttctgccctaaaattccacaggacaaattccatttggaaac

SEQ ID NO: 469661 - DNA, 939 bp, Homo sapiens
ttgggtgactcaggcaccttatcggagcccctccccaaccccatgtgagggcttaagtgtgactggttgcagacgtggcacttgtggccgtgtaggatgccacacgtggctgatgtggaaggggcactgcagggtgaggacggaaaggaagcaggcctgggctccagggtcccagggctctgggagaggactcttggtgcctgctggtggctgttccctcctcctctctgtcaagccacttttcccgtttctgcactcgctcttgggctgagactcctcaagagggaactcccttggtgccgccatctgcggccgtgggagggatcagagtggcccagcggccatgcagagggtgcgcagtgctgaagaagtcatggagaacgaagtcaacaagagctacccttggactctggatgcctgggagggtctggagccgtcgggcagaaggagaaggtggagcgggtcttcccggaggccggctcccacgggggcggccaaggctctgggcctctcggcatgcctctgcggatcctgttggatccagaaccgtctggatcacctgaagagttatttgataccagctgattttctaaggggacagccgggtggggatatcataggcaggcacactggcttcagaattagaggccaaaagtgtggactctctcagccactaactcagttctgctctctggcaaaacccttcgcagctcgggctgccctgtctgtgagtggaggtgggcagctcccgtctcagagtcctggtgggggtgaggtggaaggccccaggggcggcaccctccagtgaactccgtagcttcctccccttcatctcccacgttgtttacagtgtagctaggggtcaggacactgtccctatttcatatgctttgtttggcattttcggtatttaagcctctgtcaattcaatcagacttc

SEQ ID NO: 469662 - DNA, 626 bp, Homo sapiens
ttatcccattaaaacctaatcaaccttaccctgctcaacactagtatcccatcccacaacaggctttaaagggactgaagcctgtgatgactcacctgctacagcatgggcttctaaaacctataaactctccttacaattcccccattttacctgtccaaaaaccagacaagccttacaggttagttcaggatccgcaccttatcaaccaaattgttttgcctatcccccccatggtgccaaacccatatactctcctatcctcaatacctccctccacaacccgttattctgttctggatctcaaacatgctttctttactattcctttgcacccttcatcccagtctttcttcgctttcacttggactgaccctgacacccatcaggctcagcaaattacctgggctgtactcccgcaaggcttcacagacagcccccattacttcagtcaagcccaaatttcttcctcatgtgttacctatctcgacatagttctcataaaaacacacgtgctctccctgctgatcgtgtccagctaatctcccaaaccctgaccccttctacaaaatgacaactcctttccttcctaggcatggttaggtacttccacctttggatacctc

SEQ ID NO: 469663 - DNA, 610 bp, Homo sapiens
gcaaaaattggacagtggcattccccactttcccttgctcagaccccagaccctgaaattgacagaccctccaaggaatggcagggaggtctcgggacccacagagtaggtgtggggcaggtgcaagatcctcccaacagcaagtggaggttctggctgacacagcaaacccaggcccccagagtggcgtcagcagggaggcaggacacatctctgagcagagcagtgaactgtccgtgaggaacagccatgaaaggaccacctgcccaggatatcttcttcagcagggcgagaggcaaacgtatcctgggaaacgctgcaagaacggccagcgccttcaccagaattttctactggaaactgccggagggatggtgaagatgaggagaaggccacagccaactgcgggcaaaagaacagccaaactcacaccgcagcttggcagactaatggccatcatcattatgcccacgtagctgatgcactcatgttttctaatgtattctagtctattccattaaacaaacactgggcactctccccgcaggtaccatgaatttcacccccctgaatctggcgtgggtttctccagtccactgttttcatgttt

SEQ ID NO: 469664 - DNA, 1427 bp, Homo sapiens
ggagggtgctgcttgggaggcagcgtccctgacatgccgttcaccatatggagctcccgggggtttgtggggtgggggcagtgcggggagatgaaattagggtgcggcggctctgagaaccctgtgttgtgtctgtctctgagcctagagtgggaagatgcagaagatgaaggcatgaaaactacgggaggagttctacaagtggcatcctatctaaacctcgcatcctatctaaacgacgcatcctacctaaacaacgcatcctatctaaacctcgcatcctatctaaacctcgcatcctatctaaacctcgcatcctaccaaaacctcgcattctatctaaacctcgcattctgtctaaacgacgcatcctgtctaaacctcgcatcctatctaaacctcgcatcctatctaaaccacgcatcctacctaaacctcgcattctatctaaacgacgcatcctgtctaaacctcgcatcctatctaaaccatgcatcctatctaaacctcgcatcctatctaaacctcgcatcctatctaaacctcgcatcctatctaaaccacgcatcctacctaaacctcgcatcctacctaaacaacgcatcctatctaaacctcgcatcctatctaaacctcgcatcctatctaaacctcgcatcctatctaaaccacgcatcctacctaaacaacgcatcctatctaaacctcccatcctgtctaaacctcgcatcctatctaaacctcgcatcctacctaaacctcgcattctatctaaacctcgcattctgtctaaacgacgcatcctgtctaaacctcgcatcctatctaaacctcgcattctatctaaaccacgcatcctatctaaaccacgcatcctaccaaaacctcgcatcctacctaaacctcgcattctatctaaaccacgcatcctatctaaacctcgcatcctatctaaacctcgcatcctacctaaacctcgcattctgtctaaacgacgcatcctgtctaaacctcgcatcctatctaaaccacgcatcctatctaaaccacgcatcctatctaaaccacgcatcctaccaaaacctcgcatcctacctaaacctcgcatcctatctaaaccatgcatcctatctaaacctcgcatcctatctaaacctcgcatcctatctaaacctcgcatcctacctaaacctcgcatcctatctaaacctcgcatcctatctaaacctcacattctatctaaacctcaagtcctatctaaatttcacgtcctatgcaaacctcacatcctatctaaaaattcactaagatagatcagagatttcaatgtaaaactacacaactttgtttaaaacataggagaaaagctttgcaaactgagggcttggtggagagttcttagacatgataccaaaagcacaatccat

SEQ ID NO: 469665 - DNA, 757 bp, Homo sapiens
tgggtgctgtggcctgctccagatgccctctccaccggccagccccatccatgcccatgggcacacagtgcctagtctcacaaagcagctgtcagctgtgtcaggaacagacctgatgatgggttggaagagaattggaggtcctgctgcatggctggctttgaagacggaggatggggctataagccaaggaattcagatgggtctagaaattggaaaagtcaaggaaacagatgctgcccctagaaccctagaaggaacacagccctgtgggtgccttcattttatcccctgggactcggatcagacttctgacctcgagaacagcaagaagatcagagcaaaaatgctgtcactgtcactcctggcaaccatacccaagtattctttcatttgttcattattcagcaaatatttcctgagcacctactctgtgccaggtactgttctaggcactggggatgcagctgtgaatgtcatgctaagtccccgcttcctgcagatttcaccagttttacaagctgtcctagtcagtgggggtttctgtaacaaatactacagatcatagacatttatttctcatagatacggaagctggggagtccgagatcacagggctggcagactcagtccctgccctctcgctgagtcccggcacgctggagagagaccatctcttcttaagtctcttctcactaatctcatcatgagggccccacccacaagacctcatcaccgcccaaaggccccacctcct

SEQ ID NO: 469666 - DNA, 1387 bp, Homo sapiens
agggctgagctagtctgctcaccattggaactgggtgtccacttctccacgcagtgcccctgtcccatgggctgtgggtggtggttggatgatagaaggaagatcctggatggaacatgtgggaaggaggcagtttgactgacagggctgcgttgggcttcacccctgagtgtctggctctgccccccatccccaccgccaccataaatgcagagggccagtggcctctggaggtgggtccagcagtcagagggtggcccagcgagctcacatgaggcagcagataggcaccagggcgctgggcagacaagcggtaccagaaccactcacatgcaaagatgtgagctgaggaatggctgcgaccgcactgcaggtgccatgtgtgcacagaaagcccttgagcatatgcacaggtgcccccggccctcaggcacacatgagggcacaaacttgcaaatggctcagaacctcagcagggacgtggagaaatgcaaagccccggagtttcctccagtgttcaccggcctccgggtcaagaggagccgctgctggcagtcagggtcactgacttggtactcaaaaacccttactgtccctccttgggcagagtccccgcaaggctggctggaccaggacgtgcccccggccctcaagcacacatggggacacatgcttgcaaacggctcaaccctcagcagggagtcggagagctgtggagccccaagtgccacaggggccagggaagtggcgggagccaagtgcctgtgggtgccgggagtcctccgagccgaatggctgcaggccagggtgcaaggcccagcccgggagggcacagccgccttccccaaggtccaaggtcccttgcaggggtttttcctgtgggcgatgtcctgtccatgtcgagtgctttccatgtggcctctcgggtggacgccagcatcatctccctttgacatgaagcagaggtgctgggcttccacccatgtggttccactggtgtcctgcagggcttgtgagcgggtccgagtgccgctgtctcccacaggactgcagggcagtgtgagccgggtgtgccgcctgatccagcccagcagccgagccccagcctccgccccaggccttgctttccttaccagaactcgagattaccggcctctcaccaagtacggcctagactgtgacacccctggttcccaattccctgcaagatctgggctgccccacagcaggacggagccaggtgatggcccggtgtgcacctgagggctggactcagtccctccaacccccttgaggtctggacgtcaggctgggggcagggagtccctgcccaatgccctggggggagcagctcagaagctccccttcctcccccccgccgtttctt

SEQ ID NO: 469667 - DNA, 2637 bp, Homo sapiens
gatttctccagtttgggagaattcagacttgggggttgaactacttgtgatttggggcatttatcattgaaaataggcctcgttccctcacggagagttttctgtaaacaactcggcgccacacatccaggctcgcctgtagagtgatcccagcgggcgccacaggaagcaaaagagccatccagtcaatccagagaaccgcaaacaatcctacatcattgctgtttaaagccaccctggcagggttgtttgttgcacagcagaagagaactgatacactgtggagatctccttgtctctcaggggtcaccggcataacctgcagctcctccaccctccacctttccccttcctgtccatcacttttgaagggtgggcagtttacctaatcactgccctcctggggccaggaagccccttccagttcagccctctgctcccttcacaatgggcactgaggaaagcatctcctggcagggcctccgcacccctccaggccctcagatccctgctggacatacggacatagggtggcatagtgagggctggctcctgggaatcctgatgccgccacctggacagcactggaccctcagtgggctctgctgacagtgtcctgggggttcctggatggggacagatgacaggccgagggggtggcgcagcagggataggagctgcaatggaaggctaggccgagtctctccccacactgcccgcacgctctcccctgcatccagctcctgaggcgctctggcctcagcatctgcacctgtaaagtgggcctggagtatgcggaagtcccagccaggcagacacacaggagcctggtagacgtgcggctggggaaggcaagggaagtggcagttgggacgcgcgagcaggccgggctgcgtggacggccaccaggtggagggtacaggagcgctggggtccgctctcctagggagatggggctcggaccggggaccctgtcacccgcagtccgcgggccgcgggcgggcagaagcagagcctgggaccttgagggcgtctcccgactgggcgggggtcggcgctcgtccccgctgggaaggccgggaagcggaggcgcgcacagccccctccctgcgcccagcgcggtccgcggactccggctgggggaggggaacccggaaggggcccgccggaccacctgcctcgcccgccccgccgggacctccgatcggcccagccgggggcaggcgcagtggcggcggcgcggatggcgggactgtggccatttcacccggggggaggtggagaccctggtgggcggggggcccgccgaggccgcggggcgaggggagagcggagtgggcactcagcccgcgaaccccgcccccggggccagggcgctgggcgtccccgcccccgcacccgcagcctggtgcgcccgggtcgggggtccctcgcccggcttcggcggaggctgcgggtcgcagtgacgtccgcggccgccagggggcggtgtcgggccgcgctgggcgctggggtcgggctccgggctgccgcccgctttcccctgagcggatggggatactgaggcccggacccagccgtcacgggccagggcctcgcctctccccgagggcggtcggcagggtccgaccagggaacacctccgcccctgcaaactctctccgaccatggcgcagttcagcggcgctcagtccccaacccatgtcccggccccttccccgcctcgggcccggaaagtgatcttgcggacgcagggacccggcgggtcggggcatgtgggtagagggcgcgcccgcgcactggccgctgtcacccttgggactgccctgcactgtgcgacctgggccgggccaggccctccggtctccgttgccccttctgactcactgctcttcaagctgcagcaaagtcacagcaggcttcgccatgaccatgtcagccataccccttctgatggtcacctagcagatggccttgaaaatagaagccaccagagcagatgtctccgagcacctttacctgtgccctcctctgtgtctgtgcccaacatgctgcccccccccaagaagaactgcccatgtcgccagcccagggtacccctcacgtgtggcaggccccactccagccggcctcctccaggttatcagctggcctgcatcggacccctggtgccctccgcctgctccagcacagttggcttcagtggctgcggcctctccgtctccctgcagtgcatactcaactagagttgtcgagaaaacctaagccggccataccacccctccgagggcccttcccactccccagcgtcctcacacactttccggggcctctgtgcttgcagccccagcctccccctactgcctgtggctccctgcctgggcacacacagacccctgccctggtgggacaagccctcccagaggaagaggagtgtgcctgggtcaggtcccagcaggagcatgatggggtcaaaggtcaactcctatcccaagatggcaagacccccctccgccctccacctggggcttcctaggtgtttggaagtcatgctctgcccattcccctgccccagccaccctccccgcagcccatcctccctccctgaggaacctgccccttcacagctgttcacac

SEQ ID NO: 469668 - DNA, 3747 bp, Homo sapiens
ggctttaaaaatatttggagaacgcgatggaatttcgtgttgcctctgtagacatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacaccaacccccatgctggagactgtaccaccaagaagatggatccccagcccagtgagtgagaagatgagctagatgacacatgaatgtcatgctgaaaatgcccttgcactgctccaggaccacaattcttaccctattgcttcaaaattcactgttgtttcaaaccttccataatcaagttccatcctgccagggagggtgataatccttccattatctggtctcagaaaatattttcctgacataacataagccccgcatacactctccttgcgtcttctacctttctttgtagcattatgcaactataaggaaatgaccattcgtttcaggtcagtcttcctgtctctctgctgcctgtcagcccaggagggaaggcgtgagtgttcactgctaaattggtgcatgtggcaaacacctgatacgtatttgtggcctgagtgaagaagtggtatgtacaaatgatgttttcccccttcctgtggggatgacaatttgtttaaataattctgtataatttaggaagcttttgttccctttgctaagccttcaagatctgctcaagactttgaaagtgtgattatagattcttcctccataggagggaatgtcacatcacctccctgagaagaacattccaggaagtggggcttttaatgagtcac

SEQ ID NO: 469669 - DNA, 2023 bp, Homo sapiens
tggtttgtgatgttccccaccctgtgtccaagtgttctcattgttcaattcccacctatgagtgagaacatgcagtgtttggttttctgcccttgtgatagtttgctcagaatgatggtttccagctttatccatgtccctgcaaaggacacgaactcatccttttttatggctgcatagtattccatggtgtatatgcgccattttcttaatccagtctatcactgatggacatttgggttgttccaagttttcgttattgtgaatagtgccgcaataaacatacgtgtgcatgtgtctttacagtagcatgatttataatcctttgggtatatacccagtaatagtatctctgggccaaatggtatttctagttctagctccttgaggaattgccacactgtcttccacaatggttgaactagtttacactccaccaacagtgtaaaagcgttcctatttctccacatcctttccagcatctgttgtttcctgactttttaatgactgccattctaactggtgtgagatgctgtctcactgtggttttgattgcatttgtctgatgaccagtgacgatgaacattttttcatgtgtctgttggctgcataaatgtcttcttttgagaagtgtctgttcatatcctttgcccactttttgatggggttgttttttttcttgtaaatttgtttaagttctttgtagattctggatatgagccctttgtcaaatgggtagattgcaaaaattttctcccattctgtaggtggcctgttcactctgatggtagtttcttttgctgtgcagaagctgtttagtttaattagatcccatttgtctattttggttttgttgccattgcttttggtgttttagtcatgaaattgcacatgcctatgtcctgaatggtattgcctaggtttgcttctagggtttttatggttttaggtataacatttaagtctttaatccatcttgaattaatttttgtataatgtgtaaggaagggatccagtttcagctttttacatatggctagctagttttcccagcaccatttattaaatagggaatcctttccccatttcttgtttttgttggtttgtcaaagatcagatggttgtagatgtgtggtgttatttctgaggcctctgttctgttccattggtctatctctctgttttagtaccagtaccatgctgttttggttactgtagccttgtagtatagcttgaagtcaggtagcgtgatgcctccagatttgttcttttggcttaggattgtcttggcaatgcaggctcttttttggttccatatgaactttaaagtagttttttccaattctgtgaagaaagtcattggtagcttgatggggatggcattgaatctataaattactttgggcagtatggccattttcacgatattgattcttccaacccatgagcatggaatgttgttccatttgtttgtattctctttatttccttgagcagtggtttgtagttctccttgaagaggtccttcacatcctttgcttagatggcatcattggtgaattctaccaaacatttaaggaatttacacaaaccctcctcaaactcttccacaaaattgaagaggagggaacacttcgtagctcattctatgaagctagcatgatactaaattcagacaaagacattataaagaaagaaaactacagaccaatatctctgatgaatatcagtgcaacaagcctcaataaaatactagcaaacagaattcaacggcacattaaaaggattataccccatgaccaaatgggatttattcttggaatgcaagaatggttcaacatacaaaaatcaatcactgtaacacactacattaacagaatgaaggaaaacaaccccatgattatctcaattggtgcataaaaggcatttgctaaaattcaacatattttcattataaaaaaaaacacccaataaactaggattagaagaaaaccaccccaatataatgagggttgtacataaa

SEQ ID NO: 469670 - DNA, 1345 bp, Homo sapiens
gcagtgggtgaggactgagagtgagctggaccttcctggtgggtttggagcagagcagggtggtgattcagtgcaggatttcggggtgcttctggctgcatgagaaccaggatgtgggaggaggaggaggtggaggaagaggagaggtggaggagaggaggagaggtggaggaagaggagaggtggaggaagaggagaggtggaggagaggaggaggaagtggaggaggaggaggagagatggaggaggagaggtgaaggaggaggaggtggagaagaggaggaggagaggtggaggaggaggaggaggagaggtggaggaggaggagaggcggaggagaggaggagaggtggaggaggaggaaaggtggaggaagaggagaggtggaggaggaggagaggtggaggagaggaggaggaagtggaggaggaggagagatggaggaggaggagaggtgaaggaggaggaggaggtggagaaaaggaggaggaggagaggtggaggagaaggaaaggtggaggaagaggagaggtggaggaggaggagaggtggaggagaggaggaagtggaggaggaggaggaggagaggtgaagaaggaggaggaggtggagaaaaggaggaggaggagaggtggaggaggaggaggtggagaaaaggaggaggaaggaggagaggtggaggaggaggaggagaggtggaggaggaaggaggagaggtggaggaggaaggagaggaaggtcaggaggaagggggctgaatccacgcttttatcaagaatccactcctgtgatgatggcgttaatccattgatgagggcagagccctcaggacctaattaattcttaaagttcccaccagtccatcctgttgtcttggggattaagtttccaacacatgaactttgtgggaactttgaaaccatagcactattattacttttaacaaacatttatctgttaagattaattaagaataagaaaacaaaatgttttattttattttaaaaaacccttctctgatacttttttttaaattgtagatttgagtttctgacttatatatttttcctccttcctgaaaaacttttgatacttctggcaaggtaggtctgctggtgatgaatatctttaacttttatatgtctgagaaagtttttgtttctacttcactttggaaagatcattttgctagatatagaatgacaggttggtggatttttttctttcaatacttcaaacatttcactccactctcttgcttgctttctgagaagtctgatggattcttatctttttaggtaaggtatcttttcccttttgcttcttttaggattttatctttttt

SEQ ID NO: 469671 - DNA, 523 bp, Homo sapiens
aaataatatactagcagagccctccaagaacacactgaggacaccgtgatgcagggatgcgccatgacacaggccgtctgcctcctcgaggagcttctctatgaaaacatcaagacccacttcctgtctgcttccctccaccactcagacccacttcccatgtctacttggggaccagcccctccagggccccagctgacctctcttcctgggggaatcttgcaggagggcagttccctggacacaggaaagccccgcactgcaggtggcctcagggaggcatacactgtcagaggcagacacaatgcatgtgctcatcctggaggacgacccccatgcgacagagtcctgccctggaacaccccattcagaagctgcaacctgaccatgctggcattgccagtcaacctctggtgttcagtggagcctttggctggcagtgtcaacatggtcaggcctgcagcttctgaatggggtgttctgtggtagggccagtgggccccatggtcctgggttctctcct

SEQ ID NO: 469672 - DNA, 912 bp, Homo sapiens
gaaaacaagaagccacagaccagctcctccagcctgactcggtgctgtccaacatcctggccttgggcttggtgtggagcagggacccagggcacatgggaagaaccaggttggccctgagagattccagatgaagctagtgctaccaaaccgccgagagccgaccccttgagggcacggcttggagcccactgtctcgcccaggactctgctctctgcagctggccacttgatcagacgcttccgtccttgctgtgtggcacagggtgtaaggagccccagaagcccccaggctgatgtgcctgttgacaggaatgctgctgctcgcctttgccgccagccgggggctgcagggattggcctggacaatatttgaaagaatacaagacgattactggtacaaacacagacacgtagaccaatggactagaatagagaatccagaaataaagctgcacacctacaactgtctgatcttcgacaaacctggtgaaaagcaatggggagaggactccccgttcaataaatggttctgggatgaatggattaacgacttaaatgtaaaaccccaaactataaaaatcctggtggacagcctaggcaataccattcaggacacagggatgggcaaagatttcatgatgaagacaccaaaagcaattgcaacaaaagcaaaaattgacacatgggatctaattaaagagcttctgcacagcaaaggaaactctcaacacagtgaacagacaactacagaatgggagaaaatttatgcaaaccatgcatccaacagaggtctaatatccagcatctataaggaacttaaacagatttacaagaaaaacagccaacccaacccattaaaaagtgggcaaaggacatgaacagacacttttcaaaagaaaaatacacgtg

SEQ ID NO: 469673 - DNA, 898 bp, Homo sapiens
aactgcagcccagcaaaatgtggccgatttaggaaaccttgaatatgattgagatgacaaaacccttgggaatgagaaaaaaaggagctgtggagataaaagtgaaagttcgggatctcagaggagctaagaaactttggtacatgagaaattggataaatggaagacctgttgacaatgaggaaagaaggcttagtaaaccaacactactacaactactgctgctactgctactactactagctgtgaacaccagaatagctcagattacttttgaacctgtgagaggggccaaaatgcaggtcttatgtgttcccaaggggcccctcaaatgccacatgggaagtttaggaaaagaggaccaggagaactatcctatccctgaaccaggcccaaatgatactcaccctccccctctcacacctagacagtcaggtcccctttctgcccttgaggagttgggggtgtcctttcccactttgtcctacctcacaccagaaccgcagcttctgggtgaacatcagatcaaaggcagctttcctggtagatccacagctttgctactgaaaggtcagttgtgttatcgacttgtaagtgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggcaaagcacctaaaaccaggatacaaaatttggatttaaagtctttcatttgttaactttgacttaaaattctaatcaactaatctagaaagaagaccacaactcatcaaatatttcctaatgttcatttacagaatttaaacatataagtcagt

SEQ ID NO: 469674 - DNA, 986 bp, Homo sapiens
ttttcttggaacaaattcaaacacaaaaatgaacacagagtttcaatctgttggactgatttctgacttgtccttcttaaccactaaaaacaaagaaaaagataaagagaaaaaagagaagagagaaaagagaaaggagaaaaaagagaaaaagaaaaaagaaagagaaaagaaagaaaaagaaaagagaaaaagaaagagaaaaaaagaaaaagaaaaagagaaagaaaaagagaaagaaaaagagaaaaagagaaagaaaaagagaaaaagagaaagaaaaagagaaaaaagagaaagaaaaagagaaaaaagagaaagaaaagaaaaagaaaaagagaaagaaaaagaaaagagaaagaaaaaagaacaaagaaagaaaagaaaaaagaaaaagaaaaagagaaagaaaaaggcagcaaggagaggaaaggcagcaaggagaggaaaggcagcaaggagaggaaaggcagcaaggagaggagaggcagcaaggagagaagcaaaggaaggatttcaaaagaaaaatcttagctttgtaaaagaaacaaatatgtcaacaatagcaaaacttgtgcattcggcatatttgaagaaccactgcaagctgtgttaccaatctgtgtggctgcctacaagtgccaaggaattcacaatatcaatccccacactggagtaaccatcaaccaaataatgaaccgcaagtggcatataaagaacttgaagtatattgtttctctagtatattctgtgcacatgtttctgtcactttctgtctaaaatttaagacaatgagtcaaagaatcaatctgcattcacataacatattgtatttgataacattaatttcaaatgaagattgattttgatacttaagctgatgatatttgtcttttcaatttcattaatgccatatttttatagtattaagcaataatttgccaaggtgttggaacacattttattgaaaattatgtaaatgtttg

SEQ ID NO: 469675 - DNA, 1089 bp, Homo sapiens
tcggaggtggggcctgggctggtagtccggagggctgttattccttggaggccatgtggaccatgaggtccaccaccccgttgctgtagcaaaactaattgtcataccaggaaattaacttcacaaaatggttgctgagggcaatgctagccccagaattaaaagtggaagagggagtgtcaccgttaaagtcacaggggacaacttggtgttcagtgtagcccagtgtgccctcgaagggccttccgatgcctgcttcaccatcttcttgaagccatcatatttggcaggttactccagacagcaggtcaggtccacaactgacacattggtggtagggacgaggaaggccatgccagtgatctccccattcagctcagggatgtccttgcccacagccatggaagttccagtagatgcaggaataatcatcactgcatttgattttggtggtatcttgctcctggaagatggagataggatttccactgatgacaaacttgtgattctcagccttgacagtgctgtggagcttgccactggtggaatcatactggaacatgtagaccatgtagctggagtcagtgaaggggtcactgatgatgacaatatccactttgccagagttaaaagcagcccagttgaccagatgcccagtacagccaaatgtgtttactacaaccttcaatttcaccaactgtctcagggacatggctgctgctgcatggctgctgctgcatggctgctgctggtggcaaattcccccagcaggttcagagatgatgtctgggaaccagggcctagaattggaaatgtcagaaatctacctggtattctttctactgcagtaagtttggcaccaaaacagagtctcagtctctccctgtgtccaccactaccacaggcccatggggagtactgtggcctcccatggggaggccagggtatcgacagtgttcacttaaggcccaagggctcttcagtcatcttgtgaacactcaggcctgggactcacccttcagagcaacaggctcccttctagcatagtgtaggtccagaactaccatccaggagctaaggcctggaatt

SEQ ID NO: 469676 - DNA, 783 bp, Homo sapiens
atcaaaatcacttaaggcttctgaataggaagcattacaatgagtgaacttgattcctttggttcttaccttgggtggatagagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgtctcagtaattacttctgtgattatagctagttgtacatgactgaaattgctgaatgtttagatcaaataaatgaaatatttgtcctttcatttatatagttttattgtcttctcaaattcttatgggtttccaattcatagtgatttcccctaaaataaagaacagaggcttcgaatggtggttgcatattggaatctctggggagcttgaaaaaaaaaaagatactgatgcctaaattccattccagagattttgttatatttgttctggggtttgact

SEQ ID NO: 469677 - DNA, 842 bp, Homo sapiens
ccatttccgagtttccgtcgacacccctcttgtcgcgagaacgttgcttcctctcgtctctctctctctctctctctctctctctctctctctctctctctctctctctctctctctctctctctctctctctctctctctctctctctctctctctctctctcgctctctctctctctctctcgctcgctctctttctctctccccgcccagagttttctctgtcgcgtagggtgttgtgttaattttggcggtctcagatgtctcaggtacctgggttactgctttcacgaaccgaaagaatttcagaatgtggcgagctccaatttttaaacgcactgctgcttttgcctcagctgggcttccaaacagaaagtccagaagctgccctcgatgaatctcacagagtcatcgtagacattaaggaggcaaggaaatacagtgctacagcagagcagcagtgtccccagttgaaaattcagatctttagtaaaggaaaagagaagaaagaaagtattaggtggatgactgatgcttcagaaatatggattccaaagaaaaaggaaacaagattactggggtttagtcaactagctttacaacaagacacaaacaattcccttagtctagtagtagaatgtatactctggatacaagcctttggtcagttgtatatgtcgtaaatttcctctcctttttgtagcttgtcttttcattctctatatagtcttttgaagaagagaaattcttgattataacacagtcaaattcatcaactttttaatatgttccctgttttagaatgctttccctacaccaagatcataaaggtattctgtatt

SEQ ID NO: 469678 - DNA, 1514 bp, Homo sapiens
cagttgccagatgtgcatggcccctgagcaccagcaccacagtctgagggacctcccggtgcataacaaatttagtaactggtgtggggttcagaagggctcacctggggggttggacatgactgaggaggagctgggggccagcggtgatctcagctctgaaaagcaggaacagagtcccccacaacctcctaatgaccacagccaggattctgagtggtccaagagggagcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggagcccagagtcagtgtcaaggtcagctcacacaccctctgacatagagttgatgctgcaagactaccagcaggcccatgaggaggccaaggtggagattgcccgggcccgagaccaactgcgggagcggactgaacaagagaagctgagaatccaccagaagatcatttcccagctattgaaggaagaggataaactacataccttggccaattccagctccctgtgcaccagctctaatggaagcctctcgtctggcatgacctctggctataatagcagcccagccttgtcaggccagctccagttcccagagaatatggatttggccaagcatgtcgtggacacttctatggctgatgtaatggctgcttgttcggataatttgcacaacctcttcagctgccaggcaactgctggctggaactatcagggtgaggagcaggcggtgcagctttactacaaggtgttttctcccactcggcatggcttcctgggggcaggtgtggtgtcccagccgctgtctcgtgtgtgggcggctgtcagtgaccccactgtgtggcccctgtattacaagcccatccagacagcaaggctgcatcagcgagtgaccaacagcatcagcctgggtgagcccagggaaggaaggcttccatggggcctagtttctggtgtgcccagtggggtcttgctgggggatagaggtggagggttggaggcagccctctttggaggccagtgtacttggtgtgcaacaccaccctgtgcgcactgaagcagccacgggatttctgttgtgtctgcgtggaagccaaagaggtgcctgccttggtggtaaagatgttgtgggaagaacttgggctgaagtgtcgtgagaaacaatctatgtgggcctcaggtcctct

SEQ ID NO: 469679 - DNA, 563 bp, Homo sapiens
cacagcaggcacgggcccgcccccgccgccgcgggagttccagggccatgcgggtggcgatgctagaggagtggggaagggccaggtccaaataccaactcaagtctcctgatggctggggacaccctggagggccagatggctctgcctttctgagctccaggtattggggaaaaccaccctgctctggcagccacgggagtgcagctggtgtgagaggggaagtgcaggtagaggtgaaggcccacagttggctgacgggcactgaataccacatcacctctcacctcgaccccagagtaccctatggggcaggctgccctcctacctctcacagcaccaagatgacaaagacccaagacctgtccctgccactggaggggctgtggaggcaggagttccaaggaagtgaggcaacagtcagggaaataaattaataaatacaggccccccacgaggagcggctgggaaggctgctttgcctctgaacactgctccctgctttccactccaagcagccccgcaggttttggtgaggggcagaggggctgcagtttggaatc

SEQ ID NO: 469680 - DNA, 677 bp, Homo sapiens
tcagttccctgcaaccttcccacggtggagctcagggcctgaacacacctgtcatgggtggggaaaagggcttacgaacaggtgtgcatttcagcctgcaacagaggagctgtgaaccccaggatcccatccaaccccatgcagcaactaccaccctccaagcccgcagggcccattctggaacagctaaaacaaagaggtctgatctgctctggagatcagggaaatggatacagaagtataaggcagatgactggaaacagggatcagggaatggtagcgagatctgccttcccacccctggctatatgggcttcctgagcccagcagcccagcccccgttagaaaagagaggctcccagagaccctgcccttggctggacaccctgaagttctcatgggggactgagctgcagatgcctgcagggactgggtacctgggcatggaggaggcaaatagtcagggcccacaggcccaggtcatcctacccccatccacagccatggagactgatttaatagtaatattaaacataatgaataataataaataatgctatttattgtaaaaccacttagcaaagtcgaagtagaccctaagattagtgtcactttcattattgttatttttacatgtcagttgctttacatggattatctcatttaattctcgtaac

SEQ ID NO: 469681 - DNA, 744 bp, Homo sapiens
ctgaccacatccgtcagcccatacgcccatctgtcttaattctgcccagaaagtctgaggagcagggagtcagccctaagggagcttgtctcagacaatggacattggattttgacgatggcaatagtggtagagcatactcttgaagctactcttcctgacaaaactccaggggcagcaaagactccccatcgccaaggtgggtgtcagagacagccatgggacagcaaagaaggccacggtgtaccacaccagcatccagttcagtacagttctgcccatggccctaggaagcaggcttctagtggctttgtcttcatgtacagtcatgtgccatataacattttggtcaacaacagaccacataagactataacggagctaaaaaattcctatcaccgagtgacgccggttaactctttagtgaccctctcatggtgtgacactgtcaccataactgctggtgtcaagaattcaattgaaaaccaacagcctgagggttttaaaatcctgtacctttagcttggttagatcttcccaaagctgcagccatcgtaaagtggaaaaggaaagaataagcacagatcaataaggcaaacttattctttagtttagttgagtttacatagaaatctggaatgacatttgttgagaggctaatccctaaatggattctggaccatagagagatttttcccataagatcagagtctagcctatacttagcagcctcacaatgggaga

SEQ ID NO: 469682 - DNA, 885 bp, Homo sapiens
acacttattgcctgaaagagtgtgatgttccccttcctgcagacacagtttttaagaaggaaagtctacagatttcttcactggtttccactcattccaacccctcgtctctgcttggctgggatggtcttaatactggctacttccattcctcgacttcagtctattttgaaaccagggctggtgaattggttaaattccatcaatggaaaggacatcctaacagaacttcttaaactgaagtgtgcatttgaaccccatggcactttgttaaatatgcagattctggcaccctctgggaaccactgtgagcagcaaggtcctagaggatctgttgggagtgtctctgcagctggcagcctgcaacagcgctggcgttttttggagaggggacagattagccctgaagcctcagtgtatctcttcctgcagctcagagagcgagatggtattagccctacatacaaggaccagctcacattaaggcactgccttcagtctgatagagagccagacttggcagcactgcagaagcttctcctttctgctggtggaatgggtctggagagtttccactgcccaagccagcacagcatgaccagagttctgggtaagctgctgatcgtagactgggaaatatattcgcgaggatctgattgtgcatctttcacactctcaggtctgcgtaagccaagctctcagaagttcatgggcactctttctgaatacagatgactgctcaaagtttaaatacccgaaaagggagttgataccttctgtcatccccaattggtgcagcggaaaacatgaccatgtagtgtaaaacacatatgaacactgtcttagtcccttttgttctgctatcacagaataggtttcctatat

SEQ ID NO: 469683 - DNA, 540 bp, Homo sapiens
gcctcacttctcactgccaattctgtagccatctgggctgcggactcccacttggacagaacagttcttgggtatgtctttatcagcagcacaaaaccagactgaaacaataaattggtaccaggagaatggggcgttgctgcaaagatacctgaaaacgtggaagcgacttaggaacggagtaataggcagaggtgggaacagtttggagggctcaggagaagatacaaaaagtgtggaacttcctagagacttgttgaagggctttgcgcaaaatggtgatagtgatatggacaataaggtccaggctgaggaggactcagatggagatgagaaacttgttgggaactggagatatctggtggaagaaatttctaagcagcaaagcattcaagaggtgacttgcatactgttaaaggcatttagttttataagggaagaagagtatgtaagtttggaaaatttgcagcctgactatgcgatagaaaagaaaaacccattttctggggagaaattcaagccagctacagaaatttgaat

SEQ ID NO: 469684 - DNA, 522 bp, Homo sapiens
tgttttgctaatcctgctgctgtcatagtagattctgtctccttgggacccatgaatcttttctgcatggaacttgcatggggcaaacactggcagaggcatcccacacatccctcctggctagaggcctcaggaggatcttggggccattgcctaccaaaccaacatcaggaagaaagcccatggtggcattttctcccaggcagctttcctgggaattactccaaggctgtcaaccttcactcttctggtctgaggcacaaagaaggcattgcccttccttgtgaaatgtgtaaggaaatctgcagggactcacagaggccgtcttcagacactcatgtttttaaaaatggtgtgcctggtaatagttttagtcgctggggattcagcaaagaacaaaacaaagtctttacccttatcagagggagcaagatattaaagtttagggataaccaaatattactcattagagttgatgcatgctatggggaggcctgggtgaattgcaaatgtatgtaggag

SEQ ID NO: 469685 - DNA, 566 bp, Homo sapiens
tctgagataagtgttttcttcattggtggccatggaagtgagcgagggtagaatccggatgcacgttgaaggcagagcccaaggattgtctgaggaatctcacgtagagtatgaaagggaagagtcaagaaccactacaaggcttttggctaaggttcctgatcattacttgccgtcagccatccccttttctatttctgtggcagcttcttgtttacgagaaccgggatggaatgattctgatgttatgcttagttcacagcctctagttaagaacaacaaaaaacgactttgcctggatggctttgtgtacctttataaaactggggtccccatccccagtcttaagagaagtgagctcagagggcaaactcctgctctcccaattggagaaacatgcaggcaggtgaagagaatcacaacgtgctggagcagaaacctccttgggaaacagtactggggtaggaaaggcttaactgtaattgacgaattgtttcttggggactcaatgtggacaagtctgagttaaaaactccagggggaccccgttttggggtggggtgcac

SEQ ID NO: 469686 - DNA, 666 bp, Homo sapiens
gtttcactgcaaggaaaatggtactactcagctttatgaagcaaattctctcaagaccatcctctcagagagtgggtgcaaggcccgaatattttactactgcattccaaagacaatggaagctgacttctccctttcttacaccgctggcatttcactgaacaacctcctgtctcttccgcatttttggtgtttctcgcagcctttgaaggtgattttctcaggtgcccttaaatatgtcatgccggaattacagaagaattacctgatggagcctcttgatctctttcgttactttccccaaaacaaacggagactctctctctctcctgagctacctggagccgggggaggagtgatacaagcaccccagtggccaccaccaccaggactgtgctggaattctgaatttcttctctgcatcaccttatatttcattgagcttcctcaaaacagctattttgaattctgtctgaaagttcgcatgtctctgtctcttgaggattggtcacaggtgtcttatttagattgtttggtgaagtcatgtttttctgggtggtcataacgctcgtggatgtctaggcattgaagcgttaggtatttgttgcaagcagcaatgatacctgtcctttttaggaaggctttccaggtatttgaaaggacttc

SEQ ID NO: 469687 - DNA, 528 bp, Homo sapiens
cagctgacttagcctttcctcccgctagttcttaggaatccagcagcccagatgaggacagtcaaagtgcttcattaaatggtcctgttccccatgccactcaactggttgagaccttccaacagggattgtcaggcactctatataggagccatcctactgacatcagacaaactcgtggagatgagaaagaatcaacaaaaagaaagcactgaaaacccaactggccagagtgcctcttctcctccaaatgatcgcaacacctctccagcaagggcgcagaactggacagaggatgagatggacgaattgacagaagtaggcttcagcagatggataataacaaacaccactgagctaaaggagtatgttctaacccaatacaaagaagctaagaaccttgataaaaggttagaggagcagctaactagaataaccagtttagagaggaccataaacgacctgatgcagctgaaaaacacagcatgagaactttgtgaagcatacacaattatcaatagccaaatc

SEQ ID NO: 469688 - DNA, 562 bp, Homo sapiens
gtagcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccacccttgtgtaagtgcctaaaaggtgataccccggtcaaactttacatcttctcagttcaagcaagcaaaagaggaaatccaatttctaagcataagaataaaattgtcccaggatgggtcaggttcccatgcttagtccaggttctggagaacaaaatgaaacaaggaggcagatattagactggataagcttgatacataatttctgctctctgggttactcagaagctggacttggattcttaggcatataagtggttagagaactttctaaccactggggtgggggtgagctggtccctgcta

SEQ ID NO: 469689 - DNA, 2098 bp, Homo sapiens
ctcctgctacttgggggaagccaaagcaggaggatcacttatgctcgaaagtgagatttcaatggaaaaagtgaaggtaaagcgttatgtgtccggaaaaaggccagactatgcccctatggagtcctcagatgaggaggatgaagaatttcagttcattaagaaagccaaagaacaagaagcagagcctgaggaacaggaggaggattcatccagtgacccccggctacggcgtttacagaaccgtattagtgaagatgtggaagagagattggctcgacatcgaaaaatagtggaacctgaagtggtaggagagagtgactcagaagtagaaggagatgcttggcgcatggaacgagaagacagcagtgaagaagaggaggaggaaattgatgatgaggaaatagagcggcggcgtggcatgatgcgtcagcgagcacaggagagaaaaaatgaagagatggaagtcatggaagtggaagatgagggtcgttctggagaggagtcagaatcagagtctgagtatgaagagtacacagacagtgaagatgagatggagcctcgccttaagccagtcttcattcgaaagaaggaccgagtgacagttcaagaacgtgaagccgaagcattgaaacagaaggagctggagcaggaagcaaaacgcatggctgaggaaaggcgcaagtacacactcaagattgtcgaagaggaaaccaaaaaagagctggaagagaacaagcgatccctggctgcattggatgcactcaatactgatgatgaaaatgatgaggaggaatatgaggcatggaaagttcgagagctaaaaagaatcaagagggacagagaagatcgagaagcgcttgagaaggagaaagcagaaattgaacgcatgcgaaacctgactgaggaagagaggagagctgaacttcgggcaaacggcaaagtcattaccaacaaagctgttaagggcaaatacaagttcttacagaagtattatcaccggggtgccttcttcatggatgaggatgaagaagtatacaagagagatttcagcgctcctaccctggaggatcatttcaataaaaccattcttcctaaagtcatgcaggtcaagaactttggacgctcaggtcgcaccaaatacactcaccttgtggatcaagataccacctcctttgactcagcttggggccaagagagtgcccagaacacaaagttcttcaaacaaaaggcagctggggtacgagatgtatttgagcggccatctgccaagaagcggaaaactacctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaataattactatgaggtggtaaatacataaagatgaacacaggataggaaatggcatgtagaatgtattatggcttagaatttgaataccaatcaaaacctttcataggtttttttc

SEQ ID NO: 469690 - DNA, 626 bp, Homo sapiens
tgctgtcatagagtaggggggaagggcagcagggtgcctgtgtgccagtggggattcgttggtggcatctgtacatgagcactgatgctgacagcaatggcatggtggggtgtgcatacacatgttccagtggagcagtggtgaggtccgcctatgtgtgcatgtgtgttggtaaagtggtagaagcttgtcagctggagctccctgaaggtcaggtgtggtatgcctgtgaaggagttatggctgtggcatccagacagtaccctggttgggtgtccaaggctgcactggaagcagacatggccaggcagggaccctgggagaggctggcacacagggtgatgctcaggtcccatgagaaaaactacctgaacatggtcattatcttcaaatttggccagacaaatatccctgaagatatatgctaccctccaaacccaaagaggcagaccagacattgtgctcccttctttgtaacaggtcatgcaagatgcagcaatttatgttttggtttggagataatccaggaacatcattgaccactgtatatcacttagatactttattaaaataacaatgtgataaatcctggaagggttcctctcttgctttccagagaacatagt

SEQ ID NO: 469691 - DNA, 1600 bp, Homo sapiens
agccattgagtgagcacagtagaggcactcaagtttggaagacggtataagatgcatgccaccagcagcatctgctcctgtttacatcctggttttggcagggaaagcccttctccactcagtgtccagagattctgggaagggcatctggcagaatctgcaggtcgggttgtggctgcagcccttcagcaggctgtcctggccactggattagcagcagtcagacccctcttctgtagggctgctgtggtttgctgggggtccactccagaccctattcatcttggtccctcctgcccctggaggagctcctgtcagggatatcagagttcttcccataaacccctggctggggatgctgaaattcccacagagaggctctacttatctcactggcaccagcagcagggaaaaatggccaactggagccacagtgatgtcggccacccctccccactgggaactcagtcttctcagcgacttggtgggctcagtctggctaccctgctggcccatgagggcatcagccctggcctgcacctgggctccaagcttcctgcaatcatgttccgggctcctctctggcctcttgacactcctgctgctcttgttcctgtcactgccaccatcagcgctgctctaatgcttgtgtttctcctgttcaggggttctcccgcagacaaaggtgctgacggggacctggaggggctgctccaaaagttcttgggaaggcccaagataagatctggctacaagttcacggttctctgggcgtctttccttctgtggtttaagtaaccatactctgctccagacctgtgagcacttgttttgggtaactccagatgggagagttacaaagtaggtaacattttttttcctcctataatttaatctagtttaatttatgaagtttatgtagttattcattagttgcattaaagttaaattgtattaaatttagttcattcaaattattttctttggtttgaattcatttcacttagttaattttagttcacttcacttaagttttttcttaggttagtatataggttcagtatatgatttattattttttaacttcattttcttttctttatatgtcctgtaataccgtttgtcaccgtaagtttgtctgtagtttacaaagattttttcctaaagttatttattttaaattcttaataattgctgacactttttgtatttttgtattttagaaactatttgaggaaaaatttactttttattactgttaatcagaatgtaaaataaaaaggaaatgggcttccttactttcccttgtcattcatgagaagagtcatcttaagcagaagatatagaataatttaggttgcgttatttttggataggaaacttcaggactgatctctgtgctatgcctctggaagacattcaagagctttgtacagtgtacttacataacagtattctgttccatttgatgaaagcatcttcccacatcttttatcggtaagctgcctggaaaaaaataatgatacaaaactatctgtgttttactaactcagaagttgtaaatattatatgttcaatattattactcttcaaatgacat

SEQ ID NO: 469692 - DNA, 680 bp, Homo sapiens
tatcaagaaaaataactaatgagtacagggcttaatacatgggtgataaatatctacctggaggctattatccttagcaaactaacacaggaacagaaaaccaaatgctgcctgttctcacttataagtgggggcaaaatgattagaactaatgaacacaaagaaggaaataacagacactggggtctgcttgatgggggagggtgggaggagggagaggagcagaaaagggctgcctgtttgggttatatcaccaggttcctcctatgcccctccggcttctttgtgggtttgggtaatggggcacatcagcaggagacaggagaaaggttccaggcacccacatatggaaaactgagcctgcatcaggatacatgtaagacagaccagtcaagcaatggaaaagtgacaattttccatctattctgggtatcctaccatgatgagcttaagttccaggaaggaaactgaagaagactttcttttaccaagttttgttggaggggtttaataaacttgttaaagaagcactgtccaacattaaatatactatccaaagactttctgaaaactaatctatgtgtcataattgcatactgtgtagacattttcattgtcaatcaaataaaaatgtatttcttaggttacctttagagatctcagaataaaaagactcttgc

SEQ ID NO: 469693 - DNA, 1105 bp, Homo sapiens
ggccatcgtcttgtcttgcttttctctgttctccgtgggtcaagctgtttccttgattagtcccaatgcgagtcaatggatatgctcagagaatgcaagaaactagcagaaaaggaagaaccaagaagccatctcctaatgaaaaacatcagttacttaaacccccatgcaatgaaccaatcaccaatacaggaaaatttattcctagaaaaccaaaagtgaagacaatgattatgactgtatatacacagcagccccatagcattttgaaaacagaaaaattaggaaaagattatttgatgattatcctaaaagctaaggatacttttcaatggattcacaaactttcaaaagaaatatttgacaattgtgctaaatcaagcagtgacttacaaaagaagttgaagacaaaagcagtaaaagtggagaaatcctgtttattcatcgtccaaccatccatacctccaaccatctagctataatataacacataagaggcaataagagagatctgtgcattcccttggtgtgcagctgtatatgaaggtggtattaaataggaggggtagttagttcagtgagtaggtatgttttgtgggaatctgaatgagggactacatcctcatcctgaaatcaaatccttattctcctacatttttttttctgtagcatcgtttttggggatgttctcctgcagtcctcactccctagatgagttaaagatatgccccctatacttgtcttcagtgtaaacagtttgcaactgattctgattactgaatggttattgaggaggtctgttgcactatactgccagaatcaaaagtcaaatcagaagtcagctttaaaaaaaattactgaacatcatatcaaaagtatttcacataagattcgtgagcattacagtaacaagttgaagtacttaacaattccctcagagttatatattttttgcatttatttactatttttaagtcctgctataaacacatttttaaataatgctctttatatgtttaaagttattttcataggataaattgcttgtggaacatggccaaaagagatgcatgtttttatgtctgttgatatacttcacaaaagc

SEQ ID NO: 469694 - DNA, 1754 bp, Homo sapiens
ggtggagccaagatggccgaataggaacagctccggtctacagctcccagcgtgagtgaagcagaagacgggtgatttctgcatttccatctgaggtactgggttcatctcactagggagtgtcagacagtgggtgcaggacggtgggtgcagcacaccgtgcgtgagccgaagggggcaaggcattgcctcactcgggaagcgcaaggggtcagggagttccctttcctagtcaaagagaggggtgacagacggcatctggaaaatcgggtcactcccagcctaatattgcacttttcaaatgggcttaaaaaacggcacaccaggagactgtatcccgcacctggctcagagggtcctacacccacggagtctcgcagattgctagcacagcagtctgagatcaaactgcaagggggcatcgaggctgggggaggggcgcctgccactgcctaggcttgattaggtaaacaaagcagcccacctgaccacagctcaaggaggcctgcctgtctctgtaggctccatctctgggggcagggtacagacaaacaaaaagacagcagtaacctttgcagacttaaatgtccctgtctgacagctttgaagagagtagtggttctcccagcatgcagctggagatctgagaatggacagagtgccttctcaagtgggttcctgacccccgagcagcctaactgggaggcaccccccaggaggggcagactgacacctcacacagtcgggtactcctctgagacaaaacttccagaggaaccatcaggcagcagcatttgcggttcaccaagatccactgtcctacagccaccgctgttctgaagccaccgctgctgatacccaggcaaacagggtctggagtggatctctagcaaactccaacagacctgcagctgagggtcctgtctgttagaagaaaaactaacaaacagaaaggacatccacaccaaaaacccttctatacgtcaccatcatcaaagaccaaaagtagataaaaccacaaagatggggaaaaaacagagcagaaaaactggaaactctaaaaagcgagcacctctcctcctccaaaggaacgcagctcctcaccagcaacggaacaaagctggacggagaatgactttgacaaaaaaaagaataaaaagaaatgaacaaagcctccaagaaatatgggactatgtgaaaagaccaaatctatgtctgattggtgtacctgaaagtgacagggagaatggaaccaagttggaaaacactctgcaggatattgtccaggagaacttccccaatctagcaaggcaggccaacattcagattcagggaatacagagaacgccacaaagatactcctcgagaagagcaactccaagacacataattgtcagattcaccaaagttgaaatgaaggaaaaaatgttaagggcagccagagagaaagctcggaaactctacaagccagaagagagtggggaccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccaaaatgtaaagaccatcaaggctaggaagaaactgcatcaactaacgagcaaaataa

SEQ ID NO: 469695 - DNA, 749 bp, Homo sapiens
agttagaagatttatcatcaagtaacaactacaagatatgccttgtaattttttcttgatatttggacatgatgcattggataaaatcaactgctgacagagatggccaaggaaagtcttaaaggatatatgggaatgaagttggactttaaaagaagaaagaaccagatccaaattcagtcctccagtgagagaatcacattaaaaaaggctatgcttgatgctcatcctggaacctggatggttataatgaaatctatgaagatctcaagaaagcatcttcattggtataattcgaaaccatgccagctgggcagaatgcatgaaaagtaccctggggagacaaatgtttcatttaggtacagtaatgaaactggaggatataagtcagttctgcatcatgccctcagttcattagttgaagcagccaagtcttcacgagccgcaactgatcagcaaatgggaaatgagcaagagtataaattcccagcaaaccaaatcattaacatttgctgcctgcatcctggaaacacaggccaataatgcttagatttgcccttttgaggcttttttttttttttattttagatcctgtaggtgtgcttcattttttaaatttttttcttttgtctcttcttgcaatgtattttcaaatagcctgccttaaagtttgctaattctcttctgcttgatcacttctgctattaaaagactctgatgcattcttcagtaatgcaagtgcatttttt

SEQ ID NO: 469696 - DNA, 603 bp, Homo sapiens
ccacttcccctgaaataagacagctccacactatagcatatggggtggttagctgaatacgaaggtgagcttactcaaggatcgcaactctcaccagctagggaacaaaactggacggagaatgagtatgatgaattgacagaagtagacttcagaaggtgggtaataacaaactcctccaagctaaaggagcatgttctaacccaatgcaaggaaactaagacccttgaaaaaggcagaatcgatcaagcggaagaaaggatatcagatactgaagatcaacttaatgaaataaagcgtgaagacaaggttagagataaaagaatgaaaaggaatgaacaaagcctacaaaaaatatgggactatgtgaaaagaccaaacctacgtttgattggtgtacctgaaagtgatggggagaatgagaaccacgttggaaaacacccttcgggatattatccaggagaacttccccaacctagcaagacaggccaacattcaaattcaggaaatacagagaccaccacaaggatactcctcgagaagatcaaccccaagacacacaaccatcagattcaccaaggttgaaattaaggaaaaaatgtt

SEQ ID NO: 469697 - DNA, 757 bp, Homo sapiens
gcatgccctgtgagggggacaagggaacctttccttaaaatccagagagccatgtcaatactgagtcccgctgcatgcactactgtctcacacagtaagcgatctaagctggaacctgatgatgtgcagcatcacgtgcaggtgtccaaggatcagaccaaagtcaagaagacaacatccaggacttacagttttatcctctgtatgcaagaggtgttcaagctaagggcctactgtacacgaagccaggatatctcaaaattactctacataaaaatctatgtactaactcataaaagcaacaaggaggctgccacctttctggagccatgggtagaaataaacaaggccattgaacctggcgcctatgctacacccatatgtaggcgaggtggaagaaagagcatcactggaggaatagacatagttagaattgggaagcttaagacagggacagcaaaaaactgcaatcaggatacattctccctaatctgggaaatgcagatgggagtaccctacaagttaagcagggtgggggagagaaacggcaaactacttgaagacccatcaaagtacccaaaagagaaagatttagctgtataagcctgcccctgtctacactcctgaaggcttacctgtaaggattgcatcaaacccctagatgctggctggttttaggcagtggaagatcttggagggtagagtaaaagaacctggttaatttattcccctggcattctcacagctgggctgcaga

SEQ ID NO: 469698 - DNA, 600 bp, Homo sapiens
acatcaaaaaacttatgcatcatgaacaagttggcttcatccctgggatgcaagaatagattactacttcaaggagaaccactgcccaaggaaagaagagaggacatacacaagtggaaaaacattccatcctcatggataggagcaattaatattataaaaatgaccatactgcccaaaataatttatagattaaatactattcccatcaagttaccattgacattcttcacagaattggaaaaaaactactttaaatttcatagggaatcaaagaagactctgtatagccaagacactcctaaggaaaaagaacaaagctggaggcatcacgtttatggaaccattgtgtctcctggtggcagcgttcttccttctggagctaagacctctaggcaagcagaacataatgtcacaggaataggaagcaaaagttttgctagtgggccattaggggtgatggattaataaattattaatcctatttctgtatttctacactgttgactttgtagttataaattttttaattattttcacaatggttacccaaggtgacatcaagtacaatgcacattgatcattttcagagcatgggga

SEQ ID NO: 469699 - DNA, 720 bp, Homo sapiens
gcagcagccgctgccgtcacaaccatagcttattggatcagcaaactttttgtaaagggccgtatgggtaagtatttaggtttcatgggccatacagtctctgttgcaactagtcaattctatcattatagtgcaaaagcaactatagtcttcttttttccctctgatcagacctatctacgccattcctgtgatgaacctgatctcagagtgattatcacagacacatttaagactaggacattcaaaatcagcttcatgtacaggaggaattataaagttaccacttgtgccaagggaagaaaaacacctaaaactgtccctgaaaaaaatctaatgacagatatattaaacaaagtcattaaaagtactggcttaaagatgctcaaagaattaaaggaagtcatggagaaaaccagtagcatgatgtatgatcaaaatggaaatagaagtaaagagatagaaaacctaaaaagaaaccaaaaagaaattccggagctgaaaagtacaacaactaaaatgaaaaattcagaggattccgaaggcagatatgagcacatagtgtaaaaatcaaggaaattgaagatacttgttaatttggtgtccttcctgggggtgggtggtgagaatcagtggaattttctattccactatcctgcttgcacaaactctcccataatcaacaccaggagttctcagcagactccctgaattgaggaa

SEQ ID NO: 469700 - DNA, 615 bp, Homo sapiens
ctgcaacacacgcaatccacacaacccagttatgtgtagtgagactttgaggtctgtccagccacggggatagaagctcctcgaggaccagagctgccatctctgctctggcccggggtgtagcacagaggctcgggcacaagagggctcagcacaaatccgaagatgtgtgagcaagtgagtgaatgtcacctacgaggcgccccagatgaggaagctgatgctcacggcaagttgaataactcattcaagatgagattggaccccaagaatgtcttacctgcagacatcaacaccccagcagcggaaagtgctgctgacctgcctttgcaccgggaaaccttgatccttgattctcacactgccccactgcgggggagtttgggagctgctcaggcatttccaagcccctttccaagcccctgtccagtgattctgctgagggacttggttccagggcagccattccctgggaggttgctggagtatcctgcagaggctttcttgtgtctgcttcagagatgctactcagcagggcaggcagctggattccatgtcacagtgtcttagaaaactcagtccccgccacctttgcttgattcaattgtgtgatac

SEQ ID NO: 469701 - DNA, 689 bp, Homo sapiens
tggcccaccatgcccccgtcctgtgcctataatctgtgtgacctggaggttctcaggcttattgtgaagagccctaaaatagtcaagaggaatgtgaaagatgaggcccaggacaagaccatagcaggcaggcacacaagccgctggacgtcgagaggaacacgttgtttgaagaagacacaagcagctggactgcgagaggacgtggaggggagcatgctggtggaagagcacatgacagacggcacgtgggcaggctatggactggcagaacggggaggagtttggctggggcagtccgaggagagccggggctgccgagtggcccaaatccaggggaaaaccatctcgcttttggctctcccatttgctgagagctacttctactcaataaaaccttgcactaattctccaagcccacacatgatccaattcttccggtacaccaaagcaagaacgctgggatacagaaagccctctgttcttgccataaggcagggctggcgagtgaatggcctgcctgttacaagtcaatgtgaagaagcagggcaggtcagccagaagcaacgagaccaggattccaacagttgtcttccttaagagttctgccaactctgattaaggatggactggagaagaggctggggttttataagtaggtatagtttctgattgactttggtattgac

SEQ ID NO: 469702 - DNA, 1789 bp, Homo sapiens
ggggcaaaggccggggcccccccatgaaggagcgcgacgcggccccggccgagcggggcaagccggccacctacaccggggacaagaaggcgaagatggcggccaagaccaacaagaagtgggtccggctcgccaccgtgttcgcctacgtgctctccgtgtcgctggccgccatcgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaagcctgtgtaagt

SEQ ID NO: 469703 - DNA, 1447 bp, Homo sapiens
tgactccacttaccatcactcccagtgacctttctggaggaatttgtggttcccattcctgcagttccaagctctccaggttcagagaatctggttcccagagggggagcacttccaccagggacagaacaagaaccccataaacttaagtatggctgctttctgttcgtcagactctttgtgccaagaaaccagcaggaaagaagaggagtcacttcctggaaggggcaactgacccccatcctttgggagagatagggctgctgttacataagggggtcaggaaagaatatgtttggcacccaggtgatccactggggtgtctgttggtggttctggtgtgatatcaagatggagaaccacagggctcagtacccgacttcagttcggcagcctgagtctgcccgtttttattggcagctctgtcatttgactcagatggagctggctgtcagcgaaaaccctcagttttattcacacatgcttctgctaagctgccacttccccaccctgtccttgtacactctggagaaactgctgcctcatatctgggggaatgtgggctttgcattcaccaaggaggacctcactgaaatcaaggacatgttgctggctagtaaggtgccagctgccacctgtgctggtcccattgccccatgtgaagtcactgtgccagcccagaacactggtctggggccagagaaaacctcctttttccaggctttaggaatcaccactaaaatctccaggggcaccattgaaatcctgagtgatgtgcagctgatcaagactggagacaaagtgggagccaacaaagccacgctgctgaacacgccgagcatttctccctcctcctttgcgctggtcatccagcaggcatctgacaatggcagcatctacaaccctgaagtgcttgacatcacagaggaaacttccttcttgcttcctgaaggttgtccgcgatgttgccagtgtctgtctgcagactggctacccacctgttgcatcagtaccccattctatcatcagtgggtacaaatgagccctggctctgtggagactgattataccttcccacttgctggaaaggtcaaggccttcttggctgatccatctgcatttgtggctattgcctctgtggctgttgccaccacggctgctcccgctgctgcagccccagctaaggttgaagccaaggaagaggtggaggagctgggccgcttgggaacagcttgcttcaagtccacagacaggagcaaccctaactcagtctgccctgcaaaggtgggtacagcccctgatccacacgaactgctggaagaaaaatccaaagagaaagtcagtgaagacgtttgtagaaagaactgttgaagaaggaataagaaactgccatttttcctgtcagtgtctgctaataagtaataataaaataacaatgataactcat

SEQ ID NO: 469704 - DNA, 703 bp, Homo sapiens
gcagcagccactgtatcatagagagggggaaagcagtgacgcaaaagagagtggggagattgccaaagcgatgaccttgagtaggcaagacaaggtggtctcttgtgtgcaggtagaggggacagccatcaagaggagcacagggagtccgtttagtgacatgagggatggtggggcactgggtacaggtgctggtagatgggtggtggagcttgtggaagaactgagggcctatattgtacagcttccaagagaggccatctggctgctgctgctgctgccagcttccagacggaagctgagatttgctattgatgttccagcattgattgagctcctgcctcgtctgcatcaggcatggtcctcgcagcttcacgcagtctgccccaaggggcatgaattctcttgcacttctggtttgtacaagcctagaagtggccagctgatcatcccacaccttattagcaactcacacctcatcagcaatagacaagaaatcctgggaaggagccaagaggggcttgctgtacccatgggtgacttgaggggccatggcagtggcatcagaagtgacatccaggtctacacctgtgagagcagcacaggccatgttagatctgctcagcctggcagcaggcaagtgctcagcccggcagcaggcaagtgcacaggtctggatgatgggtaatctgaatccagtcac

SEQ ID NO: 469705 - DNA, 698 bp, Homo sapiens
ccacagaaacaatgaagcctggttcttctgaaaagggttcccactttccccaacttcatcctggttcaaccagcctcaagactgaggcgactcaggcagctctcagcggcttcagcctgcagtcccagtgggctgtgagtcacgggctgcgctgcaagcaggctgctctgagagagccctggagagctggccgtgggtgttcagaccattcctgctgctggtcaggaacgtcccttcaggaagttcgttcactccaagttgtccctaagcagttcagccccatagccttctcttgggatgactccaggctttccccacacttctgtcattaccaagctgaacaaaacagctcctctcctggaattcatccagctgccgacttgcgagggtacatgagcagctgttgttacagtggagagaagagggtgtgggctttagagtcagacagccagggctcgaattccagttctgcaattacttgctggtgaccttgggaaagtaacttaacttctctgagactcaactttcctatgctagaagtcatgataataatagtagggtcgttatgaggattgcatgtgtcatctctctgagagcagagaaactgtctatttattagtgtttaacccacataaagcattgagtaaatatttattgaatacatgcaaaatgcttcacacagtgtttagcacatagac

SEQ ID NO: 469706 - DNA, 476 bp, Homo sapiens
ctctgcaggctccagcaatgccatggttacactgatttcaaaacaacatctggaattgtgtgctctgcagtcgggggtggagacaaatggccccttcaccaggtctgctcatgagccttggggagacccttttgatcaccagttatgtgcccgtgtttcttttgttaggtgttccaggatgcagggccccctctgggaaaggcttgccaaccacagatcctggctttgtattcctgagctgctgtactgtggccctggggcaccagaacatcccatggctctgtctgaatccatggttggattctggctgcactggggattctatgtgctccagatcaccaggaaacagcagcagcagcagcagcagcagcaggaggaggaagacagcaatgatgaggctgcctaccgagcattcatgaggacctcctatgagaagaacccaaagctgttagcatccctggctgctgaataggtct

SEQ ID NO: 469707 - DNA, 507 bp, Homo sapiens
gacgtttttcagctgagatgtctgaatatgtttgcagaaaaacttccaaatctcacacatttaaacttaagtggaaaaaaactgaaagatatcagcaccttggaacctttgaaaaagttggaatgtctaaaaagcctggacctctttaactgtgaggttattaacctgaatgactaccaagagagtgtcttcaagctcctgcctcagctgacctgcttggatacctatgacccagaggaccaggaagcccctgactcagatgcccaggtggatggtgagaatgaggatggtgaagaagaggagttggatgaagaggaagatgaagacgaagatgtagaaggggatgatgacaaagatgaagtcacggaaaaggtgaaaacaggaagagagaaacagatgatgaagaagatggttaagaccccagaccacctgcagaaacagaactgttcagtattgtttggactattcatggatttggtagctgtttaaaaaaaaaaaaaaaaaaaa

SEQ ID NO: 469708 - DNA, 1131 bp, Homo sapiens
ctcacagccctctggttcagatgatcaatttttcctgattgttctctcacaagaatgcaaggtcttctaagtggctttgttgtctttctgcaagtgaagtactcttggctcagaaggaatcttagcttcttccgtctaaaaggattggagctgaagaatacatgctacagatgctcagaatctttctatgagactgctggtgacatgaacagagcaggaggacatggggccttggatgaccttgaattcctggctgtcttctgtggactcccatgcagattccagtttccagcatacccatggctttctgttaccagtgtggaagatgacaggaatgagataaagctagcacagtgggaattcagccagacatttgatctgaccatctgggcaaacttcacagattccatcttagcagaccaggcctgggatctgacagagtcaatgactgctacctttgcggaatgaatgaataaaatcattaatggctgaatgtggctggcttttccacgtcttcccacagctggggtacttaatattggctgaggcaactacttttaaactgttggtatttctctttaataaaatcttgggaaaaccttgattttcatgtcattttactttgggactttttccaaaatccaggctttatttttcatcaaacacatgtcatgatcatgctcttagggagtctttacaaaccatcatcatgctcttgagggaatcttttgaaaaccttactttagatcagagttagagaagaaattcacattctaatagatttgcagggtaattgatattctcgccatctctgttcatatttgaaatatttcagtactcgatgtaggggcaaaaacattgagtttacaccttctaataactttccaaaaacctgttataaagtaaaactgttgattcagaggtttggggatctctggggatacagctcagccttggggcccagggcctaccgtagctgggctacaccttcctctccagcttcttgtccagctgcttctcccttctgttttagactctagcaacatcctaggattgttatggtcctgttgatgcaatgctgcttcttgccatcttgctgctgtaaatgctgctttctctgctcaatcatct

SEQ ID NO: 469709 - DNA, 534 bp, Homo sapiens
aaactgcaatgtacagccaacattcatgtgggcgaggagcctacactttgagagctttgacagggagcatggttgcaactgtgaggaaatataggggagccacaagaacttaccaactgaccactacacctaagtgtcacctacaggataacattcgaaagcttcaacaccaaaaatatcttactgacatacacccctgcgaaaccaaagatgagaagtcagctacaaataaaggccctgcacgaagccatggccttattctacataagaagattatccccaagacacgtagtcatcagattttccaaggtcgaaatgaaagaatgttaaaggcagctagagaggaagggaaggtcacctataaagggaaccccatcactctaacagcaaatctctcagcagaaaccctacataccagaagagattggggacctatattcgacattcttaaagaaaaaaaatctttaaccaagaatttcatatccagccaaactaagtttgctaagtgaaggagaaataagatccttttcatat

SEQ ID NO: 469710 - DNA, 1838 bp, Homo sapiens
ggggtggagctaagatggccgaataggaatagctccagtctacagctcccagtgtgagcgacgcagaagacgggtgatttctgcatttccaactgaggtaccaggttcatctcactggggagtgtcagacagggggtgcaggacagtgggtgcagtgcaccgagcgcgagctgaagcagggtgaggcatcgcctcacctgggaagcacaagtggtcagggaattccctttcctagtcaaagaaaggggtgacagacgacacctggaaaatcgggtcactcccaccctaataccgcacttttccaacagtcttagcaaacggcacaccagaagagtatatcccacacctggctcggagggtcctaggcccacggagcctcgctcattgctagaacagcagtctgagatctaactgcaagtcggcagtgaggctgggggaggggcgcctgccattgccgaggcttgagtaggtaaacaaagcagccaggaagctcgaactgggtggagcccaatgcagctcaaggaggcctgcctgcctccgcagactccacctctgggggcagggcatagccaaacaaaaggcagcagaaacctctgcagacttaaacgtccctgtctgacagcttggaagacagtagtggttctcccagcacacagctggagatctgagaatggacagactgcctcctcaaatgggtccctgaccccaaagagcctaactgggaggcacccccaagtaggggcagactgacacctcacagtaccctcagagggtactcctctgagacaaaacttccagaggaacaatcaggcagcaacatttgctgttcaccaacatctactgttctgcagcctccgctgctgatacccaggcaaacagggtctggagtggaattccagcaaactccaacagacctgcagctgagggtcctgactgttagaaggaaaactaacaaccagaaaggacatacacaccaaaaacccatctgtaaatcaccatcatcaaagaccaaaggtagataaaaccacaaagatggggaaaaaaacagagcagaaaaactggaaactctaaaaatcagagtgcctctcctcttccaaaggaacacagctcttcaccagcaatggaacaaagctggacagagaatgactttgacaagttgagaaaagaaggcttcagacgatcaaactactccaagctaaaggaggaagttcaaacccatggcaaagaagttaaaaaccttaaaaacaaattagacaaatggctaactagaattaccagtgcagagaagtccttaaaggacctgatggagctgaaaaccatggcacgagaactacgtgacgaatgcacaagcctcagcagccaattcagtcaactggaagaaagggtatcagggatggaagatcaaacgaatgaaacgaaaatggaaccaagtggaaaacactctgcaggatattatccaggagaacttccccaatctagcaaggcaggccaatattcagattcaggaaatacagagaatgccacaaagatactcctcgagaagagcaactccaagacacataattgtcagattcaccaaagttgaaatgaaggaaaaaatgttaagggcagccagagaaaaaggtcgggttacccaaaaagggaagcccatcagactaacagcggatctctcagcagaaactctacaagcaagtgggggccaatattcaacattcttaaagaaaagaattttcaacccagaatttcatatccagccaaactgagcttcataagtgaaggagaaataaaatactttacagacaagcaaatgctgagagattttgtcaccaccaggcgtg

SEQ ID NO: 469711 - DNA, 778 bp, Homo sapiens
ggaggcctcagaaaacttacaatcatggtggtaggagaagcaaacatgtccttctttacctggcagcagcaagaagaagggccaaacaaaaggggaaaagccccttataaaaccatcatatctcatgagaactcactcactatcatgagaacagcattcagagacttgttgaatggctttgaccaaaatgctgataatgatatggacaataaaatccaggctgaggtggtcccagatggagatgaggaatttgttgggaactggagcaaaggtgactattgttatgttttagcaaagagactggatgcattttgcccctgccctgaagatttggggaacattgaacttgagagagatgatttggggtatctggtggaagaaatttctaaacagcaaagcattcaagaggtgacttggctgctgttaaaggcattcaattttataagggtagctgagcataaaagtttggaaaagttgcagcctgacaatgtgattgaaaagaaaatcccattttctgagaagaaattcaagctggctgcagaaatttgcatgagtaatgaggagacaaatgttcatcaccaagacaatggggaaaatggcagcaagttcccccaggccctgggcagtgccaggggtaacatccaggatccagggactgaaatcaaaaatcttagaaatcaacctcatgttctattgtattgcagctaagttgccattcaaaccatgagacacagtctttctcactcttcccttccctttctgcaagcaaatgagcctt

SEQ ID NO: 469712 - DNA, 467 bp, Homo sapiens
tgatcaaaattgaacaaataagatgttgattcttatggattggcaaagaaagtgctttcttgagatgaagtctacttctggtgaagatgctgtgaacattgttgaaatgacagcaaaggacctaaaatattatataaacttagttgataaagccgcaccagggtttgagaggactgattccgattttgaaataagttctactttcaaaatgggttgtaaagcagcagagacaactcgcaacatcaaaaacacatctggcccaggacctgttaacaaaggtgaaaccattacatctgagaagtatgttcagcaaatggatgagatgcaccaaaaactgtcctgcagccggcattggtccacagaaagggcccaattcttccccacaacaatgctcaactacatggctttccaagaagacgattgagttgagatccttgaaaattttcctctaaaaggattgcactgaa

SEQ ID NO: 469713 - DNA, 554 bp, Homo sapiens
cttctgcctcttttcagcttccaccagctccatagagtgcacaggatgtggccaaaattcacagtcagtccctggatccaagggcggatccacgttttagccaacattgttcctggtaggcggagcccattggatgggcaagcagccacagtactgctgccccatgtgggacctgccactcttactggcagtgcagatcttccaaagaaaggcattctgagtgaacggagaaatgatgcagaccttgggctaaagacggaagaaggtgggaatgatccatggagttgccgagctcaaggactcgatcccggcccccagtggttcctgaggaaggatcaaaccttcaaggacatcaaagaacataaaagcagaaagcccaatccaaggacagcaataagaaagattaaaggaacatccgtccacacgtatgagagagaacaggtgcaagaactctgacaactctaaaaggaactgtgtcttcctatttctaaacaaccacactagctacccagaatggttcagactgaaattgttgagataacagacatagaatt

SEQ ID NO: 469714 - DNA, 1442 bp, Homo sapiens
gccgcaggccacagaggtttccgatcattctctccacccctgcctctctctctctctctctctctctctctctctctctcacactttctctctctctttctcctctgctctcccgtcatctctctctcattctctttctcacactgtctctctctcatctctattttccaaccataaacaaagaaaatcctgccatttgcagtaacatggatgaatccacagggcattatggacattattttccttgcacattctgattggcacgtaggcgacaccaataggtttcacagcattccagcatttaatatcagcagggagtgggaagcaaataagtgtgtcttacgttatgaggaagcactcaagcaccagctcaaggagttgagtgaaaatgttttgcagacgtgtaagattctggagactctacaacaactttccactagtagctgctgcacttcaggccacaagccactttgtgatagacaggtatcagggatgcttaacaaacccagatcaacagatggagttgaatacattgagaaaactcattctcaaagttggcagaagggcacaagttgcagaatttgccctcaaggattcccacctcaccgtatggggttagaaaaaatcaaaactatttcaaaagaagtataatactctagaaatgctttgaaattctagaaaatgcctgaatttttttctggtcaagatagacgatatgaatatatattagtcaagaaaacctagaagatatactgaggtttgcccaattggttagctgaaaatattttctttagtatattgacatatttttctaaaggcccatagaagaagtaaatacattaaatatcactgtaactatattaagtagtaaccaccttcattttcatgttttgttccactttctgaatttgagaggtcttcttacataaaacaaagattaatcaacatgtatgctatactataatcatttaaattcaattttccctatcggttttaatttttaaaacctggtttgaaagttgatttactttgaaaatatatacacacatatgcatatagtttatatattatgaaatctaggatatctcatcacagatatgatttgatgtcaacttagataataaagcataatactaatcaaatatcttattattgtgccttgctgactaaaaccaatctaccaatctattcagctattctaagtacatttttggaaaatgtacctttttggtacattttatttgaatggcttttttatctctttgttttgtattatactggagggaaaaatttcagtgtcagctgcattattcttattatgaactttcaacagattttttacatttgaaaattttcaataataaaataacaattatcattatatttctgttctccaaaatagtttttattttattctaatgctttttaaaagactctgctat

SEQ ID NO: 469715 - DNA, 1225 bp, Homo sapiens
ccagcacgtgtagcaagctcctgggggaggaggttctggaggaatgcctagctgctgcggttcaggcatttggaagttcttgtgtgctggagatgcggctggggtttgtctcacagtggaggcaaggaattgcaactttttttctgttattgtacaccttgaaggggtgcctataaactccacgaccattttgtcctttgctcactacattggccagccagctgattatagtattctgaattcagttccattcttagttgactgtttccgagcaaaggaacacttaaccgaagactctgcatctgcgtcccttgagctgatgctgctaaacccagtaccactttgtcctacttacaaatatattttgcagaccctgcattccaatgcagcagatgacaccactggctcaaccagttctgcaatcccacctgggaacagaagtcagcaagaagaactcacttcgatcccttatgatttcatcttcaacccgaccaatcagcactccccactttccgaacccatatctgccaaattatccttaaaaactctgatccctgaggccagaattctccccctgtcctttgttactgagaacaccaaggagaacattgtaccctcgcagcaacaaagcaatggtcatgcaggttgctacctgctctggtactggaaccttaatttacctgcaggctctccatatagtaccccagttgtcattccccactgtcaacgtggtgtaattataatggacatagcatttgacagaaccttcacattggttcttcagcctttaggtactgtagtctggaacatgttcttggatgaaatatctagagccatgatttttcatccaatccgggacatggattccaagaatggagtaaattcctttgacagtaagtattatgtcatcccaacagaggcctacattcatctgatcttgaagacttggctttgtaaaaagtgattgtttttgaaatactgaccattatttattagttactttatacatactccaagtttaagagcttattgtttgtaaatttgagcaaaacagaagttctatagcagcaaatgaattgttaacttaatcaaatcttaaatatagtaattctaatttataatctttatttagagtcatttatgttaaagaatagcaatttagtgtataatcatgattctaatacttacatgtactgaacacatgtgaaagattttattaaactta

SEQ ID NO: 469716 - DNA, 616 bp, Homo sapiens
tgactaatgatttctttacacagtatgttgctggctcttgatcacatcactgggctgtttggagttccaggccacaaggctcccttaggcaaatgctgtggatggcaaacaggctacatccttcctggaccagtcttactgagggaagaatacccagctcctgagctggcccacgaacccatgcctcacccttcccagtgctcagagagtgggggctccccactacctgagctccaggcacagatctcagctccatattccagagctgagggattggtaccagtccttacaccctgggggatggggaccggtcccacgattttgtcctctggctcctcagggtcaaacaccagctgtgccggggagctgaagtgctcccaggccactggcaaaacagaaagttttgggaaactttgttggaaaagtagttttcctagttgggaaagtagaggatgtgctgtgcgtatgcccttgggggagcagccagacaggggcatttggagggaccggttgacaaagggcacataggttggatgcaccctggttccacaggaaaaacagccctgctgtcaagaggactggcagtcaagagggactggaaccactcaaagccttc

SEQ ID NO: 469717 - DNA, 610 bp, Homo sapiens
gtccaaatcatgggaagagaaagcctcatggttcttagtactgggtacagcaagctcagttgtgggaaatattcagcagagtggaataaaaagccccagctttctggccagaagaccataaaggggaaccccagggaagcagaaagtatcagagatatcatgagagctcagagatatcatgagagctcctacttgggaaagaaaccccataaagctcctgggttcaccctcaagttaccttcaaatacaagattaatagaagtgatgaaagcagacatccttgtcttattccagatcttaaggaaaaacatgcagtctttcaccactaagtatgatgtaagctggcagtgggctcccctgtggcccagggtgggtctagaaatactatccaggaaccaaggcctggaacaggggactctagaagcctacctggtattctaccccactgtggccgagctggtacccaagctgtagaacaaagtaccctttactcttccctctcttttcctcgagcaggaggatgcagctaggagtgtgctgcatcacacctgaagtcagcatggctctgagtgtcacccgtgacctgtgacaatgtctcactcttttgctt

SEQ ID NO: 469718 - DNA, 691 bp, Homo sapiens
ttggaaagaagttgattccaacccacatgggtgactttgagaggctgaagacttcagtggagggagtcactgcaagtgtggtgaaaataaaccttagcccttccaactacagatctaccatagaacaacaaatgagacttactttacatgattgttgtgaatgtcaaaaaaagaattgtaaacatgctttgaaaacagtaactcattttgtccactgtcatgaagaggtcatgcttcttggaaacagaaaagcatttccaaccaacaggattgttgtgaggaaggctgtatctggggacggtgaaggcttccgtgatttgttccccattctttccacaggtgtctcttcctgtagcaacgtacttgtaaccactgaggcaaggccccaggggaattgccacagggggatttgccccaggggaattgctacagctggtcagtggtaaaaatagcatctaacctgtgtaaagaactgtggtttgaataccggcctttttagagaaagttgaaagcttgtgctagcccatatctgtattctgttataagcaacagaaaatggattaagacaaatagaactaacatttattttatagacaatatatactttataaaggattttattttgtctcacaaatgcttatgcctgagattataataatagcacttattaagcatttaccacctaactaac

SEQ ID NO: 469719 - DNA, 610 bp, Homo sapiens
tccagcgaggcgcccattgccgctcccgatagggctaaaggaaaaaaacattcagtgtttcgtcattaagatattagctgttagatttacaagctcctcattccactatgccaaaagtcccatgtccaacacaactggctattttcggccctttgcatcaccatatgaattttaggattagcttgtcaatttctacagagaagctttggacctccggagagcctctaaatccttgcaccataaattatactctagtaaacatctttataaataattatgtctcctatgaattcagacctaaggaactacacatatatgaaggccaagaggaaactggctgtgcagggcagactgttacccagccagtggcaggcaggagtgtggactgccttgcacagatagagcccaagaacgggagggaaggggagaccacgtatgggagacgtggggaaataacaggtaggcattgtccacttatctctggacagttctatcccttcctgaaaatttagtccatttatccttgtattatagcttctgtaactctctggtgccattaaaaatatgacctttgtaatgtatccgctttttaaactttttctcaatggac

SEQ ID NO: 469720 - DNA, 622 bp, Homo sapiens
ttaggcttttcgaggaggggctgagagctcgagtcagtctagctttgcctaaggccttaggaatgcgagctatttatggtcccatggcccccacccccttttgtgccctgcaagttctgaagattaggatgcagacatcctggggatgccattattttgtctgccagtgtcctgggccaaaccagacctcatcgccaccaccagctgcaacggagcttgcatctggatgcttggacccaggggatttcaagggatgccttgatttgggatggcaagctaggacacacagacagcacagaacaaggagcagacaggatattcacttcctggttgcgtcatctagtcggcatcagctgttccctggcaagaccaaagccaagggcaggcggtggagggggtttgctgctgtactccacttgtgtgactcccgggctttcctttgggatctcatgcggctgctcttcaccttggcgttcaccatgataccggagccagcgtcccttgaaatgatgttcagcttcatgaatggctgactcagtgtccccttggatcactttaagtaaaattgtattttctttgttgttatcaaaactccagttttgttcaggtatctgcccccctg

SEQ ID NO: 469721 - DNA, 816 bp, Homo sapiens
aaccaggaactggtcttcctatatagagaactagaaagtgtggcccttttcccttggtgttctacctccgcgttcagcaccttctccccacctgcctgacactgaaggatctgcaagcatgaataaacaaccaaccccatgaaggaggaaaggaaaaccccagagagcatgagggtcctccagtggtcacttggatcagtctgtggggcagaccacagcagccagagtcggttcctacagcccattaaattggttcttgttccacctcattgtgcagcggaagtttcaaatcagtttaattaccgtgttgacatccagggacaacgcaacatcaagagctggccaaagcctggtcagtcctgtgcatggacaagcagggcagcaggctgggaagagaaagcagcctggagtggggcggatgagctggctggaggggatggggcaggctgtatcccacagttcactgccagggtgacaacagacactcagaggatctctaaggaggctcaaatgtgcttgaaggacacagggcttcctgaagctcccaggatgcaggtttaaatgacagttatccaaatctctaaggaatggttggctctgaagggctggggaaaagggaatctatagaaaactggactgtatgcgctgcatcccagatatgtgttacaaaaatgctgcagtgagcatccttatgcttacatctttgcctgtatatatgagtgtcatataacatctctgaattttagtacatttatttgaaatgcttgaaactagaagtgttttggatttccattttcttctggattttggaatagt

SEQ ID NO: 469722 - DNA, 917 bp, Homo sapiens
ggaagcggatttggaactggataatgggcagaggctggaagagtgtggagggctcagaagaagacaagaaaatgagggaaaaattggaacttcctagaaatttgttgaatggttgtgaccaatatgctgatagtcatatggacagtgaagttcaggctgaggaggtctcagatggagatgaggaacttattgggaactggagcaaaggtcacctttgttatgcattagtaaagaggttgcctgcattatgcctctgccctatggatctgtggaactttgaactggagaatgatgatttatggatctggctgaataatttttctaagcagcaaattgttcaacaagtggtctggctgcttctaacaacctatgctcatgtgcacgagcaaagaaataacttgaagctggaatttatatttaaaagggaagcagagcataaaagtttggaaaattttcagcctggccatgtggtagaaaagaaaagcccatttccaaaggaacagttcaagccagatgcaaaaattcgcattactaaaaggaaagcaagagcgaatagccaaggcaatggggaaagggcctccaaggcatttcacagaccttcatggcagccccttccatcacaggcccgaaggcctaggaggacagaacggtttggtgtgccaggcccagggccctgccaccatgagcggcctgaagacactgttccctgcatcctggctgctttagctccagccttagctcaaagcagcccaggtggacctggccatggaggccgatctgcctgtctgggccctcatgttcctgttcagtacacatacaggtggtgatagggaggtggaaaccctggcaaggcagataaaagagctccggttttagagtgagtcagacctgaattcagagctggctccgtcacttac

SEQ ID NO: 469723 - DNA, 849 bp, Homo sapiens
gtttatctctacctccagttcagatgccatgctggctgtggctcttttcttcatcaccatcagactgacatccttgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgtgttccagaggccactggcttcaaggttgtcccctgccctaagcagtataacgaggtgattccagaagccctgcttatggaaggtaggactggggccaacttcctggtccccctcacccctttcttcgtcccttccctccagtggagagttggtgctggaatgaagatgatagtctccctggtgagactgaacacgctaggatgcagtggagaagggtaccaagcaccacgggacacctgtagatggagggacatcctgagggccatggctagtgtggagtggcccgataacgtagcaccgattcccacctagttctatactttacccaacctgaaaagaaaagactcatccctccaatcctctgacaaatggttatcgagggatgactctggtcccagttgcagtgtgactggcaaattccagttctgtgtgggaccagacaggtcaatgaggtactgaaacatttgaaacaccaccagatggcgctgatgagaccaaagaacagattttgtgtgcgtgagaaaggaaaagatggagagagagagggaaaatatgaaagtgggatcatagtagtgagttttatgatgtgaaatttcccaatggcagtgatatttgtagtc

SEQ ID NO: 469724 - DNA, 975 bp, Homo sapiens
agattgtgcttctgatgcatgtcaagcccagtgggggcacaccgttagccccagaaagcgcccttgccccttccaccatgtgaggatgaccatctatgaactaggaaacaggccctcaccagagactgaatctgctggcatttttgatctaggacttctcagcctccagactggtactgcaaatagggtggagatgaagacaagttctcgccctctggctacactggcacgtgggaacagccttctcttggaggactgttgccagacagaggtatgtgggcacctaggcattgccattgacctcaagatgagagtggagtgggtcattatcgctgctcccaccctggagctgagccccctcctaagcccttgttgcggcgcctgtgaggcgggcccagctgcaaatggcagccgcgaggggatccgaggggaccaagggttctgctcccctccctcactgaggctttccccatgtgccatcgtggtactggagctcggtgcctgcacacaattttctgcctctcgtggatggctctgccctgctccagcaggtgacagtcatgatggtgactttggcgcggtgaatgcccaggaagcttgttagatttcttttcttcatgtgatgcgtcagctctgatacatcttataggatgggaaaactgccttgaattgactctggacaagacaattataaaacaattataaaggctaaatttaacattcataggcaaaaatgaaccttagcctaagtcttgtacattatctaaaaacaaattcaaaatggagcatagacataaatctatacaacattttttaaaataggggaaaatgtttgtgatctaaggctaggcaagagttcttagactagacaccaaaagcaagatctattttttaaaaagtttgtaaactgggctttattaagtttgaaaatgttttcttttctacgaaacactttgtgaagaaaatggaaataca

SEQ ID NO: 469725 - DNA, 507 bp, Homo sapiens
gttttccggcactggctggaaagccagctgcagtagagaaatattgcccctggtttctggactgaggaactatgaatgtagaggtctgggaaaagataggcggcacactgaaaaaggcatataaggatggtgctgaggatattcctgtaactgtctggtcagtgtgggctctggtttgctccaccttggaatctttccacacagatgatgatgaggaggaatcagaggaagaagaagagtgtaatgaagtaacagaagaggtgacagagcaggtttgcttgccagctaaagcggcaaaggagggagaagtttgtccctacccctctgcaccccccattattttgaagaagagtggcctgaccctccagatctttcttttctggaggacgggggcaaaaagtagctgccctggtgaccgttcaagcagcgcctcgagtgacctctctcagttctattcaggcaggaatccagcaagctagacaagagggtggtatggatgcttggcag

SEQ ID NO: 469726 - DNA, 752 bp, Homo sapiens
ggatgctcttgtccactagctgcactgcaattgctctctcaaatatcgccaatgatttctgagtatcccacggatgtctccttttcgagttcatggctcccccggctcccccgcgtccgccagggctgtccctgaagctgaagctgctccgtggaagcttcctcccctcggtgttcacgcgcggcccgctggctgccccctgcatctccacctgtgtgtgcccgacttccagccagagcctccctctcactatgtgccctctgtctcggggtgcccacccaccgccagcccttcagcagcctccgaagataactctcaacctagcgcctggggcttctgccttgcgtgtcaaggagacgcgatgtcttggatgccccaggaatctcaaaccccaagcagctgccaagagggtggcagccgctcccaagatggcggccagccttttattctctgacttggggttcttggcctcacggattccaaggaatgaaaccttgggccatgcggaacaatggcgaacctttagcccgaacaggagtggcaatgggcgcctcgctggatcggaaatgcagcagacaccctgccggatccggaggggtggaagtcaatggagagtctgggatgccggcgaacagcagtggtggacggccctcagcagatgggatgatacctgcctgtactacctcatcgtcttctcataacaaagtgcctctccttcctcaagccccctctccccttgaagttcccataac

SEQ ID NO: 469727 - DNA, 698 bp, Homo sapiens
gagcccctggctgtcagcccccagttttctctgagagaaagggctctgagggctgcagggtgggctgccactccagtggtcagccgtcaggatgaactggaatctcattccaacgtggagggtgggttttacaggagcagcccactccggttgagcgaggtagctcaggcaaaacctgctggactccccctatgcgctgggcaggggcggaggaggcccctgctacccactgtcatggacactccttggcagaaatttcaaacaagcgtcgaggagaggtggggcttcctgggtgtcggtcttatacaactgctgctcccgtgcagcagccaatggctttcagctacatcagctgcaaaagaggtgccgagggagacagctgtgagtgtgtagcagtgatgggcattcacctagtggatatttcccggctccagctgtgctgtgtttgggccacggagtgtgatgggagacaaggaggttgcgtgtccctggacagttaccgctgttacactgatgaaaagaacgtgatggcaagccttgtgtgggaagctcccctggacatgggctctgcagcagtggcagggtgaacacttatgaaagtcttcatgccttcgaggtaacaggtccaaacaggtgcattttcagtagagatgcgaggaaagcaggaggagggcaaagctgagtcccggccccttacc

SEQ ID NO: 469728 - DNA, 728 bp, Homo sapiens
tcctacctcggccgatccttgaccaaagcacagccatgttccttacagctcttaagcgagggttttgtttgggatgttgtgttttccttcttaattttggatgcttttatgaaaaccagtgcaaaaaggctgaaaatttcaaaaaccagaacacctcttctcctccaaaggatcacaactcctcaccagcaagggaacaaaactggatggagaatgagtttgacaaattgacagaagtaggcttcataaggtgggtaataatgaactcctctgagctaaaggagcatgttctaacccaatgtgaggaagctaagaaccttgaaaaaaggttagaggaattgctaactggaataaccagttcaaagaagaagataaatgacctgatggaactgaaaaccacagcacgagaacttcatgaagcatacagaagtattaatagccgaatcgatcaagtggaagaaaggatatcagagattgaagatcaacttaatgaaataaagtgtgaagatgagattagagaaaaaagaatgaaaaggaaagaacaaagcctccaagaaatacgggactatgtgtactccaatcagttgtaaattcaatctctttatatagtcccatagttcttggaggctttgttcattcctttcaattctttattctctaatcttgtctgcctgccttgtttcagcaaaataggcttcaagctctgatatactttcttccacttgatc

SEQ ID NO: 469729 - DNA, 866 bp, Homo sapiens
aggttatgtttgcactttgggaggcggcgagcatcttgatggatcaggcatggggcttgctccctggtgctccaggacctcagctgcagcccaaggattccttcgggaaggtgcaggaagctggaagagccctgccagcccagagaggccattgtgggagggtctttaggagagtttctcttgattttgaaggctgtcagccccctgattcccactctgcactctatttctgtgtctttgtcttaattcctctagcgctgctggaggtctgggaaaagataggcggcacactgaaaaaggcatataaggatggtgctgaggatattcctgtaactgtctggtcagtgtgggctctggtttgctccaccttggaatctttccacacagatgatgatgaggaggaatcagaggaagaagaagagtgtaatgaagtaacagaagaggtgacagagcaggtttgcttgccagctaaagcggcaaaggagggagaagtttgtccctacccctctgcaccccccattattttgaagaagagtggcctgaccctccagatctttcttttctggaggacgggggcaaaaagtagctgccctggtgaccgttcaagcagcgcctcgagtgacctctctcagttctattcaggcaggaatccagcaagctagacaagagggtggtatggatgcttggcagttccctgttagaatacatccacctgatcaacaggggaatattatagctatgtttgagacttttcctcttaaattacttaaagaatttaaacaagttattaatcaatatggaccaggttctccttttgtaatgggactgttaaaggatgttgctgtctccagtcagatgttgccagc

SEQ ID NO: 469730 - DNA, 825 bp, Homo sapiens
agaaactaaaaactttctttcaatctgaagagagtttgcacttgaagatgaacatgtttctttttttccctttctcatctcaggacaacattttcattcacattgttcctttgtattgccaactagaagcaaataaccagagacacagtaatcgtcaagtaatttcagaaggccgcattcctcaaatagccccagagagagggcagggggcagctgaccttgcccccgcaaaccacacagaaggctctgagctcagctacagtggctgcggccagcccttggtgggcgtggtctgcagcaggaggaccgcattcgagattcctacgcaacactctgtgagattatctttccaacctgctgacagctcctctgcaagttttgtgttgatgatattaaaagaaggtgtcaatggaaggtttctaggacaggttcatgtgcattcatataaggacaaccacaaaaagtctgcattttgaccaatagtgttttgacactatcaattttaagaagcattttgtcttagttcatttgtatcgctaggaaggaatacttgagtctgggtaatttataaagaaaagaaatttatttagctcacagttctatggactgtaaaagaagcatggcaccaatactttcttctgactggggtctcaagctggttctactcatgacagaaagaaaaggggagcttgtgtgtgcagagatcacatggtgagagaggatgcaagagagggggcaaatgttgggctcttttcagcaaccagctctcctcgaaattagcagagctttcttcacctgtgcacaacacattctgaataagttact

SEQ ID NO: 469731 - DNA, 546 bp, Homo sapiens
gggaggccagagaaactgttagcctgtggttgtaacatccaaggggcttggggtgggggcaggaaatgcaaacgggtgccagattgacaaggggtggatttgtggacttaattttaggtgtcaacttgactggattaaggaatacctcaaaagctggtaaagcattatttggggtgtgtctgatggatcatgctgaaatggaggagtccatgttacatctaagaagatgggagtatgggagaaagacgtgggctcaagataaaggcacgactttaaacccaaatcctttagctaaagaagcgcttctacagcccccagggaggggggggaatgccttggaaagaggccgagctgctcgagggagcgggcattgtcatattaaatgggaattcttatttattcatcagatactgatggattcatttaaccactatgctcaagactgctgactaggcactgagaaacatatgcagatggacccgctgtcctcgtagagggatcagaggttgtcagaaatgattgtggtgcaggtggggggtggcaagc

SEQ ID NO: 469732 - DNA, 2567 bp, Homo sapiens
aaggaggcccagctgtgatcccgaggctttgtaggcgccgcagccctggccctctagaggccgacggaggagtgcgggggaagttagcttgcgcctgtctcgtcagccgtgcacgagaaaaaaaaggaccttcgagaagaacaagggagggcaagagttaccgagtacagggacatctatgtggccgctctgctttcccgccgtcacctgctgttgaactccggccgcatcgcggtgtccggagccgcctggcctggagtatgcgctgagcgtcacctaggcaaccacccctgcacctgtggatcagggtctcgctctgttgccaagggtagaatgcagtgtcgggatcatagctcactacagacttgacatcctggactcaagagatcctcctgtgtcagcctcccgagtagctgggaccactggcgcgcgacaaataatttgaaagtgggaggaggggaacagaaccacatcaaatggcagatatcatagaatgagaactgaatatacgcgttttgtgggaaacgcgttcttttcccctttctctaagattcgcttttaattcactagccactaaccactgggcaactgggaagctggatttggggaagggtattaggcaagaataagacaaaccggacttgtcttcattttaatggtgaatgtagagtacttctacgtgctcacattcattacgcccgtcgatcctcacaatgactctgcggtatagtagagacttaataccattttgcatgtgaggaaacagaaacttgttcggggtttccgaggaaaacacctccacctgaagccggagagagaaagaactgggtctccaaaccttgctcagcaaatccagccacgtggcagagggacagggaagagcctggcgtcaggttaccaggcagcgcccctctgctcggcccactggcaagcgctcccagcggcaggtataaaagctcaggctggcagtccttgaacactggtgctgaaccccgccgcgcgcgctttgaatttcccagccgctaagcgcctctcctggtcggtgtcccaggcagaaaggtgcagagacccatctgacgcaggactccaggtagacaagctccagcagagagtggccagatgtggtgcctggagcgactccgcttgggtcctgagtgccttcggcggagcggagactggcttctcccgggtcgggcccgcggagccaagtctcgcaccaccgccgcgtgcgcaaatgtgctcactccggaccgcatccctgagttctgcatcccgccacggctcatgccccgcctggccttggctgcgctccggaattcttgggtcgaagaagcagggatggacgagggcgccggccgcacagactgggacccgcgctcgcaggccgcgctgtcactgccgcacctgccccgtgtgcgcaccgcctacggcttctgcgcgctgctcgagagcccgcacacgcgccgcaaggagtcgctcctgctcgggggcccgcccgcgccccggccccgggcccacacctacggcggcggcggcggcccggacgccctcctggggaccctgcgcgtcccgcgagctccgggcccggcgacccccgcggcccccggctgtccccgcccgccccaggacgcgctcgcccggcggccccgcggctgccgcctcctgcgcgtccccgacgggctgctgagtcgcgcgctgcgggctgggaggagtcgccgcctgacccgcgtccgctccgtctccagcgggaacgaggacaaggagcgccgcgcgggctcccagtccccggcccgggccccctccacgagcccgccgtcgtcccgggtcccgtttcccgagcgcctggaggccgagggcaccgtggctctgggccgcgccggcgacgccctgcgcctggccgccgagtactgtccgggaaccgggcggctccgcctccggctgctccgcgccgagagcccggccggaggcgcccccgggccccgagccgtcagctgtcgcctcagcctcgtcctgcggccgccgggcaccgcgcttcggcaatgcagcactgtggtggggcgcagccgcaaggcctcctttgaccaggacttctgcttcgacggcctctcggaggacgaagtgcgccgcctggccgttcgagtcaaggcccgggacgagggccgcggccgggagcggggccgcctgctgggccagggtgagctgtccctgggcgccctcctgctgctctgagggcccagccctccccggggcgctctgcccgggggactccggacactgacagccgcgtggtacaaaataaacgtgtatttgttgttcttatcagtcccgtttcagtacaacactggcagagatgattctagattaactatcccagtgccaagttaagtgccaggagagagaactgagaggaaaatttcactcagatgcatcaaactcagtcttaaattactgagaggagaataaactaatttcatgcaaatacatttttagacttatgctttttacattgaattttcattatgaatgtgattaatgtataattcacaatcatgaattaagctgccacc

SEQ ID NO: 469733 - DNA, 2462 bp, Homo sapiens
tctggaggcacttttgattgccacaattgtgtgtatgtgtgtcggggaggccttggtgattctgtctgctacaggatgataggcaggctccatgacattgaccgcttgaccttggtcagcagcctgtgcgactatttgcatggcttggtggaagaactgatgcaggttatgaggcaccaaagcttccaggcaccccttgctgccacctgctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcgcctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgctttcagaaatccacccagcaggctgggtcctcagaggcccagctgcagcagaaaggttggatcaggatgtggtggggagaacaagcacacagcatccctttgcctgtaaaggcctctctggagacactgctgaggctcgggtggctgaacagggggaagagattcctggccaccaggccctaagcatgcccacaagatattccgctagcccaacatgaagcctgtttcaggaggggtctttgcaaagagcctggggaattgtttctcctctttttctgggctctgagacctttcaaagcagagaaaccaagtctgagtagtttcatgttttccttgctccaggcatggttcctatttcctctgtgttcctgttgcctatttgtttatttcagtgtttctctttcatgtgagggcctatttcaaatatctggtgatccttggccatctgttcatgttttacagtgagccccagaaaagccaattggacacctgggggtggagggagatgtcaggcgtgttgactgatgggaccctcaactatcaatatctttaggtcatttctcttgagctcctcagtgtccctagaaaggaaccctccaacctcctgccacagggagttcagtccggcagtcagcctttaggagcgcagcagggaagagagcagcaggagagttccacccccaccttcatctgtgcctgtgtcccttgtccacagcctgtgacaccaacctctctgaaagacttggacaattcacctggctgctattcaaggtgggggcagagattgggggtctaattccctattttataaactttcaaacagtcctgttttgatcatacctgcaccttcaccttcggagggtcccagtgtctctgattcctgagctttttgaggttacaaaggatttcatcatccagcattgtgacgctccctttgcaggcacttaacattgcccaggaagcagaaaccaaagcagttatcactcctccacctgcttttccatcttccagtgtgtgacatcctttgtctcctattcctcttttctttgtgggtttatacctgtacccctttgactctcatgtcagctgggtttgagaaagaagctgagcaaagtgcacgtctccataccagcatgtttactcagcctccttccttatgtcttctcagcactttactgtgtacccatgtgagagtacttactgccttgtacttagcggtttttttggctctttctgtggtagactaggaggacaggaatcaaatcgaatcacccctagtgtctcacacagcacctcgtatacaataggcagttcctaaattgtgctgaataactggatgagcaagttggcctcagtctcccatctcccatctctaagaggagggctttggagccctggtgtccagctgtctgaacttcttctgggaagttgggtggtccctggagccacagcaggtgtgccattcccaggaaagtttggcatttctggagcaccgccatgcatgtcttcccacctttcttttagggagcagtgtgtgcccagccctgcccaccagggacatttggccagaactgcagccaggattgtccttgccaccatggagggcagtgtgaccacgtgactggacagtgccactgtacagctggatacatgggggacaggtaaggatagtgttaactgttatctttgctgtccattttactcatattcataggagacttgcagagaacagctcatagccctctctctgccagccttccagttcctttctcagaaagcactctgagctctcctgccagggagggttggcacctgatccctcctcaccctcggcctgcagagacaccctcttctctagcctagtggcccaagccctgaatttaaa

SEQ ID NO: 469734 - DNA, 5385 bp, Homo sapiens
caggcagcccacatagagactttccccttgggcatgaaccacgacgatgaccactcatcttgcgctggcaggtcccacatcatgtcaggagagtgggtgaaaggccggaacccaagtgacctctcttggtcctcctgcagccgagatgaccttgaaaacttcctcaagtcaaaagtcagcacctgcttgctagtcacggaccccagaagccagcacacagtacgcctcccgcacaagctgccgggcatgcactacagtgccaacgagcagtgccagatcctgtttggcatgaatgccaccttctgcagaaacatggagcagacagggaaggccctggccacaggggaaggccaggagcctgtggtccacctggccctggcagtgacggggctaggggagcagaacctgcaccatcctgtggagaaggagggcagaagtaggggaaccagccaggggacggagcaggtgaccaggggaacagatgtgaactactgattaaaactggtggaaaaggttgtttatggaaactgcgaggaagttaaactttaaaatggaggacaaagaactgaacatactgacatactgattatttgaactctatccaacacactcacgctcttttggggaagaaaatgcagaagaccagatgcttccctgtgaaccctttgagaaccaaggatttggggcatgctgccctaggcctgggacatgtatcagtcaaatccaggtgaagacagtgccacacttcagggctccaggccctgctgtatcaacagtctgcgccttccctgcttttgtaggactgtgttgtggttgatgttgggtatggcaggagagcgtacatatgctgttatccctcaattcttccctgctaggcagccttcctggtgcaggcgtgtgccgcctcctttcttccttctgggcctcatcctgccctatgctcccctgcacttactctattccagctgtactggttttccttttcttctcggaccccaccagggacacagttgcttcatgctggctgtttcctcctccctgccactcttctcccagttatccacatgactaattccgtcaccttttttgagttctgtttttttttttttaatataagcttctcaatgaggcctaccctgactaccctctttaagatgacaatctggtaccctcccctgcccacctgtgcagcatccacatctcctaattcacaagaaacatgaagaaatctagaaaaatactcaatataatgaaattgtttgaaagtagtgaaaaagagaaaatcttcaaggagccagaggaaaaacagataagttatatacagataaagaaaaacagtactaatggtccagttttctcattagcagtcacaccagtggtgtcgtgacatcttaaggtgcctgcagttattgcagagggaactttgatgcaaaattctcagcagtattcttcaaaccaatgttggccttctttaatatgaaaaatactactacttgctagatgctgtaaaacgaaagaaaaatattcatagtcaggagttttaggggtgaagcaattaaaagtctaaaaatttggaggactctgttctcttaaccccattcatatgtaggaattgagaacaccattcatgttcccaagccctaggctcccccaaagaccgttgctaagaactggtgcctccagaagcacagaatgaccaggtgctgggtggaattttaaatgtggaccttctttctgactggtcctctctgtatgttcttctgccactcgcaattcatagctgttttaagaccaatcaatttaaacatcatttccctactcaaaggtgtgggtaaataaccttggaagagcatttctgcaattgctttaggagcagtctaggcttcaaatattaaccaggttgctggtttctcaaacatttgcataccggagaactgagaaaaattaaaatacagtccatattaattcttaggactctggaggctcccacactatcaccactgaatgtctgtctgcagaatgctagtattgtaaggctcaaagctgtctatggaaatatgaactagaaaaaaaattggcatcaacaactggcatttgttgcaaaagttattggcaaatacagctgtctcctcttttagccaatggtaatgtgatgtttttaattcaataaagcatttcaagaaagtccaaacataaagttataaacattggatggtaaatatttgttagaaaggggaaataaactttatgcaattagcccaatcagtcttttttatgattacaagtttctcctgtctgtcagcaaagtcactgcaaaagaaagttgctatttaacaacactttcaagctacttaagctcagatattcttccaggtgaagcagagggtgagaaagcccaatgcaggcgctgtcagctgcaaggaagagtgtgtattgctgctagagaaggagcaagaaggggtgcagttagggtcctgtcctgactgtgagatccctgcctcacaaagtcccaccgctttctcacatgagagaggtgttcatctgccccatcaccaccaccctggtcctggaggctttcagttgaaaggtgctgtttaatgaccaccacccctttccctactgcttcccaggaatgcattccaccatcgtggctccaaagcccaggcatggctgccacacagtagtgcttggaagggatgtacactcttcttgttagttgccacgagcatatatgtgcctgtatgtcatagcattcacaaggacccgaggtgtgcatgttatgccgctgtttaagaatgttattgagcacaaagctgtcagccaatcatttcaggaagacaggatctagactggttataggcattggaaggtcttagacaattgtttctacgtaatactccctcctttctcttttctcgttaattgccttttggtacagtgtggagatgctttctagatcacacagtgcctgagaaggactctctagtcaggctgcccagggccccattctgcctctgttcttgaacaggttgcctagtctcactatgtctcagtcttctcatctgcaaaatgggaatataaactctacttatccatcattgtgaagacatgagagttagtagtaactgaattaaagcacttagcatgtagcacacactcaataaatgttaggtagtgtccattctgtgcctccttgtcgcctggagccagagggacaggaggaaacactgtttagctgagatcacatgggcctgtcccttcccatatctttccctgtgctgtcctcaccatccctcccggtactctgggagcctggaacccccagggattgctttcccgtgtccagtacctctacctgggcaaaatcccagtctccaggcttttctcctttctcacgtcctgcagatttacatgggcatctgatggctagagagatgcttggggtgacaaaattctaccttgggacaacaaagtttgttcctctgatgccagttatttttaaacctggtggattgctagagtcctccagagactgttagaagtttctgtgtcttactccagattttctgtcttaaaagtcttcaggaagatgggttttaggtatctgtctttccgtacagcttccctggagattcttccatccagcttagttaggaaactgctcatctaaatgaggtctgtccctttaatgctggtggacctggccagaatgggtggctggcggggtcccggagcctggccttgcccctctcagggctgtacggtagtgcgtggacttgcatgccaggctgaaagctgtcctgcctgtctcagtctccgcttcctgcccagcatctgcagcctctcagagccgttggactttggcagcagatggtcctaattttccagaagtgtttgaaagtttacagtagactgccttttcagagagctctccacaccatgccagttgtgagttgtctttcttgtccctgctgccagctgaagtcctgggccccaccctcacccggcagcccccaaccccagccaggtgacggtctctgtagccctcaggaacatggaaggagtggccctcccaggactcaggaagccttccaggagtggggctggcatgctggcccggggaagacttcacactgcagtagtatgtgtggaaaatttggatgagtcactttttcatccagctcttagcgttgattttctctctcttttggcttgtgttatcagcagcacatttttgagagactttatataagcatctcattcagtatcattttgagttagagccgccctccaaaccctcagcagatgcccagagaggatgaggcaagagaacagcaacatgaccttcacagtccttgacagggacaccaccagttgaagaaaagtggcgaaggctcgtgtacgtgagcaatggtgccatctgagcagctcaaaccttcccgcgttttcacagcgctccagggatgcatgcttgctgctggctcatcatgcagccgctcgaggaactatgcagcaaaacatgctggggatgactcttgacaaaccgtaagcgtagccagtgaggtgacaaatgctagaaccagagagctgtttcattttccttgccatgtgcacggactgtgactttccaccgcaactcaagcactgccgccgggggcgggagtgggagaggaggtcttagtacccccacccctgatttggcctgggcagccgccctttgtgtgtttccaccctgttctagtgcatcacgtgtcgctgaagcccagggacgtgctgcccagcagtgtttccagggagaactctgcaggcggagggaacggcatgtcgctgagcacagagcgccccatctcactgcagatgagaggatggacactcacaccgagaatgcatgattgcaggggaagcgggaagaggaaattggggactgatggagaggtagtgtaaccagtgggaaggagcctgtgttctgggttagaacaggtccacccatttcctcatctgtaaaatgggaacaggaagtgtctgtctcacaaggttgatgtgggtaggaaagagacaaccctgataaagcacttctatgatgtctggacttggtgactgcttagcttgccaggcactggtttacagatgaaagtattcatcccattcatacattccacacgtctttactggatatatatatatatatatatgtatgtatgtgtgtgtgtctgtgtgtgtgtgtgtgtcttggagttagtcaggactagtgtagagttgtcccgtcatttttaaaaaattgtgttattttttaactttttgttgtaagacaattgtaactcttaaaacttacaaaaaatactatatgcctttcagccaacttcctgttatgttaacatcttacac

SEQ ID NO: 469735 - DNA, 3882 bp, Homo sapiens
gacaccctttgcaaaccacacggtgaccaccctgcaccagctacaggagctccttgaccttcatcctgctcagtgtgaagcagcaggtccctggccacaccctggagggtgatgtcttcctgctccaacttgggccttttagccatgattgggtttgtcatcctggaatcactgcgtcttcacaagatctttaagtacatctgttctcaattttcagactgtgaggccaggatttgggtgcaagtagtttatctgggaagtgatcccaggaagcactgtgagggggtgagggagagagcagtcaagaaaggtgcaatcctgactgtgacctgtgagtgtgggtgttctccacaattatggttccttcccttgtcctgcagcatctaatgtgtgctggactgtggtgcctggtagaaggagacacatcctgcaagaccaagctggaccctcccctggatggcaccgagtgtggggcagacaagaaagaaccaaggttccctcacgtggagctggctgtgccatcgccaagcagcaaacacaactctcaggttcacaacctcaaccggggcatgccgcctcccagcgagaaacgcactcactggtgccgcgcgggggagtgcgtgagcaagacgcccatcccggagcatgtggacggagactggagcccgtggggcgcctggagcatgtgcagccgaacatgtgggacgggagcccgcttcaggcagaggaaatgtgacaaccccccagctcacagagccaggggccgccagggcagggaccagaactgccaggtttgtactgagcgtcctgtgtctctggatggtgaagctggtccgaactgctgttgtgactttatcttctggtctgtcttcatttaatacagcaaacctgaaaataaaaagtggcatctttctcttccagcctctcttgattctacctgtccatccactctcaaagaaaggggcagatgttctgccatatgatcctgttggtctcagcaaacctttgctgcttctctgctctgggcttgtgtctatcaaggccctgaggactccacttcagcaggagacggtccttgttctgcaggcgcttgggaaattttggggtagagctcacctttctctccacgctttcggtttctcaccaaagcctctctaccttactcttttgcttatttttaaacaaacttatgaaggtagaatatacaaagaagcacagctccgtgcacagtattgctcatcacggtcgagcatgtgtgttggggcgcacgtgcaggtatatgtcagtacagtaggagggcagttgctggcccctggggcgcgcatgtgtgaccacataacagctgccagctttgcagaatggccgtgccatctccattgccgtggctggggtggctttctacttgccccatgtcctcactgacaccggtgttgtcagtaattctctctggttttggccgttcggatgcgtgtgtagcagtatctggctggggaattggtactttcctcatcaacagtgaggccgaacttctgtttccttatttgccatttggatatccttttcttgtgaagtagccatgcaagccgtttggttttgtatctaagcttctattttattcacccaagcggttatgtcacctgttggagcgttgatttcctcacccaaagggtgcagtcaggagcaccttctgattctgcatgtggatttaatgaagtaatggttagaagggccagcaaaatgggagccctctgggcgtgtcggctgttttatgatcactgtttatgtgaaagtgcctcttgccttgaagtttcttcccggtcctcagggatcagtcctcatttcaggatgagattgcaacttgttggctttcccctggaggcctcatgggacctcggagccttggagcccagtagggctgcgccttcctgccctcacaggagagggtgagggaaagactggacccaccttcagctcctgggaagggataactctatcacgaatctcttatattaactgttctttattttagccctgtcaagctgtctttctgtcgttttagtctccctagatgtgttttgtttttctccttactgcgtagctcagagcaacttccagagttacatctagtatcctttcatttgaacttgaaggactccctttagcatttattgtaatgcaggtctagtggtaacaaactttctccattttttgtttatctgggaatgtgttaattttcaccttgatttttgagggacagttacatggatatagagttcttgcttgacggttctgttcttaggcactttaagtatataagcacacttctttttggccttcaaggtttctgtttaattacaatgtgtcttagtatgggtccttgtatcctacttggaatttctcgagcttcttggatttatagagtcacatctttctttacatttgactcagcaatttcaattgtcctatattcaagtttgctaattctttcttctgcctgctaaaatcttctctgaactggtggatttttcatttcagttcttatacttttcaattccaaaatttatctttgttttcttaacttccatatctttattgatattctcattatgtttatagattgtcttcctgtctttatctgtgccttcatttggttcctgagcatttttaagacagtcgttttaaagtatttgtctagcaaggccaacatctgggtttcctcagggacaggctccgccaatacattttgttcttttgaatgaaccatactttctgtttctttgtatgccttgtgatgttttcattaaaaactagacattcaaatcttagaatgcagtaactctagaaatagattgtaccccttccccagggtgtttggttttgttttgttttatgatttagtggtatctctggatcaggaattaacctgaagtgaaagctgaaggtcttatcaggtcttttttgaacctgtatcttttcctagccattgctggtggctttctaagttctcctagatgaagttgcttttaaatgtctttgtgcctaaatgtctggctcctaaaagaaaaaaggagggaaatcccctggaagccacttcacctggtggaggttacagcaatgtcagccatcttctgcatctgcaccttaacaactgaaagtagcaatcaacagtcagaacacagaaaccagatatttggaagataaggttcttactgctcaccctgactccagaaagttgcaacaggagcacagacatagctgcctgccttgtgggtgaaggatgggcagtaactgttaccacactaaaggctgaaattgagcaaaattaactgaaattgacctggctttcccctggaagctgcaagccttcaagtagactgcagagtttcaaaatagtttcttcaggtagtttttgccagtgtgattattgtctggatggagaactggattcctggtgcttcctcctcagctctcttcccgacatcattccctctgttggtcattttaagatcagctctgataatatagttcacaggtgaaggtaattgttgtgtgcgggttaggcagatgtaaaactggagaaatcagctactggaaaggcgaggaaactgaagcgtaaaaggaagctcgataaccactcaggaagttaatcacatgatgttcaccaatcagagtctatactcaagtgtgtaggaaaggtagctttctttattcttctacgaacccacctaatttgtatttctttactcccttccagtccgtgttttgttcctcatgacttcatgtctgccctgctttcccttagtctgcatggtgatgtttctcctactgatccatgtggcttttgggggccagcccttctgtgctccttccatgccgtgttcc

SEQ ID NO: 469736 - DNA, 651 bp, Homo sapiens
ctctcgccctgtgcaaagtaaccacatagatggcattaggagctcagtcctgcactgtcttcccctgtggctgtgggtctttttccgcttcctggagcgcgtacctgagctcatgcacctttactgacctgtgcggacctctcttcctcagggtttccctctgcccacatgtacctgtgccctgcatggcccacgcacaccttcccgtgtcaacgtcctccaacctttccctcctcagataagccatgtgaactctactgctcgcccctcgggaaggagtccccactgctggtggccgacagggtcctggacggtacaccctgcgggccctacgagactgatctctgcgtgcacggcaagtgccaggtgacgtacttctccttcggtccttggtggggctttggagaggagactcactctccccagacagggaaacgagcacctcctgaggtggcgcagcagctgggatggggagtgggtgtcgaagctttgtattttctgtgcctcgcttatgccacaggtaccatactccctggtgactcgggtcaagctgggcatgttgtgagagagccccagcatcttagtcagcttgggcacctgtaacgatacaccatagaccaggcagcttatgaacaactgacctttattact

SEQ ID NO: 469737 - DNA, 1029 bp, Homo sapiens
ggaatgccttatccaccatcatggtattccacacagcactgcctctgaccaaggcactcactttacagctaaagaggtgtggcagtgggcttatgctcatggaattcactggtcttaccatgttctccatcatcctgaagaggctgcaaagaacggtggaatggccttttgaagtcacaattacaatgccaactagttccagagggagaaatgctgccaccaggagacacaatgattccattaaactggaagattggtacccacctggacactttgggctcctcccacctttaagtcaacaggccaagaagggagttacagtgttgactggggtgactgacctggactatcaagatgaaatcagtctactactccacaaaggaggtaaggaagagtatgcatggaatacaggagatccattagggcgtctcttagtatcaccatgccctgtgactaaggtcaatgggaaactacaacagcccaatccaggcaggactacaaatgacccagaccattcaggaatgaaggtttgggtcactccaccaagaaaaaacccacgtcttgctgaggtgcttgctgaaggcaaagggaatacagaacgggtagtagaaaaagatgcttcctgccctggaacatcagaccccaagttcttcagttttgggactgggactggctctccttgctcctcagcttgcggacagcctattgtgggatgttgtgattacagctgctgtgttatggtgctggccacaaatatttccaagtctttctctggaaatatggaagtaacacatttcaccggccacttaaacgtgtgtgaccatgtgacttgaagagtaaaatgttatcttttgaagacctgaaaacaaccacatgttcaatcatccagaaagaaagtttctcagtcagaaagtttagcagtgtccttcagccttgacagcaaatgccttggcattgttaccacagacctagccttggatgtttacaaataaatgtcctgcaggatgtttggagagacttcacaaatgt

SEQ ID NO: 469738 - DNA, 959 bp, Homo sapiens
ccgcaggactctttgttcatctggacccacagcggctgggaagggtgcagtgtgcagtgcggcggagcagtcactttaaatgaccaagtgaccatcagcagcacccaaacatgctttcatgggcatgcaagcccagcctttccacgtgggtgcagccacagtctctcagctccctgtggtttggtttccaggggagcgcagaaccatcgtctcgtgtacacggattgtcaacaagaccacaactctggtgaacgacagtgactgccctcaagcaagccgcccagagccccaggtccgaaggtgcaacttgcacccctgccagtcacgaatgaaattccaccctaatgctgaaggcctggaggaagagctcactgcaggaaatctgcttgagcacctcgtgctgctgttgattagtgtatcattcacagtgttccaggtacaatccaaaattactagtcatatagggaaacagatccatactcaaaagagaaggccattaatggagactgactggaagatgacataacaggggtcagcaaacttcatctgtataggtctagagaataaatatttttgccttcgcaggccacatgtggtctctggcatatttttttctgtattttgagtcataatcctttaaaacatgtaaaatttgttattcgcccttgggttgtccaaaaataaccccgcaggccagacatagcccacacgtaagagtttgctggcctgtgttttggattattgcttactcccgttttgcccactgagatattggcaccacgctctcagcatgagccagagctctgcaggtattagctcagggaatgtattttcttattatacaaaggaggacgtgttagaattctgaatttctttttattgtgtaacttgataaatattcgatttctgcctccccaccacttctctttcccacttccttacactcccttcctgactgt

SEQ ID NO: 469739 - DNA, 649 bp, Homo sapiens
aagttcaaaccatgactttgagacctttaaaactacttatcttgagtttgtgtctagtggagaaccagctggcgggctggggggggcctgacctacgcaacaggaagcggcctgcccaccctctccactgccatgctccccagcacaggtggaaaggaaaagggctacagagtctgcagattctttgttttttaaaagcccaagcagcttattttaagtcaataatgccatggcctcagagcaaagcagacactgcagcacagcgcttccaggagccagccagcgagggggcctgcagccctgcaacccaagcccagtgtgcaacaagcagccagagggctcactctcagaatgggggctcagctgacccgtcccaggacagacagcgggcctgtcaccgatcacgctgttgcggtggcaaagtattccactgcagctggccagcattgcaagacggtcttgtaccacacatggctagcacaggaaaacactaaaattccaaatttaagttcagtttctatcgaatgcatatcactttcacaccattgtaaagtcaaaacatccttaaattgaaccatggtaaattggggaccatctgtattgacaaaaaaaaaaaaaaaaaagggcaaatagccaaatggaaaaaaaa

SEQ ID NO: 469740 - DNA, 586 bp, Homo sapiens
tccaggtttggttcacagtgggtctggtgggcaagacagtaaatcaatagcaatgtcgcaacccagtgagaatagcattatgaatgtcattcttaaagacctaaaggatgctgctgtggttgtccccatcatattcccatgcaattcctcagtctggcatctacgaaattcacagtggatcctctctgaccacagtggactactgcaattgtatccaagaatgagccccacacaaactgctgtgccagttcacggaattttagaaccagtgctcaagggcccgtgcctggggaaccatgctggaggagccacatcggcacctgattcaggggatgcagtcccgagcctgatgctgaaaggagatgagactttagggctggggtgggggagggctcactcttgggatgtttgccaccaaaatcccaccatcccttggagaggccccttgcaggtgtcccggctgatggtcctagcggaagttctgactgacagctgtcatcaccggccacaggtgcaagactatagcccttctgacccttccagtctctacttgacctttgagccaccccagcagaggtgagctgcc

SEQ ID NO: 469741 - DNA, 864 bp, Homo sapiens
ctcctcaagtagtgttcagactgggttaggtcagcgcactctttacaaccaagtcattcgtaagcattgccaagggagaggggaaggggtgttgctttccctgccctgaattccagtggaaaccctagctttccgaccccaaagctagctgctcagtgccactgaggcattcacacatggaggagacaaaagctgcatcgactggacacatcaaatctaaacgaagcctagaaaatatccgtgttccaagtgtttcccttaacacgactacagccgaaaactcattcatcaatgtcctgccacttccctcctgtgggacaagatttggatgcacagggcccggtggcttccctctgttccggtctccaactcacctggcccagagactaggatggtgtcccctcgcccccattattaatcactacgcacctccccacaccctggccctggggaccattgagtctgacacaaataaagctgtagacagacttaaaactcacccccacaaacctgttttcagatcagagcagatatgggccccagaagagcctcgcaaactacctccagccagccaagttcgctatcatccttttaggttcgactttttccaagtctgtaggtgacaatgaatatcttgtagttttttgaatttccatttacttgactatctgtaaagttaacagttttttcctatatgtatttctttagtgaatttttgcatcatttggttatttttctataaagtgcttttttattgagatctgtatgccttttatatattaaggatatcaatgtatcaaagatggcaaacatttttaccccatttgtcataagcctgttaaactttcaataattgtttttgcc

SEQ ID NO: 469742 - DNA, 1189 bp, Homo sapiens
tgaaaggggcagattctggggatgggcaatcttaaatttggatcctggcttggccacttcctagtaagctgtatgactgtggatacattatttaatgtcttgaagcctccttctcgtcctgactccaggcagaatagcaataaagactccttgcctactgtggttcatcagaggcctagccttctacgattcaaggaccaattacttagcatccagactctgtgcaaaagtagcaagaacaagtgttctcagtgtaggcatttggcccttgatgccctgcaaatgaaggaggaggatgtccttgcagcaggaaccaacttaggtggcaccaatcttgacttccagatggaatggtacatctgtaaaaggaaaagtgatggcatccacatcataaatctgaagaggacctgggagaagcttctgctgtcagctcgtgccattgttgccattgaaaaccctgctgatgtcagtgtcatatcctccaggaatactggccagagggccatgctgaagtttgttgctgccacaggagacactccaattgctggctgcttcactcctggaactttcactaaccagatccaggcaaccttctgggagccacgggttcttgtggttactgatcccagggctgaccaccagcctctcatggaggcatcttatgttaacctacctaccattgctctgtgtaacacagattctcctttgcgctatgtggacattgccatcccatgcaacaacaagggagctcactcagtgggtttgatgtggtggatgctggcttgcaaagttctgcacatgtgtggcaccatttcctgtgaacacctgtgggaggtaatgcctgatctctacttctacagagatcctgaagagactgaaaaagaaaagcaggctgctgttgaaaaggctgtgaccaaggaggaatttcagggtgaatggactgctctagctcctgagttcactgctactcagcctaaggttgcaggctggtctgaaggagtgcaggcaccctctgtgcctattcagaggttccctacggaagactggagtgctcagcctgccacggaagactggtctgcagctcccactgctcaggccactgaatgggtaggagcaaccactgaatggtcttaagctgttcttgcacgggctcttaagcaacatggaaataaggttgatggaaaataaa

SEQ ID NO: 469743 - DNA, 1240 bp, Homo sapiens
tgaccttactgttttaggctggatgtctccgtgcagctgctgctgccaccctaatattttagaggccctcaaaatcacaaactatgatcaactcactctctacagctctcataatttccaaaatctattttcttcctcacacctgacacatatactttctgctccccggctccttcagctattctcactctttgttgagtctcccacaattaccattgttcctggcccggacttcaatccggcctcccacagtattccggataccacacctgactctcatgactgcatctctctgatccacctgacattcaccccatttccccacatttccttcttccctgtgtctcaacctgatcacatttggtttattgatggcagttccaccaggcttaatcgccactcaccagcaaaggcaggctatgctatagtatcttccacatctatcattgaggctaccgctctgcccccctccactacttctcagcaagccgaactagttgccttaactcaagccctcactcttgcaaaaggactaagcgtcaatatctatactgattctaaatatgcctttcatattctgcaccaccatgcggtcatatgggctgaaagaggttttctcactacacaagcgtcctccatcattaatgcctctttaataaaaactctacccaaggccgctttacttccaaaggaagctggggtcattcactgcaaggggcatcaaaaggcatcagatcccgttgctttaggcaatgcttatgctgataaggtggctagacaagcagctagctctcaaacttctgtccctcacggccagtttttctccttcataattcaggcctgtcctcagaatgctacgaggtacagcccatttgagctcctgcatagatgctcgtttttattaggccccagtctcattccagacaccagaccaacttagactgtgccccaaaaaaacttgtcatccctactatcttctgtctagtcatactcctattcaccgttctcaactactcatacatgctctgctcttgtttacactgccggtttacactgtttctccaagccatcacagctgatatctcctcatgctatccccacactgccactcttaactcttgaagtaaataaataatctttgctggcaggactatgctgaatctccttaggcattctctaatcagatgtcctgagtcatcccaattcttagaccttttatacctgtttttctccttctctt

SEQ ID NO: 469744 - DNA, 1038 bp, Homo sapiens
tggtattctttttgtggttccatatacattttaggattgttttatctatgtctataaagaatgtcattgcatgcactgagctgctctggagctcaggactgccagggccgtcctggtactggggtcaatggctgccaatctagtgctggagcaggcctacaagatgggtctgcatgtgctagcctgaaatctggggttgtgaaggcccagcctggcactggggcagactgggtccctagtctgcaaggactggctggaggctgggtccatgaatgctggcctgaggctgaggaggacctggaaactaggtctacaaaggccggtctggagtctggggttacagggccagcctggagcctgaggctgctggtgccagccagccaggtgttgaggcagtctggagcctcaggtcactggggccatcctggcagtgggacaggcctggagcctgagaatggtctgaagcctgaggctgcaagtgctaaactgggctgcagggaccggaccaacactggagggagcatgaagcccagggctatagaggccagcccagccctgggaacaatctggagcatggagccactggggacagcccagccctgggggtctgcctgttgctggatgagtctgaggactgagtccttggggccatcctggagcctgactatggtgtctggcctggcattggaaccagtccagagcctggggctgctgcaggtaactgaaaccacagaaagcaaagccacagataaggggggcctcctgctgaattcctagctttgtgtgattagattgttacctctaatccctttcgatggctattgttctgggtgccagcaatttgctcatacacatacactgattcctttctcagcaaaatattgaggaagatcttgatgtggtttgactgtgtccccacccaatttcatcttgaattgtagctcccatagtccccaagtgttgtgtgagggacccagtgggaggtaactgaatcatgagggcaggtttttcccattctgttcttgtgatagtgaataa

SEQ ID NO: 469745 - DNA, 1139 bp, Homo sapiens
tattgagaatctaatgcctgatgatctgtcactgtctcccatcacccccagatgggactgtctagttgcatgaaaacaagctcagggctcccagtgattctacattatgggatacctggagctgcaggaaatccaggggaaaggggagaaaagggagaccatggtgaactgggcctgcagggaaatgagggcccaccagggcagaagggagaaaagggtgacaaaggagatgtgtccaacgacgtgctcctggcaggtgccaaaggtgaccaaggcccacccggtccacctgggcccccaggccctccaggtcctccagggccccctggaagcagaagagccaaaggccctcggcagccaagcatgttcaacggccagtgcccaggtgagacttgtgccataccaaatgatgataccttggttggaaaagctgatgagaaagccagtgaacaccattccccacaagcagaatccatgatcacttccattggaaacccagtgcaagtactgaaagtgacagagacatttgggacttggataagagagtctgctaacaagagtgatgaccggatttgggtgacagagcatttttcaggcatcatggttaaggaattcaaggatcagccctcacttctgaatggcagttacacgttcatccaccttccatactatttccatggctgtgggcacgttgtttacaacaactctctctactaccacaaagggggttctaataccctagtgaggtaagtcgcaccacagcaccttctcacgcctctcaggcagcacctgtgctgtggtgcttttgtgagcaattaggggtagggactgtgttttcatcatctttgtgtccctagggctgacacactgaggtcaatcagggtttgtcgactgaatgaatcacaggatatgttagtgagccccatggcccagcccctgcctggggtctgcatttgttgctggtctggacagcccgaggaaggtcagagccagggagaagtagacctggagtggtgacggccgcagcttccccatcctctgagagagaagcagcccgaactcatagctccccctggtggaacgtgctgctgctccctgataaagttttgttttggaaaactttgggtgtggggaatttc

SEQ ID NO: 469746 - DNA, 525 bp, Homo sapiens
ctcagaagacggcaacaggtcgcagctgctgcagcagggggatattatgcagcatggctgccctggcagcagtcagggagtattgagccccacactcagacagacacttaactgtgtgacactcaggagccatggagtggatggtgaggacagccagagagcatggggaaagttaccagaaggcccggctgccatcaggaggactttccaggggagtagcccactcagcatgacacggatgcaggagccagaggaaaaactctgcgagccttggagcagacctggcacgtgcaggtttattgaccacaaagtcatgagaaagagattttacataagtcgaggctatccgaggagaaaggaggttaagaccacagcaaagccatctctgtttcataccgagtgtcctcaccaggctgggccttcccgacttagctgggaggaggtgcaggagctgggcagcgaggtatgcacacagctggatgtgccaacgtcggggccgaaactcagaggctaaggaagcttctg

SEQ ID NO: 469747 - DNA, 556 bp, Homo sapiens
ctggtcaaccagagatggagctaatctcagctccaccctctaaggcctctaaggccagtcctcagggccatagaacgtccttagtgctgaactcggaaaggcaggagttcagccattgcatgcttttagaggcttacactgagagtggccctcagtgcctgaatccaaagagggatgaccaatggcaagaagttaagaaccccagaaagcaggaaggaagcactgtttggatgtcagctgaggtggacctaaaagttgtcaagtgcaaaccagagacccaaatgttgattatgaagttgacgtttgtgatgatacttgtcaacagcagatccttcaaacagggcttcccatcctgcctgtacaccccagaggatctgcagattcctgggtcatgtcccacactggctgagtcagaaccttctggaggtggggttcaggaacctgcatttgtacctcccctggtgatcctgatgaccagcaagtgtggaaaccactgcccctcaaaaccctgaagggaagggtgatttgctttccttagcctacagatctaagtgtt

SEQ ID NO: 469748 - DNA, 506 bp, Homo sapiens
acaaattcaaattatattattccctcagtctaaactttgttcagaatgtcaaaaacacaggacaggaagataagtaaatcctcatacagcagagtcactgttcaccctgggaagggaggtgggcagaaccagaatgggtcatgggatgagagatctattacgggaacgagaccttgccagttgcaggaggagctagagaagagaaggtatgagagggaagtgtgcagagcggaggagtcaccaactagctggtctgagaaatcaagctcgtcgcactgccaacgctggtccatgaaagcagaggagacatctacagcaagctatttcttcagccaagcacctgaagatggtcggagttattgttggccaggaggatgccccacagtgaagaagaccaaatggacatggagtacaaggacacgcaggaggctgtggcacctccaagtgtgtctgtcactgcacctaactgcgttgaccttcagagggtaatggctgctgcctgctga

SEQ ID NO: 469749 - DNA, 517 bp, Homo sapiens
tcctgctgattggtgcattttacagaacgctgattgcgctcctgcgcactgcctgatgttccctccctgggctggatgccgacgctgggagactcggaagccgcgtgtggaagatggcagtgtgggcactgttgggcactgccagagagaaatctcaaagtcagatgttacactgtctgggatgcagctgcgcccagcaatcctggtgtgtccccaatccaactttctctgccaccttctggagtggctatttcaagtctccggttttctgaagtccttaagtctctctttccacttcaaagagaacattgcagtcatcggttgggaacttgctccaagtgaggagcaactgtgcccaccctcccatcctctcccacacctggggagttcatggctagccctgccctttgggcactggctcccagccagagacctctgcaggggcagtgccccatctcatgccctctctttcctgcaccttcctctctgctagtgcccttcttctgcatgtagagtc

SEQ ID NO: 469750 - DNA, 605 bp, Homo sapiens
tccaagatttcataatcagatgatggagacctctctgatgccttgcactttgggttctgttttcccaaagctcttcttaatatttgactttgttttattttattctccaaagcccagacttccaggctggtggggagaatgtcaggcttgcttccccttgttgtcagccttatccagtcacattccaccttcttgtgagttcttgttgctcatgggaaatgccagtgtcctatttttagaagagcagccctcaaactggtaccctttgaaatctacttcaaggactttgaaatgcaggaactcttattctctggttcacagtttgcaatttcagatagccacacatctacagtgctatctcctaggaaagccttcccgaagtctcagttatgctccccttttctgcttctctctcctacctgtacccttagcccttgctctcttctttcttattttgtgtccttctctggactgcaatgaatttggcactccctgccatcttgggaggacagactaatctaaagagctgtaaatttcttctactctccccttagtgtttgaggctcagaaatgtctcacagcagttctttcataaaggcaccctc

SEQ ID NO: 469751 - DNA, 608 bp, Homo sapiens
tggctttggaactggataatggatagagacaagaagagttttgaggtgcatgctagaaaaagcttagattgctgtgaatggaccctaaagggcaattctggtgagagcttagaaggagggaaggagagctgtagagaaagcctccatcttcttacggaatgcttaagtggttgtgatcagaatattgtcagaaatatggactgtaaaggcaattctgatgagatactatctccatgtgttcccttgccagggaactctgcagtggtaggaacactggcttgggctcagggtggctgcatgaccctggtagctgacacgtactcattttctgaccccagggagattgccagtcccctcaaaggatatcctcctaaaaggataatgtattatcaatgggatagaggaagccatgacgcaggccctatcttgccctagaacagccctcatgttattaatgtgaccgcacctccgttactgtcatttggcttaatggtggtgacagccttaaatgggaaacctgaaaaagtacatggaatatcatctctgcctaagccctaagctgtgcaactccccgtgggtggtacatttcaggcgagaggaggaggagg

SEQ ID NO: 469752 - DNA, 604 bp, Homo sapiens
gttgctctgcattgcggaggaggggcgggaaggatgctgagcgctgccttgtgaggagagtgtccatgcgggggcggtttggcgtgtcagagctggaacaacatgaagacagctgcccagcacagggtgggaaggtgtccatgcagcaaggggagggtgagaagcacattcacaagggggagcccatccggggcgtggggatcccaagcagggtgaagaggatacccagggtgaggggcaagagctgtcacgggtgtcagagcctgagccaggtgaggaccggcattcacatgggagctggggaggccctgggtgaggtttcagagcctcagcaggggaaaggagggcctccatgtcgaaggccagcccagcattgggtgttggagcccgagcagagtgaggagggtgttcatacaggaggctggttcatatattttgccaaatttgagaactttgcagccattgtgtgacatttaatattttattttcctgctataggtccctgagtctctgttcattaaacctgttgatcgggtttaatcatttttgtccttctagctttaggttcactgagtcttttcttctgtcatctccattttattaa

SEQ ID NO: 469753 - DNA, 472 bp, Homo sapiens
cctgagaatttgcatttctaagaagttcacagatgatgcggatgctggaagtcctcatgctgaaaatccctggactgaagtattgtccttctcacgggccgcatccttcaggagaaggggtgtgcttagaagggaagaagattcagtgtggaattagacacgcgagatttctctctgcagacttgctgaacttgcctggtcacatagcactcagaataaagcctgtgtcctttgcagtcaaatgtgaccatgtgactaattttggctaccaagatgtgagtggatacaatgtttgcagcttccgggttatagccatacagggaaagagtgcgggctacattgtggctttgccctgtgcctgccagtacaaaaagtatcagaagggctgtgctgcagggtggaatccacttcagggggcaggggagatctagcaagaacatctcaaagcaaaaaaaaaattattattgcacat

SEQ ID NO: 469754 - DNA, 740 bp, Homo sapiens
tgccctgcagaagaggtggaggactcgggctggtgagggaagacctggtgtcctaaaagaccttggcatctgccaccatcgtctcgatggtgatggcactggagcatataatcactgcccagcaggactcaccgcatccccactacaatcaagactaccgtgtccctcaaaagcccaaaacatttgtgaaaaccctaaagcttaatgaagattttgagccctgtgaatgctatctcaaagaagaaatgatggtaaatataatattctccaaccttcaagtaaatcctttaacccaatatattgcaagtccagcaggtgcagatgacagtggccctaggcataaagcatcggctgagcaagagactgctgaggacatttcagaatgctgcatgctctctggcaaatgtggaggggatgtagccgtaaacattggaagaggcaagtttcagcaatggatacaaaagcttgtggaaaatttggtgatgaatgtgatatcctgggaaggacctgacattacttatgtaacattccagccagaaatgcataacctgaatctactcctgaggaaacaataggcaagcccttctgctcctcctcattctttctcttcttcctcctccttctccctcttctcctcttcttcctcctccttctccctcttctcctcttcttcaacttcttcctcatcctcttcttcctcccccccttcttattctcctccttctccttctgtttctcct

SEQ ID NO: 469755 - DNA, 1021 bp, Homo sapiens
tcccagaagtcagtctcgctgggctcctggggtcacatgctcacctaccagccacctctacagcccatggcccctgatgctttaaagggccaggattgggtcacaggcttcacctgggagccaggtctggcatcagaacctgagaatcttgtaacctgggtgaacgggtgccacacaggcaaacagaacacgtcatcagagacaaacaaggaagttgctcaattctcggcagagatctggaagggcttcaaggaagaggcaacttttgacttggactttgatagaaccatggaggtagatgaggtggagacattggaaacacaggcaaagagaggggtgggctgcctggtagcagaacagggtgtttatgatgaagcccttcagcctggaccaggcttaccaccaaccccatctctgggaactcagggcccatgggcttcagagaaaaccttttcgtttccaaatttatcctccaaaccctgcatgggcctgccctgggggccaaggatttccacagtcagactcacaactcggggtcgagggtcggtgtctccagaaggctcctcctccaagacaaatagtttgcctggaaaacgctgacaaagagccagagctcactgaagggcagctgattaaaaatcaacctggtgaggctctgccaccgttaatgaggtgtgatcctgaaagtgcaagacctgggtggattctgcaaagagcctgttggctttgatcccccttctcctataaaatgttatgtctgctcttggcccctcaaattcctagacggacgaatcagtctgggctgcctgtggaatttgcaaagaatgaattttcaaaaaaccacacttgggaacaatagttaccagaagtgtctgggtctcagaggaaaaacaaacaccttaaccccagtctgcaagtgtttcccaaacatccttctacctaatgccttcccccatgctgacacctaacatgaagcatgtcatttaatgaggagctagtttaccctgtgcttctgagccac

SEQ ID NO: 469756 - DNA, 669 bp, Homo sapiens
tggtgagctacttgccaaaacgtcatggcaagtcaatgacaaaggtcagcagaagaaaaggtcatcataagacaagaagggggcaggtagaaggcaggatcaggagcataacaaggccacattcatcattcatttattcattcactcattcattcattcatttagtaactattgagcatctggtcagaggcagacagactgcaagggaagaagaaatgactccccgcaggtccctggaaatcttggaatcccttgcggtagctaagccaggattcaatttacagacactcattccacacacatcccaaattgatgcatggtattgcaaagttgaagcagggctgtttgagggcatggatgaatcttattccaaatttatccttcactaccagctctgcaaaaatggagatgggcccattaaatagttttcttttgccagctggcacagtggctcctgcagcttgtggcttctctagagcccagctctgctgtcttgtggctagcctttatctttggttactggactgtctcctatgcctctagaagcctgtgggcattaaatagcttaatacacttcaattataatgcaaacatttgaattttgacacaaaaactgagatgtaaaagtgtgattactgttctgtggtataaaaatgtaaaaggattaac

SEQ ID NO: 469757 - DNA, 779 bp, Homo sapiens
ggtggagtgataacacagctgtgtggatttggttgaattacttagcctctctgggcctgtttcctctcctatcaaatggggataatgacggcagccacctcacaggggaactggcacagaggcacgcaggcatggggaaggggactgcttgacttcagtgtgcaaaatgcaaagatggcatttgtcagctgcctctccacagaggtggaggaaagatggggctgcgggaattcgttagcaccaattaacaccccaaggctcccttctgctctcaccctggtctgcttccctgctggctgtgggcctggaaccacatggcagaggaagcagccaggccccaggggagagggggaaactggggaaccatcagcaaaggctgaggtgctccagcaaagcccaagcagtggccctcctagagcaactgatacatggagtgagggtcatcccgtccactatacaatgaactaactttcagtcagaatctggcaataaaagaaagaaaacaaatgttggaaaagaaatgcagacagagaaaatgttttgttgagctttataaatatatatatatatatttatttttatttgaaaaaatgttattggcatgcacatgaatatatatatttgctccttaaccacagaagaggcctgtggagcagaaatgagtcagagttaggggagggggcaggcaacatacatccacatgaatatatatatatatgcacttgaatatatctatatgcacatgaatatatgcatatatatatgcatgccaataaaaa

SEQ ID NO: 469758 - DNA, 870 bp, Homo sapiens
gcatctatccaaatacttggcttcagaaaaaataatcctcatggggtatacaaatataaaggaggagaaattgctctttaatacaccaaaaaataccgagttcctttatcttccggaattccgttccctagcacagtatttccattttgatgggtttttctgctattcactcctcaagcatgtctttatttcattcacaaagggaaaactcacatggtggagcagcagtgcgttcagctctgtgtggtccagcaattggaaagggatctcttggaaggagcaaggaagctaccgcagtgatcttggtgaagtagccaggtttgctgaaatcaataggaggtttgcagccaaacgactctctggtcttggctgggcgcggtggctcacacctgtaatcccagcactttgggaggccgaggctgagagtccacgatttaaccccgatgtctccaaatctaactctgtgagcttcaactatggcagtattaatcaaaggctccagctctgagttacccttttggctgctgatgactaaacttcggggctatctggaaggagggccttggtagcttttgtaagaacttcagttgccttggctgccactgacatttttattgatgatgctgacactttgtgatcgagaaattgaaaccagcttcctgaccatagctatcgacgtcatccagacaatcccccaatacagtgcaaaaacaatttcaagtagtttcttaaggaactagaatgtatagttgtgttaccaccacgcaagtcaagatgtggaagagttctgttttaccaagaaggttcctgttccccttctcagtcagtccccttccatcacctagcctgtcatgtacaaggggggccaac

SEQ ID NO: 469759 - DNA, 1648 bp, Homo sapiens
ctgcctcctccaagggcacagcgttcctcactcatctgggcgtcccagggtgccaggcacgatggcctgcgatgggggctcactctggtcactcacctttgtatccacagggaaatggggaagctctgcaaacccgggccagggcacagcttggacaatctgtcaccagtgtgcagagtcagctgagaaacacaatcctgcccaggctttctgtggctgcggccaagaggtgggaacaggcctcccacgcttatcacaaagcgcgggctgcctttccaatgcggctggaggagatttacaaaaagaaaaggaagcaaaagctgatttgcctgtccccatgcggggcacagggtgcttggaagtggttgggcctttgcaggggggtgaccgcaaaaagaaagtgagatgtgttgccgccacagcggagggcttgccagagccagcatcagagttggtgggttccctgacgtatggaaaagatccagggaaaagttgtaaaatactgggcaaaggattatatggaatactttaaacacctgagccaggttgtggagggaaataagtgttatgacaagccacacatctgcaatccctgccctttatctgggagggcaggcgtgttgaaaaccttgaagtgaagtcaaggtcaacatgccgtcctgagtcattagccatacacagattagtaggttaatacagaacagtctccacagatgaattacacccagaagccccgtccttggtgttgacaccgaaagtttcagttatcacagggagagcgatgtctgcttaattttgatagggcttaattattatgataaatgcctttggaatttaaccctttcattccacctagtgttatggcctgtatgtctgtgttcctctgaaactcatacgttgaaaccttaacccccagtgggatggtattaggagcttctctgggatccttgggaaggatctttgaggagtaaaattctactgtttcaaaaagatacacatccctgtcgtttggggttgttaggacactttaggtcaaaagttgcagaagcccacttcaaacgagctcatggaatttgctggggggaaattaggcgctcttttggaaccaagatggaattgaaccattggaccacaagagaggtgagaaccaggcctagaagctgccagaaatgcaggaagctacttcctatctgtcccttgcaaaagccacatgtgttcctccctctgcttctctccaccaacccatcttctgtgttgccctatgcatgtcatgtggtgggtggaaggtggtcataacacagcttctgagtttacatctcctccctgtatagaatcgagcactgattggtccagtctgggttaggtgtccaggcttaatccagacatctgggattagggggacagggttgtaatacatagacacagacaccagaagccctcctctgtatgtaggtgggtggaggggatcagcactaagagaatagtcattgtgagcagggtggcactccaaaaggagacttgtcctgctcctgagatcaaaacggtgcacagtgaaggaaacaatcaaaacagtgaagagataatccatggaatgggagaaaaatattttcaaatcatacatctgattaggttaacatccaaaatatac

SEQ ID NO: 469760 - DNA, 780 bp, Homo sapiens
gggtggccaagggacactgccactccactcagcagggaagtcataacctttccacagacacaggtgtcagcgttccttttgcacatcctctagcttagggggaaggagcgggaagctgaggctgaggcttgtgattatgcaaccaggaaagggctgctctaacctgctgaatcagacaccctgggggtgggcccagcagactgtgtttgaacaagacctccaggggaccctgaggcaccagagtctgagaaccctacgatacagagtggagaccacagaaggcaaacttcttactcccagggccgttgcctggagacaatatgtggggctttgggtctggacgaagatcaaagccaaaggacaggtgctcaggcagagtgtgaggaggcttccttcactgggcgaggatagagacatccacgtggacctcccgaaagccctggcagacccccagaggcctgcacgcagctgcagcaaaaacaggtgtgggggccgcaggaagctggcagcctccataggccccgcgctggggagtgcagcacagcgggtggacggaggtgcgaatgggaccaagctccaagtttcctgagaatatggaggcaaaggagagacagggcaaagagagaggaggagactcacactcccagtgctccctgtgtgcgtgtccccgcctggctggtgccttggctatgcaaaccccgcgtgagcaagctggactgcccttcctctgtggaccagacgaaccctcctctgctgggaagagctctcgtccaggccatc

SEQ ID NO: 469761 - DNA, 602 bp, Homo sapiens
gccagcacatgctgactaacggtacaccacatagactagactttcggctaaatgccatctatttcaaaaacaaaccaagtttgcatggaaaaaaaaaatcctgcgaagatgagggtcctgaaggaaaatatactattgcagtgtgagaggggaaaaggggaacaagcaaggaaaactcgaggcattgggcctaggtctcagcattgtcgaggggtcgctgtgtcactctcagatgcgaacaaaatgacttcccctcaacaaatgcgcagcccctcatcgggggatggaatgtccagttctcacaacctcatggtgcaaaggcagaggagttataatcaccgtcacattataaatgaggaaactgacatccaaggccacccaagaggcaagtcttggaacccagacttcagtccagatcttctaactcctaagctatgttctctcaaccactcttcctccctggatcttagaacctttccagagatacaagacttaaatacatgaaaaagacagtacaaagatattagtaattatatgccaaattcatagaggtgttgccagattccagaaaaggatgaaatcatggtaacaaaaaacggtaa

SEQ ID NO: 469762 - DNA, 498 bp, Homo sapiens
cgcctcctctggcacttagggatggaggagatggagtcaaagggtagaaggagtcgaagccccaggaaaagagaccgttgtttccccccagggaatatgttggctcagatctgttccaagcagaagcgggaatacccacagccatgtgaggaagagtccttaggaagggatgtctggtggaggatctgtgaaggagattgggcctctgtgatccttctgaagtctctgttgatggcctctcaggatgaagccatttccattgttggctcttggattaggacagattctgagatggagacatcacagaatggcgccacagatttgacgatgaatatcatgactggccttgacattgaaaagtactacgcagactcacctgacccagatgctctgacaaaagccaacccattcagagcgataacatgatcaggttccctgaggtagaaagcagggaactgcccttttaggaatccccagaagccgtggctgtgggtgtcc

SEQ ID NO: 469763 - DNA, 1952 bp, Homo sapiens
gggttgcagccatgagaatacgaaaactcagagcaaacgtctgcaatgcctctgtgggctcacgaaaagcattgccaaccctcggcagtcacacgtggaagctcatgccaatcagatgttaatccattaaactcattcacagcaaaacataatgtaggtcagagtggggagcaatgtgatgtcgtgtgcaagctcatttaccatccagagcaatatgagtcaggggtgcaaacgtggagcacttcaagccaatattgtacaataccgaaagtgctcaaatatttcttaaatcccaggtactgtgttttcaggtgcaaagatgagacttctgaggtcactggtgagcatgtttgcaatacggaaggagaggagcaccgttcctctctctcctatagaaacagcatgggcccgcaaggacaagggcaggaaaaatcacagcagaccgagtcggggacagggcactccccggagcctgtgctgcgggtggagggcctgggcattgtcagagttctgcatgtgcatcatcacattggctctgcttcctccagtttctgcaaagctaaggatgtcaaggatttggggtatggtcagacaggatcgaaggtcaactaccctgctgtccttctctttaaggaatgcattgctgctgaaaattttgtcccttagtacctctgggatggcaaatgtcctggcaaaagggagtaataaagaggggttgttatattttagacacttttgaatagagtggtaaattgttattcaaatctcatttgatggccagtgtgcacattattcttcccatgctccagttttttcagaaaatatatagtagtaattaaatttagactaaatctaaatacttagtctaagtattcagatgactggtccctggaccagtattgcctcatcttaattatatctataaagatatgatttccaaatgaggtcacattcgcaggtatcaggagttaggacttgaatatgtctttctgggggatgcaactcaacccgttacaacctttttaaaactaaaatttaaaaaaagacaaatggaaaaagaataatttaaaagagaagaactgtgctagttgaaatcaatcaaaatataacaagataacattgcttagataatagaattcactgacagctgaccactttcagctttgcactgcctataccttttgataatcacaacagcctcatgaaaaagaaggttctaacttcactttgtgaagccaactcaaacatgatttaaaacaaacaaacaaacaaacaaacaaacaaaacaatagttttcctcaataaaagttgcggggtcggggagaagaatttgagttgggctatgtaatttcaacttccctaaataagtcctttggaaagtgttggggggagcaagtgtgtgattttggtcttggctcacaacttcggaaccaactttttaaaaaatgtctgccgtggattttcacaacagatttcttccccgtacgacatgttccctagctaagtaataggtctgatgtggctgccaaatttttcaacaacttttactttccaaaggagggttaaatagttcccttaataacttgaaagaaaaaaaaatttcaaggtttaccacagttcttagtcacaggctaaatgttttcaacagttttatgactttgagcctacttagtctcaagaacgtctcccaagaagaatgcagcataaaggattcaaaatgtagtaattctgaaatggagatagtgttgtttgcatcaaagcatacatttatgctatctttatcaggacttctgtgccaaatgttgcttagttctatttgtcacctgctacctataaatcatcctgaaatatcaagggtgctgactcatgaatcgctcgtgttttcgtagtttgtgttcatacatttcattcagttgtgtttcaactgtatgaaacatttgggggccattttt

SEQ ID NO: 469764 - DNA, 633 bp, Homo sapiens
tattgccctgaaagaccttcctgtgcgacagaatgtcaaggtggaaaacagtgatattgatgatcctgaccctgcatagacctagacttatccgcaaatctgaattcacttttagccctcctccagctccatttcttccacctgctttgatcagccctttgacagtttccacctttgagatccaccccaatattttctggagcctcttgagaaacctggcatgtggaccctgtgtgacgatactgggtggagacagagtcagcagcccagttagaagctattccagaagtcatcaaacagtcaaacaacgtgttgagggtagtgtgatgctttttctgaactgtgtggtagagatacgcagaaggagctcaaaggagggacactcaggccaaggaaggccagctgggggggtccttgcatgggagagaggccttgagcacagtccaggcaaatggactctgttggggacactgcttagctgacctttcatgggttgttgtagaaacccaagcaaacagttctaacaaatggcgatcattctccaacaatcagagctcttatctaggaattaacaaatttcctttcagagtttgcagaccagcagagacaatatgtgattcaacactctctatt

SEQ ID NO: 469765 - DNA, 609 bp, Homo sapiens
tggttgatagaggacggtctcaaagtctatccacctgcacatcatgtgcaaagacagccggggttatactttggcttcaaatgattcattgggattcaagtgtctaagcacatcccatacccatctttacagcagcaccagttgcagcgcctcttctgggaaaggcattgctacttctgtgattaggaggaaaggcaactcattgcggtccaggcttcagggaagactcgcagagacatactgcgtctttaggtgtaacggtcgtgaggcagcagggatacttggtcctgtggtctggggaagatgctgggatggaattgatgctgaatcttttggaaggagtcctgtcagtggtgaagctggtggtagtggtggaagtggtagaggacaggaaagaggcagaggaggtcgtggtggagatggaggtagaggtggcagtgatggagacagagatggaggtgaaggaggcggtggtggtgggagtgaaggtggtagtggcggtgatgtggtgaatgtggtaaaggtggtagaggtgaaggtggaggaggaggagaagacactcattctggtttaacattttctaggtacgtgggtttgcaggaattattc

SEQ ID NO: 469766 - DNA, 496 bp, Homo sapiens
ctaacgtctggaacattttctgaaccaaaatataggtagcaaatgagggaagaagagcaccgatctgactcagaagccaacgttctttccatcataccatatcgcctctctagaggacagtctcctcttcactatatcatgaggctgagcaaatcctccaggaaggtgatcatggtgtgtccggacttggtttcttcttgtgggttcgtggtctcactgacttcaggaatgaagccatggaccttcacggtgagtactacagctcttagaggtggtgtggacccaaagagtgagcagcagcaagatttattgtggagagtgaaagaacaaagcttccacagcatggaaattgcaacattttacgtgatctattgcctctgcagacctggcatgaaaggtgcactttatgggatggggtgggcaaacgtgggagagttcctcttcatccgatctgaaccgtcaggacatgtcaaacgaagctaatataaatgtcagc

SEQ ID NO: 469767 - DNA, 448 bp, Homo sapiens
tacgagtgaaaggcacattgataatggggggagccttgatgtgtagcacttcacaatttctgtgtctaaatacacccaacattgcctgtttcaatgtccaccatgacaccctgagtacaggaaagagaggcagacagcttcctatgccaggcaagccagctccagcatatggtatggatggtgagtgtgaaggtctggaaatgactcaaggccatgtcagtggagaccaagcagtttgtaaccgacagaagcaagtctcaggcctctctacagggaaactgatccagatgcagatgcagggaagcaactgtgctgagcccccagtcactgagggtgctggaaaacctttgagagattttaaacaagaaagtgacaggatctggattgtaagctacagacagaaatgtgatcacggtatgaaagaacatagatggacataaagaaataa

SEQ ID NO: 469768 - DNA, 800 bp, Homo sapiens
gttaccctactctcactccccaccctctaaaggacctctgtgagataaggccagaatgactttcctggggctcaagctgagaaccgggagggtcctgatgcttcttctacttttatattttgcttggctgcctaaatccatttcagctctagtgcatgcatgctgtcggggtggggctctggcatggcgaggcccatgcacgcatgtgaaccagtggcaccaaaatggtgaattccatgtgtgcacctgtgtagcagtgggggaaagccacaggcaagtgcacactggcaaagcagtgggaggaggtgtttggcacctctgtgtctaccgaggcctgtctgctgaagctgtccagtggttagatgggatctgctatgatgtctgctgcaggagaaatcctggttttggaatccaagcctgcactgcaagtggatgtggtcaggagggacccagcaagaagccagcaaatgaagggtgctcagatcaaactggccttgtccctgtgggcaagacagcccgtctgtgtccagaagaaatgaataaatccacgtacatgtgcaatttaccaatactaaatgaaaatctacaaatatgtttgaagaaatacaaaaacctgaacagaataaaaaatgaatgagaagattaagttaataataaaaagcatttcatcaaatgaaaatgcaggatttgatggcttcactgttgaactctaccaaagatataaagaagaaggaatactaactctcctctaagtattccataaaactggggaggagaaaaaacttctaaatttatcttac

SEQ ID NO: 469769 - DNA, 3024 bp, Homo sapiens
gagggtcaagatgaagggcagtagatgccatctctggatatcagggataatacctggcagagagcaaatgcttgataaatcacagcttttatattatccataccactgtacagggcctcccagaaaactagagttcctttattttcccaaattctttcctgtgactgagcgagtgagccaagttggagcaatcggttacaatggggggctggcgtgtgccagaggtaaacatggtacgatgtttggagatgaggtgttaaagactgcctcttctgagacaatgttaagaacaagactttgttctgagtctgctcttctggaaggcctcagcttcagtgtccccagtaatcaagccagatgtcttaacatggtcactttttcacggtctctgacagctgacaaaatgtttctttctacttcaaccatgcaacacactatctatgaaaaaagagagactatggatgttccgcagctcccagcgatgttcctgagcatttcattgactggactgccttgtgaccagtggttgccctaggctttatttcctgaactaatcactgtcagggaggatggcattaccataattggattagacaattcatgatgtctactcagcccacgcaaaccatttgtctgtagggaaaaggaggaacaaatgttggagaaccaaccaatgtgtcctctggtgaactgatgaagtcatttttccccagctagagatatatataggtatatatagtagtatatatatataggtatatatatagttatataggtatatatataggtacataggtatatatataaaggtatatatgtagtggcttaaaatggtataattaactactatattctcattatatattatatatagtatatatatagaatacatatactatatatactactatattctatatagagaatactatgtactatactactatattctatatactatatagaatatataataatatatcatacatcatatataattatatataatgtaatgagaatatagtagttacatgttatagttctatatatagtacatataatatattctcattatatatagttgtatatatgatatacaatattgataatataatatattataatatattatattattatataatatacaatatattattatattatatataccattatatatgattatataaatttatataatttcatatgattatatgaattatataatttcatatgattatatgaattatataatttcatatgattatatgaattatataatttcatataattatatgaaacttaatctaacgtaatctatgccaggcaccattctaggtacctgaatgtgttgaagaactgtttctaaggagcttatgctctagtgacatggtatttgatatataaaaatatatatgtatatatttgtatatacaaacctagaacatatataatgagaatatatgactactatatatactataacatatacctactatattctatatactatatatagaatattatatactatatatactactatattctatatatagaatattatatgctatatatactactattttctatatatagaatactatatactatatatactaatatataatatattagcatatattatattattaacaaacactctatatatgatataatgtatatatttatataatataatgtattatatattaaatatatatatgagaatatatattgtatatgtatactatatatagatctataatatatatctaatatattctcattatatattatatataattatatatcctatataatatatagaatatagttgtgtatgtatagtatatagtattctatatatagaatatagtagtatatatagtatataatgttctctatatagaatatagtagtatatatagtatataatgttctctatatagaatatagtagtatatatagtatataatattctatatgtagtatatagaatataatagttgtatgctatagtatatatagtagttatatattctcattatatatgttctagatttatatatataaatatatgcatatgtaatttttatatgaaatatcatgtcactagagcataagctcttcagaaacagttcttcaatacatctcaggtgcctagaatagtgcctgacataaagtacacacaaaataaatacacttattgttgaatgattgttgcatgtcccaggtgctgcatatttgaacagaaagcatagaccatgcagcattctccattctccttctgctgccccctccccttcacacaatgctgcatacagacccagttgttcacaaacaaacttcttgcaggcacctttaaaccccaggcgattcagcttgtaaaaaatcatgtctgcctggctccctagtaaaaagacttcaatcagattagctctatgagatgggggcatagattgatagatggatagagtttgtattcaaaagctattcccaaatagccttttggttgcctttctaaagttcttcagactgctccaaacattgttgttgatagctatcaacagcaaggctccagaaatggacatagaagctctctggggaaaaatgcagataaaagtataaacacattgagaggtgaagccagctggacctcctgggtggagtggggacttggagaacttttctgtcttacaagaggtttgtaaaatgcaccaatcagtgctctgtaaaaacgcaccaattggcgctctgtagctagcaagaggtttgtaaaatgcaccaatcagcgctctgtaaaatggaccaatcagcattctgtaagatggaccaatcagcaggattctaaaggcttatctctactccctcctgaaagcccattagatgccaacagatcggctttggatggctagcaactgcctggacaaagcggagaaagttcctcagtacatgcaaggaggaatgccaaaacattacatgcctgttcatggtacagaaccttggagaggtcctgaa

SEQ ID NO: 469770 - DNA, 811 bp, Homo sapiens
ttgtttaggtgctaaaaggttagaatttctaacccagggcataatgtgtgtggcagaaggatggcatgtttgaagtgtgtcttgtcaaggaatgtagagtctctgaaccaacaggacaagcctcctcctgctctgggcaccttgggtgtttcttgccagtcaggaggagcaatgatgttctcctctacacccacttcccctgctcccatgcaatcagctgtattcctgacttctaatcaccctccaaacctgacctgttggctattagcctcattctataaaggggaaaactggggcttgggggcgttaagagatttgtgtaaggccatgctcctgacgaagagaaagccaggatttgatcccaatctgtatcgtgccagaactcacacccttgtcaatgtatccactttgactggaaaacatgttttgatattgtataacctagaagatgcaagagtgtgcaccttaggatgtgtactgcaaaggctgttttatcctgcacacctgggccagggagagtcattagggaggcagctgcgtcatactgcacgtggattctgtgtagggtgaagccctcccaaagtgggagagactgggcttcttttcttcaagagaaacctggctgaaaggaagtggccagaaggaccaattccacgttttaccctggaaatttcatcaccaatattgacattcagatacctaggtatgattatcccaagaaagtattattagtacctcacagaaatcgaaagtggagttcctaaaatttgccaaattaagtcccaaagtactgaaatagatgctcgatgtt

SEQ ID NO: 469771 - DNA, 666 bp, Homo sapiens
agaatttcaaccacgctgctaatttcagcactgaccctgccaatgcaaatatgcccggcattccagagacacatagtccagtagggagagaaaattctgcacatgcagaacattcctactgctatgtgaccatgcttagaacggtgcactccagctctgtgtcgtttctcagcatctacatagacatcacatacaccatcaggctgctcactggcttagtgactcaatccctccagcctctttgctatgctcgagccacatgtctgctggctgtggatcccatacatgcagagctgcgtcatgttcgcgggcaccctggggacacctgctgcggggttgatgttttgttatgtttctgcagcacaaccagggctggcttcttggggactgtatacagtgcacttgcccagccccacacacagaagggattgaggtttagtgctctgcagtggcaatcttaaaactcttaatgattgtatctttgaattaatgttttgtacatattcagtttaacgtatgtttagaaatatatatctaatacctcaaaccctcaattcttaactatctcctggatgatgctcaatttaaaaaggagttcatgtaaaatgaataaatataagctaaatattaaagcctattatgttgttattaaaataaataaataat

SEQ ID NO: 469772 - DNA, 763 bp, Homo sapiens
cccagcactccccgcaccaccatcagggaccctgtgccattgctggaagatggcttatgcccatatagaatgggacatgatagtctgtgcagcttatgcacacgaacttccaaaatacggtgtaaaggttggcctgacaaatgatgctgcagcatgttgtactggcctgctgctggcatgcaggcttctcagtaggtttggcatggacaagatctataaaggccaagtggaggtaaccagagatgaatacaacgtgggaagcactgatggtcagccaggtgcctttacctgctgtttggatgcaggccttgccagaaccaccactgacaataaagtttttggggctctgagagtgctgtggatggaggtttctctatccctcacagtgcctaacgattccctggttatggttctgaaatcaaggagcttaatgctgaaatgcatcagaagcacatcatgggtcagaatgttgcagattctgcaacgtgcattacctaatggaagatgcttgcaaggcaagaacctttattgtagtttccatgggaaggaatggatgaggcaaggcaagggaatattggcctcgagtgtaagagcctgatagaagaggtgggagaggagtgggctctggattggttggtttgtgtatgaaagggcactcatagtaccatctctgggaattgactagccctaggaatccagtttctccagggtggtttcagtatgtctttatcagcagcgtcaaaatgaactaatacactgtctt

SEQ ID NO: 469773 - DNA, 822 bp, Homo sapiens
acagtgcactgggtaagtaacattcctatgctcctgctgaccttccttcacttgttgcttcttccatcacgtgggagtaaagtggctcttgcaggctgcctgagacttgtccactccatcgcacgctgtctaccatgttttctgcctgaaacgttcctttgtttccagaacttacggtttgggcgtctgttctgtttgctttcttctctacactctctcagtctgccactaactatctccatatgcccgagggcctcagagagcaagagtagaggtgggcataggtctctacttgagagagagagagaaaaaatattcttctcttcaaccaatggtcaccagggtgcaggcaagtggcggaaggatggtgcccaaaatcattttgctcctgtgaaccccccaagaaatctgcccctacttctcttgtgggagagtcagctgtttggatgttggggggaaacaaagaaactttgtattgagacagacataaagctgcagacacagccactttccctgaaattaaaagaattagttgctgtgaaatgcaaacaaaattcagagctggttggaccaaccatggacacttgccaagcttctactatacgtaaggtactctaatatggttccaaattttctgggacaattcttcgagttatataattcttccacatttttactcctctggtatctattgagctgactttttcccatatgcttattgctcttttatatttatttgtttgtgaatttgtatatcattgcttttacttttcctattgcatgaggtctgagttaccgttcgctgaatagttgttaatgctt

SEQ ID NO: 469774 - DNA, 781 bp, Homo sapiens
tggtttggttttgtctgggtgaattttttccaccacttaggttttggctcagccacagcctcagagccacagaatgccagctgttgtgggttttggagaaccacagggaaatcttttctgctgccctcactggaagtgtggtattgatgacaatcctgctccagcctcggactacagtaacagccacagcaaagccattggtgctccaactcctataagaagctcctattataaagagtatgaattttcagtcaccaactcagacataaaagcagtactgctttatttctctataattgagctgaacttcatcttgagctgccgccctcaccccctaacaagtgaagacacagtcctgctcttctcagggatcccaatgcctgcagggctcagcccaggagaggttcaatccatgatcctttctcagaacgcttctggcacacagattttcatcaagttccttccagtcgtcttcctcccaccagaagcccaaacttggcatctgagctggaaaagctgcccttgcagccccacatgttcttctgccttctggttcacagtgtgaaccctctgctctaggtttttagcctttcctggctcagaaagccttttctgtctccaaaagcccagctcttgcaacagagagccttgcccttcaagaccatttcctctgttatgagttaaaacaaaattttcagaaattcaattactaagtttatctgctgccatcctccctgaagcagtgaacagccaggactctgtaggtggagggccccaaggc

SEQ ID NO: 469775 - DNA, 1262 bp, Homo sapiens
ctataccttcgtaaacacttcctaatctcctcagcatttgagggcatcatgagcaagaggatgtgttctgcctttacccttcaagacccagttcatttggtgcctcctccaggaagccttctgcagagccctccttcttttgtcatatgtagtgttccgccagagatcacagggagggtaaccgacccattcaagttgtgtgggcttctgagtggatgtggcccagcaagggacacaaaaggtgagctttccgttgaagaggcgcaggaccctttcctggtcagcatccacataatcgcagacccaggggagtcccagcccctgcaggaggccatcgacaacgtcctggcgtggatccaccccgacctcccgctgttccgggtgtccgagaggcgggcgtcccggcggcggcggaagccccccaagggcgctcagccagcgctggctgtggtgctgttcctgcaggaggagtacggcgaagagcagatcctgcagctgcaccgcacactgcagcagccgccctggcgccaccaccacaccgagcaggtgcacggccggttcctgccctacctgccctgcagccaggacttcttcacgctggcccctgggacgccgctttgggccatccggcccgtgcactacggcaaggaaatcgtgcgcttcaccgtctactgtcgctacgacaactatgctgacagcctcaggttctaccagctgattctccggaggagccccagccagaagaaagcggacttctgcatcttccctattttttccaacctggatgtggacatccagttctccctgaaaagactgccctgtgaccagtgcccggtgcccaccgactcctccgtgctggagttccgagtgagggacataggcgagctcgtgcctctcctgcccaacccttgcagccccatcagcgaggggcgctggcagacggaggaccatgatgggaacaagatcctcctacagcaaacatgttcccagttcttcctggtgacccctggaagaattttgtagaaatttgcactgatgcctgatgatactaaactatggctttgtggagtcaaggattgctttatgaatctttccggatcccccatagaactaaactgacattctactttgaacacagtaggttctccttatacgtttttgtttactttctattaaagaatattattaattatgtatataccaaaaagttcacattgtaaatatacagctcagtgaattttcacaaatttaacatttgtata

SEQ ID NO: 469776 - DNA, 555 bp, Homo sapiens
gaatagggcactgttcaatttggcttaaaatcaagcacaactgatggaggatgaacactgtgtagttttgcagagattttcacgactgtgcttgtttaacagaaatctacctgtattctcttatttttaccacatgacgaagggagtacaagtgcagatttcttatgtgcagatactgcatagtgatgaggtctgggcttttagtgtacccatcacccaaatagtgaacagcgcacccaataggatgctggccatgggcaaagcctgtgttgtctttctggaatggtcagtacaggaagaggatttggatggaaagggcaaagttcaccctaagaatggacaaagcccgtacacgttttgtaaaatcagtgatgtttttggtagaaagtttgaaagttgtcaaagagatgctgagctagacaggatggcggtccctatcattctcagttgtacttgagcttacaaattactccaacaaataggagatattgatatatttagaggaactgggttaattgttaaatcttcacttagttctgtgaggcttttagaaat

SEQ ID NO: 469777 - DNA, 954 bp, Homo sapiens
catctccatctcctccatctcctcctcctcctccatctcctcctcctcctccatctcctcctccatctctcctccttctcctcctcctccatctcctcctcctccatctcctcctcctcctcctccatctcctcctcctcctcctcctccatctcctcctcctcctcctcctccatctcctcctcctcctcctccatctcctcctcctcctcctccatctcctcctcctcctgctcccccccccacctcgccttctctctcatcattcacattcgaaaatgaagagtgaagcaccaagatagcccaatggagagaagcagggctttggggtcacacggatcacataataacatgggcttatgtggtcctgggaaatcgaggaaggggctggctgctacctggtatcagccatcagggccactggagtggaaccctggtcctgtgtgtgacaggctctttgcccaaagaaggctcagagaaggcctcatagctgtctgtccctctgctgccaaaattctcctggtacaacacagaaatggaaaacttatcaaaggcagatccatgccttctaatggttcacactctactggtaaaaacaaatgtttaaacatacacctgctctccaataagaagcacttgtttgcacttggtctgggaaaatcagtgcaggatgccagaggagagggatatagaggagctttggcgaaattggaaaagttggaggccatgaaggggagaaatgctgtatccagctctgactttgcaaaaagactgtccagtgagagaaactgcctcccatcatcatcaatagatattgaccaaatctacttttggtgttgacctgaaggtcacagagtgattgcaaaggcctctgcttgctatggggaaatgaatgcagaaagaaataggcatcaatttaacattccttggagagtccttgtaaaatagcagcgt

SEQ ID NO: 469778 - DNA, 647 bp, Homo sapiens
tgtctgtgtgtgtgtgtgtgtgtgtgtgtgtgtgtgtgtgtgtgtgtagggggttgagggaagcagggtattcaatgaagcatctcttccttctggggagaatgtgggaactagatttcagactttctttgctttgtgttgctttttggaatgagacattttggagggtgggggaggagagtacgccccaaggaaactctttgcgtttgtgcttgagagaaatgatcatgcaggtgaggagaacgagacctcaagaggcaaagctgactaaagatgttaaaacaaaaaggagctggggaggaggtaaggttcaaggggtacatatgcaggcttgttacatgggcaaattgcgaatcactggggtttggtgtacaaatgattttgtcacccaggtagtgagcatagcacccgatgaagagtttttccgtcctcaccctcctcccagctccaccctcaaggaagtcccggtgtctgttgttccactccttgttttggctgtgtggctggttcctgtcaatggctgtaatgtgagcagcaaagcagaagcaggctcttctctcccttctccttctatacaacatggacgttgacacccaaggcaatcttgcaaatgtcagaaactttagaatcaacttgttcacttaaaa

SEQ ID NO: 469779 - DNA, 955 bp, Homo sapiens
caaattgcctgcaggacagcttcatgtacagtccacagtatgttgagagagaggcatcccaccaaagcctccagcgcagcacccgtggagaccagcagtacagatatccttcattgcccttctccccctaggctaccacccccaggacctaccctcgaccagttggatgatgcctgcccctattggggaggatggatcttctttgttcagctgctgattcaaatgctaatctcttccagaaacgccctcacagacacgtccagaaataaggttttaccagctacctgggcatcccttagcccggtcaagctgacacataacactgactatcacaatgttcaagttcaagggagttgggagaagaaagaactgggcataaagcaaagggtcttcaacagaggacagaacagacagtgtcaccaacatcaaagaccaaaggtagataaaaccacaaagatgggaagaaaccagagcagaaaagctgaaaattccaaaaaacagagcacctcttctcctccagaggatcacagctccttgccagcaagggaacgaaactggatggagaatgagtttgatgagttgacagaagtaggcttcagaagatcagtagtaacaaacttctctgagctaaaggagcatgtgctaacccatcgcaaggaagctaaaaaccttgaaaaagggttagatgaatggttaactagaataaagggtgtagagaagaccttaaatgacctgatggagccaaaaaccatggcacaagaacttcatgacacatgcacaagcttcaaaagccgatttgatcaagagggagaaagagtatcagtgattgaagatcaaattaaagaaatgaagcaagaagagaagtttagagaaaaaagagtgaaaagaaatgaacaaagagtccaagaaatatggggctactgaaaagaccaaatctacatttgattggtgtacc

SEQ ID NO: 469780 - DNA, 589 bp, Homo sapiens
tgaacagctgtgtatccacataccaggcatgggaaacagcccttcaggccactcctggagtgcgtgcttccaggccaggcaaacagctgtgtgcctgcatcctgggcttgagcaactgcatccccatgctcctggccagagtaacagcaccatggccagccccacaaagccatactccaagttttctgacccactgtatacctgcatacacctctaccctgagaaacaaaagaaaaaatgggacctcacaacagatatgacagaaataaaaaggattattagagactattatgaacaactctacaataaatttgaaaacctagaggaagtggataaaatcctcgacccatacaacctgccaagactaaaccaagaagaaatagaaaacctgaacagaccaaaaagaagtaatgagattgaatcaggaacaaaaaggccttcaacaaagtttgaagattatgaaaatgctgaatatgtcgcttcatatgagccctgattcccagcacctttggacccacccggagcctgggagaacttgccatcgtgaagggaaggacacaggcctgactgtttttaccatgtgatgatc

SEQ ID NO: 469781 - DNA, 747 bp, Homo sapiens
aggttaccctttgatagttcatccatgtccctgcaaaggacatgaactcattatggctgcaaagtattccatggccaggctcctgcgggccgcgctgtgctgtgctggactggcctcaaattttaaatggctagtatcctctatcaatttttggaggcttgacaaaggacccacaaaggacactatcccatgtggatgcagatgtcaaatttcaaaggatgctctttctaggcaatcaggaacacagttggggtcagcagcagggccagagggagaccaaaactcacctccagacaaaattggaaagccaatgactgagatgatgagtattgccaaggaagaaggctttaatcgggtgctacagccaaggagatgggagagctccaagccaccacccttccctgcttctgctcctgaggctggaaccacagtgttacataatgctggccatggagatgcagagctgcccttgaggaggtcacagtttagagaaaccattcacatgtccttccacaaaggactgcatcatacgaaaggaaaattgatactataatgttattatgcataatttgatcccttgaaatcatgtctatatttatgtatgtttatgaagccataacatattccagaagaatgcaaatactatatgtattagtcttgaagggaatggtgtaacaaattgagtggctcaaacaacagaaatttattgtcacattcccagagctagacgtacgaaatcaaggtgtc

SEQ ID NO: 469782 - DNA, 916 bp, Homo sapiens
gctgactctaggactgggtcaggaaatacacaagcctacaatatggaaagggggaaaatgagcaactttacagtggagaaacctgacagacactacctcagccaggtgatcaaggtcaacatcatcatggtaagtgatattgacagtaggctcctaccccacaatcctagtgaatgccaatgccaaaaacccgggagtgcctggggcggccaacaataccaaatgctgaaaacccacagtaaccgagtagtggccaatgagagtccccacacccaatgccaaaaatcccagagcatccagggggcggccaaagaccaagttggggccacagaacaacatgactctggcatcccagggtttccccggcttgggcaggcttggttgctgcgagggaattggcatgtgatcctgcagcctcccagccagagctttgaatccctgcactatggctactcacctatccactcagctcaaccatctgccaggaaagatgatggtcctgaaaagaacctttggaccacaaatcctcccaaaaacctattcaaaagaagttactagattaagttaaaattaaacttagttaaaaaagatagcaaatgttgctttgttgtcaaatttgtcttctgcagctcacaacatgacctgctcatgtgtttgattttcatagactcgtaagacattatctgcaatggacgaaacaatggcagagaaaggtgagggagttgagggagagagacaagaagtaaagacggctcttagcttggagaggtgtccctggaagaatggttatgccagtaatagaggggtgagtttgcagaaagaagctgacttaggaggcaaatcatgaagtccttttcccatctgttatgcttgtgttgcctacggcatactgctacctgactgactgctggcatga

SEQ ID NO: 469783 - DNA, 1021 bp, Homo sapiens
gtgacgttggctgctgcagaaggagttcaccacctacgacttccccagcatgtctgctgaaaataatcagttatcaggagcatcacctcctcaccctcccacaactccccaatattccacacagaacttgccttcagagaaagaggatactgaagtagaactagatgaggaaagtctacaggatgaatctccattttctccagagggagagtctctggaggacaaagagtatctggaggaggaagaggatctggaagaggaagagtatctggggaaagaagaatacttgaaggaggaagagtatctggggaaggaagagcatctggaggaggaagagtatctggagaaggcagggtatctggaggaggaagagtatattgaagaggaagagtatctggggaaggaagggtatctggaggaggaagagtacctggggaaggaagagcatctggaggaggaagagtatctggggaaggaagggtatctggagaaggaagattatattgaggaggtagattatctggggaagaaagcgtatctggaggaggaggagtatctggggaagaaatcatatctagaagaggaaaaggctctggagaaggaagagaatctggaggaggaagaagctctggagaaggaagagaatctggatggaaaagaaaatctgtataaaaagtatctgaaagaagagtatctggaaagggatgagtatctggaggagggcatcccaaaggatggtaactctagtttaccaggatgcccaggaaaaaagcacaaacctgacatagagccagagcgcaaattgtcaactctatccatggtgctgacagggaggaagactcatttactgaccaagttctgctcacaactataatacaatagccttgccccaaagcactgcacccacaaagcaggcaggaagacttcataaacataaagcacctgcttataataataattgttatttgtatctttcctttttcatattacacgagtaatacatgttcattgcaaatgtttt

SEQ ID NO: 469784 - DNA, 520 bp, Homo sapiens
tatcccagaagcctacttctgtattgggatgaaggacatcggtccagcagaggtgactgagacaatatgtaccctatgccatcagactatgttccctaactttcgctgggacaagacacgtgcagaaaatgattctgttcttttgggagcacattggaggcagaagaaaccagctctggggctcagctatctcttgcacctttcttctgaaatttccagaattgctaggttccctgttggaaatggtagttgggacaccaactctcaactggaaatggcaactgaattacagcatttaggccagacggcatttggagctgccgaggaggatctagcaggattagaagagtattttataccttacaattgtgtggtacaggggagtttcaaagcagtttcaggtatgttacttcatttacttattacaacccactgtgagaaaggtgtttttgcacatggggaaactgaaacctagagatggcctaaaatgctatgtgtctggcatatttcttaatgattt

SEQ ID NO: 469785 - DNA, 1083 bp, Homo sapiens
agttcagactaagagtcgtgatgggtgcaccagaatctcagagaccaccactaaagaacttattcagtgggaatagaagtcaccaattatgtcactacctgccatgcttggggatctgcttgtgtccttccatcagtggttcatttgctttcactctgagtggcttgttaaagggctgtggtctagggtgctggcgtacagggctgacgctagattctgagccaatccaaaacagacagaagaagccagatgtagatgtaatacaatatcagctttgtttaagctcttcctctgtcttggggctgctggccttcagactggaactacatgatcagccctcctggttctcaggccttcagactcagactggaactacaccatcagctctcctgggtctccagcttgccgaatgcacatcttgtcagcctccacaatcatgtgaactgatttcttatgacaaatctatctctgtttatctatagatatagatatggacagagacatatacaaatcctattggttctgtttccctggagaaccttgactattactggtttacattgatatttgtgttcattcttttgcatatgcatacatactgcttatgaaattatagtataagcataacttattaatattcttcttaattatattagtgttagtactgttactacttaatattattagtacatttaacctgtatcacagatatttccccatagtgtttttgttgatcattttcattttaattagtgcaaaaaatgcaatgccaaaatataagtagttacagtcatccctccttacccatgggtttgctttctgcagcttcagttacctgctgccaaccactgccccaaaatagataaatgaattccaaatgctaccctgtgcgtgacgaataacaattccttacactaaaccagatttaggatttatgtgacattttgtgctgataaatgaaatgtcactaactgggcaaatggcttgtgggttctctacttttttctcaaataatatcaatgttcatttttctcttctttttgataaagaaagggaaaatttgaccatcaggcctgcagtatt

SEQ ID NO: 469786 - DNA, 573 bp, Homo sapiens
ggtgtagtgcaacacgcagctctggccatgcatcgggaaggtgcacccttctcctggggagatgtcgtgacggctgactctaggaaactcgacagtggggacgagcaaagacctgttgacctcggaggaagaggagcccatgagggagccagagatggaaactcccccatggcagaggctctggtgttccgagacaagtttgtacacagtaggccatgcagtctaagtgttcctgataaggccacttcatcacatttgtcctataagaacacagacacaaaggggaaaagtccctcccctgaaaaggaaccgtggccttgcacacctctccagagtgacccaccttcaagggacttggacaaaggaccttgcaccagcacagtatatggactaaagatcaaggacccccttcttaaatgttcctcggggagggaggagactatcaacaagaccaagactaaatttcttgcctcctttgtgcgcccaggaagtctaattcctcgcaaccacatcacttagcaatttcacgtggtagtaattaagaccacattttccatacttgattttctggtc

SEQ ID NO: 469787 - DNA, 2973 bp, Homo sapiens
caaagcagcaccgaaaattcctgtgtcactactgccaatgtgatagaatttaaaccaaggtaagatatcgcgagagggcgggcccgctaggcttggcgtcgctcccgagctggagctcttgccggcgtctcccctcggccagcggctgaagtgctggcggttaagggcccgtgagcagccgccactccttcggcgttggctcttgcgccggggtcgttgtttcgtgacaaccactcaggtagccgtttctgagacggcagatgcggccgctttagccctgagcgggctccgcggctccctggacggtctctgccagtgcccgactcttctcttccggactccacgccaagcagcgaccctgagccaacagccagagcgcccagaaatggcggcctggactgcctcgcactggccagtcaaggggatcctgaagaacaagacctctacagcttcctctatggtggcctcggctgaacagcccagcgggagtgtcgaggaggagctgagcaaaaaatcccagaagtgggaagaaatgaacatcctggcgacatatcatccagcggacaaagactatggtttaatgaaaatagttgaaccaagcactccttcctgtcgtaagatgggtgatggtgaagatgcgtgtagtggtatagaaaccactgaagccgtggcaccagatatcttagctaagaaattagctgttgctgaaggcttgaacccaaagtatcgggttcaggaacaagaaagcagtggagaggaggctagtgacctctcacctgaagaacgagaaaaaaggcgacaatttcaaatgaaaaggaagcttcactacaatgagggactcaatatcaaactagctagagaattaatttgaaaagacctacatgatgacaaagatgaagaaatgttaaagactgcaggtggagaaagcatgaagacggaagaatcaaatcaaagctctacaacaagtgaccaacggcaaaacacattcagtaagttcatagaagagctttgttcaacactacaactgtttgctagatagaaaccctgttactataatacattgcttcttcttctccacaatttatgatttaagtatcaaaatcataccagttattatatattaccaagaattaaatgatatccttagaaactgattagactgaacatgcctaattggtatatatatcttgtgcctagtactttaccacaaatccagtgtaatatcatcagtccaaaactgcattacttttgtaaaaacactggttaatttgtgtaagatattatatagcatttttagaggataaaaaatatctttggggaggggaactaagttattttcatcactctaaatggggcgatacctcttagaagtttgttggtttgctttttttttaaatcaaaagacaattgaacaacaggatgtataggctgataaatattcagtccgaatagtattttaacacttgtcttcaacttgatttgtctgtttaattgaaaaggattataagagttactcttgcattttctgtcctactacctttaaagttcctgttgagtttctttgtatttacaaggaaaggactgaactttttctcatcaaaactagccttttttttctcacaaataaattatcagtttaaacttgcaaaaaaaaaaaaaaattaagccaaggtagaatgtagttgtggtctgaggaaattaatgttctaaaagttgtagaaggataacagggtgtgaaaagatactgttaagtcaacttaaacatgaactgataattgaccactggattcaggtgagcagagatgacaacagcatgtgatatttcttcagagtagaggaagcaaagtctgattgaagtttgttggagagaggatgggaagagaaagggttcagacggtaagtacagttacactttcaatgagttttgttgaatagaacagtcaagtcaggcattagaggaagaggcagagtcaatggacttttattttttttgttgctttgtttctaaggcagtagaaactgcaatgtttctatacaaatgaaaatgcccaaataataaggaaaacattgatcatacaggaacatgatagggaagttgccggagtaattcactttgcaaacaagaggtaatgggatctgttgcacaagtgtagagctgagacttatataggagcatatagcttatttgttgtgggaagaggataggagtataggaaggtcgatagactcgatgatgggtccatgcaggcattttcttcatatactttctacttcctcagtgaaataatagccatgaatatgtatctggaagaaaaatgctctagttccatagagtggggaataattggaacagttacgcagaataatgggagagcaaattgaataaggagatagagtggtatcaccctacagccttaaggaatcccttgagttcagtggtcaggatattaaaatgagatcattcaacactgttgtgaggttttctcctttaagttcacttattcgatgatgacttagaacaggtgaccagtgaaaaaccagtgaaaacagtaaacattttttcaggaaaataaaacacgggtgttgataatggtattgaggctttatgaacaatggaaagaggttataatgagtggtcataagataaagatagtcttcaagctctgagattcttttctccacttaatctattctgctattgatacatgtcattgcactgtgaatttcccatgttgtgttcttcagctccatcagatttattcacattttggtgttaatcaacactttaaaatttctgaatagtattctgctttatggatatacaatttgtttattcatttacctgttgatggatatttagaatgtttccagtttggtgctttacaaataaagctataaaaatttgtgtataaatcttcatgtgaacataaatatctaggaatgaaatgtctagaatatatgcaagtttaagtt

SEQ ID NO: 469788 - DNA, 793 bp, Homo sapiens
gtcttcctcctcctcctgtgtcaggaaacagcctttctcacattcaggggcaatcatggaggaactccctcaaaagggacaggaggcgattgtgcctatccaaaaattggattctgctcctaaggaggaaagagagaaagaaaatgccgtggttaatcggtcttctgcaccacacagtaagcaaactccagggcctcagcagctgtctttcctcctgagcctgcaggaagccaggcccttgggtggtgccatcacgagccttcactggtgctgcaccagcctggctgccttggttgaggattggtccttccccatccctaaccctaccctgtctctggcagacagtgacaccagagaccttgttctgaagtctgctacagttgggactgatctgacagggaatgcttttaattgtttttccactctgaagaactggatgagattctgccaatgtgatgacacatattcggttagagtgctgtggtatacagtggtccttacaagatcttcctttgacatctgctttgtaccagcgagtgaagtattgatccacgaacaaaggcaccaccggctctgcggttaagcttcaaaattccatgggggaaaaaactcagttcattcccatcaacagtcagtttttcaagtgatctgtaaataaaggaaaccacactttaaaaggtattatacaattcataatattaaagtaaaattctgcctcaattgttcatgaaaattggcatcaaactagtaccaataaaatacaagtatgaatttaagtatttctttagaatca

SEQ ID NO: 469789 - DNA, 1162 bp, Homo sapiens
aactttcacacttaggaaagcaccattcttgagtcaagggtgtatgagtacagtaacaaataatgatttgcatactttattattccgctcatgtttgtttctcttttctgttccccagatattatgtcttaaaaatttacaaatactgaaattgagaaataatcctatcaaagaaattccttctgaaattcaacaacttgagttccttagaattttcaccattgcttttaatttaattactgttcttccaattggaagacttcaagcaagctctgacataataaaaatgtttatttgcaaagtttgttcaatgaaaactcaccaggagggcacttatacagtgaagaatgaaggtgctgaattcttcatatctaagggttgttgtcagaaatctaccttgctgagcaaagaagacctcacggagtgtggtgagacttggagatcagatgttggaaagaaaccaatagggaatagattgaagatgtggaaggatgacagatgaagcagaatttcacaggagatgggaggggaagaagtcatcagctcaggtggagattctggtcttgaacaggaggagtaaccattatctcctaaaactggagatggaggaagggagccatgagtcaaggaatgaggcagcttgaaaacctgggaatggccttcagcatacagccaacaagaaaacaagggcctcagttctacagccggaaagaactgaattctgccaacagcctgcatgagtaagaaaacagattctccctagagcctccagatagcaatgcagtcctgctgatgccttaattttagtagagtgagacctttgcagacttctgacctatataactataattaataaatctgagttgttgtacgccactgtttgtgttgcaatttgttaatggcagtaacagcaaactaaaataaaaccagtcaaagatttcaactcttgtgggatcacattcccccaggaggagacagtcaatatatgtaataaataaattatatagtatgtgagaagattctcattagtattttcctttgcatcatgtctctttttattaaagaatgtttatttagcacttaaatcttacaagcattttagttcattctccttttatatttatctgtatgtatttcaagactcactgtttacagctgtttc

SEQ ID NO: 469790 - DNA, 670 bp, Homo sapiens
tggtcaggaagcgaaggaacgcattcatcagtgttgcagtgaacacgtgtaacatgatggtatgccgatcgtgaaacaagcaaagatctatcacaataaactaaaggttgaagggaactgtgagtatttaacaggctggttgcagaaatttgagaaaagatacagcattaagtttttaaggactcatggtgctaaagcatctactgatcacaaagcagcggagaaactcattgacaaggctgccaaggtcattgctgatgaaaacttgacgccagaacaactctccaatgctgatgaaatatcactgtttgggcattacagcccccaaaagacactgactacagctgatgagacactgaaaattctcatcaaaaataatgttgatgccatgtactttccactaaatgtgacttcattaattcagccatgtgaccagtgtaaccttagatctatgaagagtaaacataagaaccctttcttgaacagcatgctagcagcagtgaacagagaatccatcagtaagctggaggaagtgaatattgaagaagtttttaacctctatcatcggggtccagttgttcattcattcaccattggtgaaatagcctaaatggttctgaatcaaggagatcatgacaatagtgatgatgaagatgaagttgttagtact

SEQ ID NO: 469791 - DNA, 776 bp, Homo sapiens
cagactctaagcaactcatcacacaaacaatatattaatgagcatggtaataactgctgaaaaggagttattccagggatatgaggttctgtctccagacagttactactgctatcatcaccattattccagagacatagacattctcattcactctaccaactgctatccccagaggcccagtattgatggcagcggcggcctgtctgggatggccactaccatgatgccggctgcagtgggggaggtgctgctggggctgtcacttcacggagcctgtgggggccagaagcaggcaggagccccaacttctcgggcacagctgcagccgcccaagttggtgctgcagacccaggcctccctgtgctcttgggggctggaagcaggcaggagccctgctctcccgggtacagctgtaggctcagaaatgtctgctcccactgcctggcctctccctgctccctgtacccactctgatcttggagcgaggttaaggccaagcccaggtgctgttggagcccatctgggtgtgtacacactcggggcagcactgacaccccagccctctgccgccttgaccccctcacagagcagataattctaattttaataaagtctagcttatgaaataaagacaggaaagaaaatttagtgtgcagaccaagatatgctgtaatgtaaagacacactggatttcaaatacttactatgaaaaaactgtaaaatatcttaatcatttttatatggattatatgctgatgtgataatatttttaa

SEQ ID NO: 469792 - DNA, 2251 bp, Homo sapiens
cagtgggtccagtgggtccccggactcatcctgtggtcatttccccagtgccagaatgcataatacatacttagcagctggcagaacccccacattggcttcctgactggtagggggagggctattatggtgggaaaggccaaatggaagccattagagctgactctacctagaaaaatagtaaataaaaaacaatattacatccctggagggatttcagagattagtgtcaccatcaaggacttgaaagattcaggagtggtgattcccaccacatccccattcgactctcccatttggcctgtgcagaagacagatggatcttggagaatgacagtggattatcgtaaggtcaaccaagtggtgattccaattgcagctgctgtaccagatgtggtttcattgcttgagcaaattaacacatctcctggtacctgtaaaattctaggggtccagtggtgtggggcctgtcaagatattccttctaaggcaaatgataagttgctgcattcagcccctcctgcaaccaagaaagaggcacaatgcctagtgggcctaactggattttggaggcaacacattcctcatttgggtgtgttactctgccccatttatcaagtgaacttaaaggctgtcagttttgagtgggttccagaacaggagaaggctctgcaacaagtcctggctgctgtgcaagctgctctgccacttaggccatatgacccagcagatccaatggtgtttgaggtgtcagatagggatgctgtttggagcctttggcaggccctcataggtgaatcacagcagaggcctctaggattttggagcaaggccctgtcatcttctgcagataactactctcctcttgagagacagctcttggcctattactgggctttggtggaaactgaacgtttgactatgggtcatcaagtcaccatgcgacctgaactgcccatcatgaactgggtgctttctgacccatctagccataaagccggttgtgcacagcagcattccgtcatcacatggaagtggatgacccattctgtagacaccactcagcctctttccccagccacccctgtcattgctcaatgggcccatgaacaaagtggccgtggtggcagagatggaggttatgcatgggctcagcaacatggacttccacttgtcaaggctagagccactactgagtgcccaatttgccagcagcagagaccaacactgagccctcgatatggcaccattccttggagtgatcagctagctacctggtggcaggttgattatattggacctcttccatcatggaaatggcagaagtttgtcctcactggaatagatgcctactccagatatgggtttgcctatgctgcccacaatgcttctgccaagactaccatccgtggactcatggaatgctttgtccactgtcatggtattccacacagcattgcctctgaccaaggcactcacttcacagctaaagaagtgcagcagtgggctcgtgcttatggaattcactgtcaacaggctaagaagggagttacagtgttgactggggtgattgacccagactatcaagatgaaatcagtctacaactccacaacagaggtaaggaacagtacacatgcaaaacaggagatccgttagggcatctcttagtattaccatgccctgtgattaaggtcaatgggaaactacaacagcctgatccaggaaggactacagataatccagagccttcaggaatgaagatttgggtcacttcacctgggaaaaaaccacaacctgctgaggtgcttgctgaaggcaaagggaatacagaatgggtagtagaagaaggtagtcataaatagcagctacgaccacgtgaccagctgcagaaacgagaactgtaattgtcatatatttcctccttcttttgttaaaaacatgtttgtacatgtatacacttgtactaagaaaatgtcttcattttatttcctttctcctttatcctgtgacccagatttattgacttcacatcagcatttaagtattgttaacattatgtaataggatttggtttggggattggtatgtttctggttgtacgaaggatagttttattatgttaggtgtaattatgaccttattattgtctttatttgaagattatgtatgatctcaaaagatgtgtatggattcaagttgacaaggggtggacttgtgatggttaatactgagtgtcaacttgattggatt

SEQ ID NO: 469793 - DNA, 772 bp, Homo sapiens
ttctcctattaatctgccttttgtcagttcattttcagtgaaccttcagagaatgatgggcaggttttcccttggcccccacagttttggcactgtgagcaggataccaaaaccactctgttcttctggaagccacagcccagggaacctaggatctgagaagttcacaaaaggattctatgcagtgcctggactggctgaatgtcttgattctgtggtgcttaaagcagaaaatgtcactatgatttcaaagggccttaatgattatagcaggggtgagaaagaaagcagaatttctaaagcctgtgttcccaataagccatactgcctcagctttcttgttggagagtcaagaatcctacaagagagttcatcagctgagggaaagccattctcaggaaaagtttaccttcgattagataatttggcagctcttcatatgggctacataaattggcattccttcgcttagcacacccaagatatctccatgctgacaatctgacctggatgagaggtgatgactacagttcagtcattaagatgacaaattatattgatcattttctcatatgcttattagccattcatatattttctttcatgaaatgcctgctcaaatctcttggccatttttattggattatttatcatatgtcctcacaaagacttcaacatgaatgctttagctattttatttataattccaagaaacaataaacaaaccaaatgttcaataacagttgaattttgaatggacaaataacatata

SEQ ID NO: 469794 - DNA, 525 bp, Homo sapiens
aatattctttaaatgaagttgtttagaataaaacaaatttatctcaaaagtactaatgtgtatacattctctcacacgtctttagaattactggtgagtggtaacacagctgcctctgagatcaacatctgtggcatatctgagctcagactctccttgggcacggcttgctgtggctgctgtgggagatgtcgatgtggttctcaggccaatggagttatgttcccagggggattatggctgcctctactgtatcacacaggtcaccagggaagtgaggaaaagccagcacccaaaggccttactcagttccccatgcagcctacagtccgaaaagctggtctcactcccaccatgcccctcacgacagtaccaagtttatttctggcagctggtaagggttactttgtggattacagtgattatgtgtaaaatgcctgaaatgtagtaggagactgtcagatcattagtctccaaattccaggaatttaagaactttatctcatttgtcactgtgtatctcag

SEQ ID NO: 469795 - DNA, 724 bp, Homo sapiens
gagcacaaataagcatcagagaaatgccatctcataaacaggcagaagcatttgtgaacacagcagctgttttcttgagttgtttcgaaattcatattgatagagcttcggaaaggctttttgttttcactatcaattgtgtgactggcattatatttttggtgaaatcccttgcatttatatttatttccttgtatagattaatgcatagcctttgtcttcttctcggggattttcatctactttgtgtgaaaataaaattatttctggaatccttgtatatagctagttggctctaccccacagccaccatttttggtattacaagtacacgcagtcgagatccaagaactctctcttggggtctggatcaggaccccttttctgtaacaccgtctcaaagaaagcccctcttgcccttatttgccaacctccaaatccaaaaaaaaagagaagaatcaaattcaaaagatggcataataatgtgtgaatctgatataatacaactgaagataacccaggaggctgcatttcagcaatccctcgcagagtttctactctctgatatctggtaaactttaatgctatgtttatgaaattttagatgtatgacaaccagcaactttttcaatattgccagaagcctattaaaagttagacaatataaaaatatttttgttctgtcatatatgtgaacttttaagcaaagagggataggctccct

SEQ ID NO: 469796 - DNA, 734 bp, Homo sapiens
gggactgactgttagaaggaaaactaacaaacagaaagcaataacatcaacatcaacaaaaaggatgcccatgaaaaaaccccatccaaagatcaccagcatcaaagatcaaagggatgaaaactggatggagactgagtttgatgaattgacagaagtaggcttcagaaggtgggcaataacaaactgctcagagctaaaggagcatgttctaacccaatgcaaggaagctgagaaccttggtaaaaggttacaggaactgttaactagaataactagtttagagaggaacataaatgacctgatggtgctgaaaaacacagtgcaagaacttcgtgaagcatacacaagtatcaatagccaaattgatcaagcagaagaaagggtatcagagattgaagatcaacttaatgaaataaagtgggactatgtgaaaagaccaaatctacctttgattggtatacctgaaagtgacagggagaatggaaccaagttggaaaacacccttcaggatattatccaatagaacttccccaacctagcaagacaggccaacattcaaattcaggaaatacagagaacaccacaaatatactcctcaagaagagcaaccccaagacacaaaattgtcagatttaccaaggttgaaatgaaggaaaaaatgttaagggcagtcagagagaaaggtcaggttacctacaaagggaagcctgtgtaacagtggatcactctgc

SEQ ID NO: 469797 - DNA, 604 bp, Homo sapiens
aaatatgtagtatctgggccggaatgccccattactcatggcacagtccctcacagcttcccttggctaggagagggagttcattgaccccttgtgcttcctggttgaggggacacaccaccctgcttctgctcgccctctgtgggctgcactcactacctaacctttggataacatctctgctgatttttggagactcaagccttcgtgatggccatttgtcattccctcagcttccatggcttctggctatgggtactaaaaaagcaccaaggtcatattgtaaacttagactatttggcatggcccaagtgccccagaggaaatcaaactggaaagtccactaccgccaaatggttaagggaacaggcattgggaacactactaatggtccccagagtggctttaaagaaaagatgaaagtagtcaagaaagaaatttgaggcgataatttcctttttcctataattattacatacttctacaagaatttcataatttcaaagtagaaatttgtgctgaatttttaaattaaaaattagcaatttaggaagctaaccgtactcttggggagaaagatgtgaagctggcccttgctgactcc

SEQ ID NO: 469798 - DNA, 875 bp, Homo sapiens
ttattgccatttttgcaggagtcggggcaggtttagccatgtctgagctcagtctctcctcgggcaaggcttgctgcggctgctatgggtgatggaggtgtggttctcaggccaatggagttatattctcagggctattatggctgcctcttctgagtcatacaggtcaccagagaaagccagcagtcacaggcctcacctcctccccacgcagcccaaaagcctaaaggccagtctcactcccactgtgcccccacaacagcaccgagtctacttcctggcagcagaaactcaaggggagtactgtgccagccagcctctggaaaaaaggcagacaacactacctcccacttttgtgagtgatgctggggagcacgtcgctgcttccaacctgcctatctcaattgtggtgacaaagcaccagaccaagaggcagatccctggaactgaaaaccctgacttgagaaagagagagagtgagagagcactattcaattctgtcacttactagctgtgtggtcctgggcaagtgactaaacttctctgagcttcagttgcctcagctgaaaaataaagaaaataatacctatctcataagaatgatgtcatggttaaataattttttaacttggcactaaaaatgatatatattgattgaatcactcatttaacaaatattttagtgttttagtagttgagaagaatgataaatatcttaaaacagcaagcaatataactgtactatttaagttatagtttgctggccttacagactagaaggatagcagacatttaagtaaactattacaatgtaattttatattaaggaaagcaggccaaggcaatcacatacaattatgaagattttacactgt

SEQ ID NO: 469799 - DNA, 546 bp, Homo sapiens
gagggctgccagcatgctgtcacctctcaataggacttttcctcattggagatctcccactaggagggagagagcagtgtgtggagacccatatagtgaactttttctccaagaactaccacaggaacataccaggaaagctgagagaatctacagacctttgaaggaggtggattgccactgcaggctccatgggacagcagaggaactggcaagcatgtatcctccctatacaatcacagctgatgtgctctcgaaagcaccacctcttggctggaggccagttaacacaaaaccatcacacttaacaaaaatacaaccaagaaccatcacagagtccatttcattcccctgctacctccaccagataccagattgtccctctgacatcatccacccaaatgagaataaaccagaaaaacaattctgataatatgagaaaacaagctttcttaacatccacaaaagatcacactagctcaccagcaatggattcaagctaagatgaaatctctaaattgccaggaaaagaattcgtaaggttga

SEQ ID NO: 469800 - DNA, 631 bp, Homo sapiens
acaaaaatccaaccagactgactctccccctcgctcatcacactcatctttgaattttattgagattccataagtgtgtatgcttttaatgggctcattttctgatttttgtccctgtgatgaatctgccaggaacacccccaaccctggatcaattcaaccacctacatgtccattcacatatctgatcactaatcagccacctggaactgagaatgggggacacaagcaccactgtggccaccaacactggaactgcactggttcagacctgaagccagcacagcactgggtctcgcccaaggcctgccttagagagaaagcaatacttcctgggaaaagcgagctggtgtggcttcctgaaaaaagccaccttgatgtagttaccaagggtatggtcttaaatatggagattggagagtcaatagtcagtacatccagagttaatcaagcacagggaaataactcacaccaacccaattcacaagtctgacattaaggaatccagaatgccaatgtattcacttatgataaaaaatataaggctccattgatggatctgggcaggccaaggctcactggaaagttacctgatggatatagaattagaagcttattgcctgagccaaac

SEQ ID NO: 469801 - DNA, 647 bp, Homo sapiens
taggaagatcagagtcctggaaggagctatgcccacagaagcacaggccccgagcgtaggcacagggctgttgggactgccagactgcttcttaggctggaagcgcaggcaatgggagttggtaacccgattgtgcaggaccaaagacacagctgatcctgggcccaggctccacacagctgggattgtggagttcagccactcatgtgagcctggtataatgaagatggaaccccagtgctggagacgtacagtggctactggcccctggagcagggtgcactccagaaatggctctggtctcaagatgggcccatgctgtggcagcttggctcacaggggtttggtaggggatggagagtgcacaccttgtactcctaatgtggaaaaatacagctgctcaaattcttggaaactctccaaactgggctcagagctttcttcttgcttattattatataatgtccagagtttacagctgtacttagcaggtggaagatagatatgtatgtttactcttgtcctagaagtgaaaatcattgacttaatttttgaattaaattaaattaaataaacttatgtcaataagcatgttttaaggtatacaatagaaactctgaagaaagaaattatagagtgcattttat

SEQ ID NO: 469802 - DNA, 500 bp, Homo sapiens
ctgagaggttacccagcagcacctcccactatcatgacacaatgccaggaagacttgtgaaatggcaatttctggattacatctgggagcccatttcagtggcagctcctgcagccagcatttcaagtccagaggaggctttttgtaaagagctgtctgctccctctggggtagatacagaattagttcactacgcttccatgctgctttcctctgatgtgccttcctgctctgcagagtttagaaaggcagaggagtctctccccatgtccatcaacatcacaagacactgggagtattgccatgattctgctgatgttcacttaagacctaagggctttgtagtcagcttgtggtcaatgctgccatgcctggaattcacctttcagggcagtgggctcccctctggcccagggccagaaatgccatccaagagccaactctggaatcagggacccgaagagcccacttggttcacttccccactgtagttgagctgg

SEQ ID NO: 469803 - DNA, 816 bp, Homo sapiens
cgggaaccacaggtgattcctatgcacaggaaaggtggagaagacaatgaactcttccttgctgctgggtggggagaaaaactggagaaatggaaagccaggtggctgttcatgataaacagaaaaggagacattcagaaggaaaaatctagtagaggggtaggaggctacagaggcaatggccagcaggggcataggagagggaagaagaggctcctagaggctaccggcagttctctgctatgtgtccccacagacagttcacaatatgattattgctcttcttccagtaaatggaactatcaggcttccaggagctcaagagacaccccgagaaacatctttgattcatccattgttcacttcctcttattcaatctttcaggagaaacaattgccagctggtgtcatcgtggagtaactatagtagactgaatgcaagtatgttttgcctttttacctggagagcgttcaattttagaaagtttctattcatttttgcctgaattttcctcatctctgaaatgggatattatacttctcttatctccttagagtgttgttctgagaagcaaatgaaataatggctaggagagtgctttccactatacaaactaccactagcattctggttatccattttggtagctaataaggtgatgtttatccatgtgatatcaagcaattttataggaaatgagaagcttcttcaataaggtgatataaaaaggtataatgatgttttacttaactaaagcagaggtatgtgtatattaagcagacacattcagaaaataattgttgggcttttgtttt

SEQ ID NO: 469804 - DNA, 1048 bp, Homo sapiens
tttctgtgagcagagaggagggactgacaatcgggtccattagctaacgagacctgtgaaatgtggagctcagaggggaaaatgcacagaaacagggcagcacaagaacatctagccctttgtgtctgggatgttagtaaacatccaggaccttccacagccaatggatcctacaatcgtggagatgtcctgaatgccccagtctggacactgaagacagtaattaaacacgtcactctgcctcctataaatgcctgcaatgaagtactcacaagtaagtgctgcacaaaggaaatactctacaccattgctacaaggaataaagaaaaatcatttgctcctagcttggtcatagactttcttcctagtgcagctacctactccaatgtggcaaacatttataaagcaccactgtgtgcagagttgccaggacagaccatccaaaggatatcaaacaaaactaacacgatattaatggctgaacgaacaggctttccatttgcacttgcatgagggggaggttaaggattggcagttgctcacataaatcaagtctgatacaagcatgtatagaatttttatcttcttttgattataattatgatttttatttatatacctttacttacagttcttgatttattgacttcatatggaattattgactccctgctatgagagttgagaaacttaccactcatatttttgctccattttacttctgcctaccaacttaggcacatgattgtgcattgtccaaccttataacatttacgttgttctgtaaaaaaaaaaatgctttgtataaagacacagttgttagggtatagaattttaacatgaatactcaaactccatttcttgtgctctaactggagtgtgattaaacttagaatagaatgcattccttcctgccacgtaaactgcaatgcaggaggagaaacagactcttcacaccactttgcttgttcggatcccatgagcgtgcccttcatagaaagcaatatccaaactcttcagttagcatgcaaatgatgccatcgatccc

SEQ ID NO: 469805 - DNA, 543 bp, Homo sapiens
cttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgcagaagggactgtcaccgaggactacaacagccaggtggaggatcagagtgagtgggaagtttcacaacggattgatctgatcaatcccttcaaggagctgaaggcaaaatgtggaagtccagcagctccaccagatagagatctggagatgcttctctcactgtgcttggcttcatctggggtgcaagggaaggcattatcgggtggctcccttgctccaggaactgaacgaggcccttttcataccttaaatatattctgcacaacaaatgggtattgttagtctccatttcatagatgaaaatagtgaagcccacagaaaataa

SEQ ID NO: 469806 - DNA, 532 bp, Homo sapiens
ttctattccatgttccaggactctgctggagtctgtaagtggcttggacactcagctggactggcaaagcagaatatctgtgtgtcagtgtacttcattcatccgtcgctgggtcagggtctgggggtcagacccctgcagctggtgcccctgtgtgaggaacgctaccacacatcctggcctgggctggggagtccatccaatggatttcagagagagcttgatgacacggtttgggggcagggtatgggtcgatgggtcctaattgccatgctgcagagcatttactttatcataaggtcaactgtcaccattaagaaggttggccatggaagtgacatgaccaggtctttgaaacgatacatgcaagcattacccagaactgtggggcttgactttgaaagtgactcagtattttcagatcaggagcctcaaaatggaaaggatgtgatgaagagctaaaaaatgaaaaaaaaaaaaaaaaatagaaacacggacttaaaggaaaattttaaatttaagagcagactga

SEQ ID NO: 469807 - DNA, 613 bp, Homo sapiens
gtgaaccctgcttaactaggccatgcctgagtgcttcctaactctggcccgaatgacccatcaagacagttgcagcagagtggacggcaccggagtggaggtcaagattggcataacgtcttggtgtcagggacacaatctcattgctgaatctgacctgcagcgacttccacttcctgtgtctgctttggactttcagctgtgccaaaatctgtcccctagactgaatgtagctgagtgtctgaaggtcgtgcctggcgtctatgttgtagtcgggttcccagttgattctgactcacagcaagaactgaacattgctgtgttagctgatgagcaaacacaaataattgtcaaagaagacaatgctctaagacaagggtccccaacccctgggctgtggaccagccctgatccatggcctgttaggaactggaccacacaacaggaggctggggggttagtctatcaagatgaaaaggctttcctggtgacttgccaaacaaatgaggataattatttactactgtcctctgaggactctacaaatgagagccattgaacttgagaactagaaggaatctttgaggttttgttattcatcttctttatttta

SEQ ID NO: 469808 - DNA, 574 bp, Homo sapiens
ctgcctttgccctgtgagacagcccagacctttacaagctctgtacaatcaacccagttcttttagcagccatggcaggcaagcccacagggaatagttccccagagctgaaggaggttccagaggagcaatctaagacagctattgaatgtcataacccttccagtccccctccaattgtggacccttctcacttggcttgtcaaattccaaacggcattgtaaatgactatcttaaatatggatgtcctgatcccaaggatgcccctattacatgtaaagaagggaaacttctaagatatgagaaaaatctgctggtgtctctcacaaggcacaacttaggatcaagcaatcaaacgccaaatggggctgcaaacagaaccacctatggacataacattctgccaaggacccttagatcgaccccaggaggagccctagctgctgttcccactggacgcccgtttgcggcaggaagtagccagaaagagttgtggcccaaagccccctaacagtagtgaggatgacatctcctccgggggaaatattataggagttattaagaaattatttt

SEQ ID NO: 469809 - DNA, 698 bp, Homo sapiens
ctgactgtcaggggtattgaggggggggcagcaaaagaagaaaagccctgatttttattcaaggccatgttcttaactctgagagcagttgttaactgggacatatcaatgtttgggactgtcttcaggctaagtatggatggcccttatcagcgcctccagaatcacacctgtaggtcattgttacttccatttgcatgtgtggccagctgtgttggtccgtcaggaatgcagaagaccaatctgccccacatctccattgttgctggacttctccatttatacatcctaacgggcttcacacagaacctatccaaaacagaaccacacaagttcaagttgtattccatgctccacatctcaatgagcagttgttactcaaggttacccagaccacaggttaaggtagaagagaaggagacagaagtattgttcctgtggcagcaacagtcaggtttagggacttttgcagatggcctgcgtgagatttgaccatgacttccaagagtccttttgtaaatcacctatagggctgttgcaggcatctgagatcttgattaaagtttcctgcaattcctgaacttcctgatttcctaaattcttttttaatatttttactttttaattattaattgacaaattatagttgtaagttttcttaaattctaaaagcagctcttactgacctttgttccctt

SEQ ID NO: 469810 - DNA, 626 bp, Homo sapiens
gccgccggcacacctggctgtgcgcagtggccggagccctcgcttgctcgctcacacatccttcgctgctccacatctggctcgcctttggcgggcatgggattcacacgtctcatgaaattttctgcagcaccaaataaagccttcttgtttggcaatactcattgtgtcagtgattggctttctgtgtggagagcagcaggacccagactaaccccctggtgtttagaaaagcagttggggccaacggcaatggggccggcaagagaccgaaccccaccaatggccaaagaaaaagtcagacagttgcttaggaggacttctgaaactctccctacctatagcagccaagccatgagcaaagcgttcctggtcagggacccaaatcttaccaaagcactagggaggatggaggcagctctctccatgtctgtggttcgagtcacattgctacctgtgagcagaggtgacctcctgttgctgttaagattcatgctacctcctgggtagtatcatatgtaatagtatcactttttaaacattttggtcaaataaatttttacataaagtacaaaaaagaagagattcatgctacctcatctcatctcccctgcttgtcctcacag

SEQ ID NO: 469811 - DNA, 646 bp, Homo sapiens
ccgaccttaccctatttctttctttttgtttcttgctatgccaagtcactatgctgacgccatctgtgatggttaattttagtcgtcaacttgactgggttcaggaatacacagatagctggcaaaacattattcctggccctcggacaacagagctccaggttctcaggcctttggactcagaccgcattacgctacagacttccctggttctcctgcctgcagatggtgtatcacacgacttctcagtctccataattagaaatgcttctgtgacatcagtgtgccttccttatcaagaggccagggtcaccacagcggtatccatcttccctgctgaaaacagaacaaagaacacaacaaagaatgatggtattcagcttttggcgaaaggccaaaatgtcccaacaaaaggtgataccgttaaaaaatggacaacaatgaatacaaataattctggtccttggaacataactatgaatataactaatactcacaattatcacaaaatatcaacagcattgtcagcattgttttctgcatcttctgtgctcaacatgctagttaaagctctatttgattatgttccaagagtagatgtaatggaagtccaactcaaacatcggtagggatattaatcctttgg

SEQ ID NO: 469812 - DNA, 503 bp, Homo sapiens
catagtgtttgggtgacggatccttgaggagtcgccacactgtcttccacaatggttgaactagtttacaatcccaccaacagtgtaaaagtctcagagaagtttgatcgtctgaagccttcttctctcaacctgtcaaagtcattctccatacagctttgttacattgctggcaaggagctgcattcctttggaggagaagaggtgtcaggaccctcagctgcaggtctgttggagtttgctggaggtccactccagaccctgtttgcctgggtatcagcagcagaggtggcagaacagcgaatattgctgaagagcaaatgctgctgcctgatctttcctctgcaagcttcgtctcagaggggtacccagccgtctgtggtgggctccacccagttcgagcttcctggctgctctgtttacctactgaagcctcagcaatggcaggctcccctaccccagccttgctgacgccttgtagttccatctcagactgccttact

SEQ ID NO: 469813 - DNA, 2259 bp, Homo sapiens
gcaaagacgattcacagcacaaatggggagtttcaggttggcagaaagaaaacccttcgagatgcataatggagagagtgacaaaactgagccccacagaatgtggaaagctggacagcttaaatgtatcttttcaaactcatgctagcaaggaatggattactatattgctaaatctgaaggtgtggtatattggagctaggaggtggtgtgcattctgcaatcagtgggttgaaaatgttgggaaaatcagggaacgggaaatgagtcaaggagctgctgccttctggaaacttaagagatgtgatgagaggactcaacccattgtcgctggctttgaaaatagattaaagaggccacaaaccaagaaatgcgggtggcccctagaatatggaaaagaagtcaatcatggaacccagtcagatccatggagtaccagtacccggagggtggtcatcaaaattgaaatgagacttggggcacagggagagacatttgaaccatgtgagttcaggaagcacttcctcgtaccagtggcccagaaggagtggtttagaaggagacaagaacgaattgaagcccatgaaaaagcagcaaatgtcttggcaacttgtagaaaattacatttgctttcacctcttcccctcctgaggaaaaactgcttctgtgcattttcaggggaatccctttccatgtgagagaggaattctcatggctttcacctgctttgggatgttgcttcctaattatcctttgccatctttctccccactctctcttttacacccttctcttgattatgacgaaatcaagtttatccacaaaaatgctaccctaagccttcctgctaatttttattttaaagttatctagttgattcctttttcaatcttataaattttttaattccctgaaaataaccacatgtattgaactcaaaatgttatagtttctgtaactcttggtttgcataaaccctaaaatgaagtaatgtgtacattaattatatgctttgccatttacttgtggtttctgtgaaagcaaatgccactatttttagttcctgatcttaaaattactctttctcaaatgctgttaaaccttaatgaatatccaaattcatataaattatttaagctataatttcctatactaaacagtcattagattaacgtacatccttagggctcttcccagctgtaccaaattagctttttttgaatacttttagatttgaagcaatgcagaaagtattgctcttctaagttgtcttataaggttacaaacagcaatttgacttaaaaatgccattgagaatgtttcctccagttagtattcatgcaataaaacctcatgtttttccctaagaattattgaattttaaaaacatatcctaatcttttcatttacatacaagtgaggaaactaagatatagaaagtttggatgaagtcctcagcatttcaaagaagtctgtatattgaaatgttctcttcctcctttctttcctcttctttttttttttctattaagaaagcaagtacgacagaaccatcttagtttggatagtaattctcacttacaaaaaaatgtaaactaattgaaatgatggaaatcaaaaatgaaaacattcgtttaaatctttattttttaaaactaacacatatttaagaatgtataaattccggtgtgtatctgtcaaggtattcctgattttatttttcactacactcttttcctgagtgttttcatccctagaagacatactcacatggaggaagcatcttcatgttattccaacaaatgcatttttcttaaatttcccctttctagcctctagatatagggtgtcttcctgtttctatctcacaccttttagagattcttttcacatacttcactgtgtagttattaatgtttcttctctgacaattctttatttctcttcccttgaaagagaaccctgctgctgtcattacttttccttcagatttccttcagatctctccttttgccagctacccaattcccagtttacagggaacccgctgatggcaatatttctttcctttattttttttgattcagaatactcagactgctgtttgaataataatgatgataggtatattgtatttacaaattactggttatttggtgatttcaatgtaatttatgtgcatgaattcattagtagtctcaattttcacacgacgtgttggaacaacttgtgttttttctcagtgaggaaatgaaggac

SEQ ID NO: 469814 - DNA, 508 bp, Homo sapiens
cagccatgttgctcacacaaagccttggtggggcgccgaaaatttctgggggatggtatggagagagaatggacgatgtttctcagggctgcttcaagcgggattaggggcagcgtgggaacctagagtgggagagattaagctgaaggaagattttgtggagattcagcatagtcctgccagcaaagattatgtatttacttcaagagttaagagtggcagtttggggatagcaccaggagatatcagctgtgatggcttggagaaacagtgtaaaccggcagtgcctggtggaaatgccatcaataaatcaagcgtgatcagggtgaggaacaggaaagaaggaaatatggggaaatggggtgaatatcaggtggatcagagagatacagtcatgggtgtcaggtgtggtatcaggaataatgtgggaggctggattgaagtccaggccaggaacaatggtaattgtgggacttaacaaagagtgagtacagcagaaagtatatgc

SEQ ID NO: 469815 - DNA, 809 bp, Homo sapiens
ctctgtttgcaattgaacaggactgaaaataacagaactcagcaccatgatcggaccgggacaatcagattatttcattcctcagcaaacggagatcgatccgaaaagtggaaatatgagctcttctttggtggcactgactagtggagctgtgacatgtgggtcaccatcccccagacaccggaaaggtagatccgctgacagcatgcaccatgtgcctagaaaaaactgcaggcactcaacacagcccatgaaaacagccttaggagctataccctgcagagccacagggatggagctgcctatggctgtgggaacccaccccttgcatcaatgtgccctgaatgttagatatggagccaaaggagattttggagctttaagatttaatgactgcctggctaagttctggacttccatgggcactgaagatctatgtggaatcaaggaggctagcaagaatacagtatacttaagaatcacctaaatatatgccagtgaattccaactatatgtattgccaatttcactctctttgccaggtccctaaaatgcctgcaaccactctaataccaccctactcaagtggagaggtggtagagaggaagtcagtgtggaaaaggcagtgttcttaacagattgcaaataaaatatttcgtgaatttgtaaaaagtagatgacaggtctagcttctggaaatattaggatatcatatagaaaattaaagcttcttccaaagacaattatgctttccagacaaattattttttttaaagtaactgtttgaagacacaggagggtgacccaaa

SEQ ID NO: 469816 - DNA, 668 bp, Homo sapiens
tttgttacttatgccaatttctgcagcaggcttgaatttctcctcagagaacggggtcggcttttagggatggagccagcagtagaaatgacaaatgtgctcctagagggtaatgtaaactacatggaattgggagacatccaacaggaaatccgagagatagagcctgattatgtgactgaattgctgctatctcttgataaaacttggatgcatgaggagctgcttcttatggatgaacaaaagaagtggtttcttgagatggaatctattcctggtgaagatgctgtgagcattgttggaattacaacaaaggacttagaatattacacaaacttagttgaaaaggtgacagcaaggtttgaatggattaactccagttttaaaaaaagctctgtgggtaaaatactaccaaattgcttcacatgctacagagtactctttcatgaaagcaaaggtaaaatggatgcagtaaacctcactgttgttttatttcaagaaattgccatagccattccaaccttcggcaaccaccaccctggtcaatcaacagcctcaacattgaggcaagacctttgaccagcatatagattaaaactctctgaaagtgcagataaaggtattttattcttaaaaataatgattaatttaaggtatgtacttttttt

SEQ ID NO: 469817 - DNA, 815 bp, Homo sapiens
aggggtggttttgcccacactgttcttgtggtagtgaacaagtcttacaagatctgatgattttatcaatgggagttccccttcacaagctcccttgccttctgccatgccccctgagagttatacagaataccttccagaaatatctgactgtagggtcgtcaggtgaggttcctctctgccagatcctttctttcacggatttaggtttggttctgagggctgcaactttccaacgcttctgggctgcatttgtgtgtagatccccacatcagaaagcaaaaatatgggatttagccatctggcaatgtccagaaggggtctgcctattccattatattgataatattatgttaaccgctggttctcttgcaaatttagaagcagcagtgcccctcttgcagcaacatttggcagcatgtggttgggccatcaatgaatccaaggtccaagagtctgtattatctgccaaattcttgggagttatctggtcaggtaaaataaaggccatcccagaggctattaatgataagattaaggcatatccccagcccaccacggtgaagcagctgcaaacttttgtgggtctcctgggatattggcagacatttgtgcctcatttagctcaaatgataaaatctttgtattggttaacaaagaagggagctacctgggattgggatgatgtggctgagaccaccttcctggcagccacgcgattcaactcagcaggcacaagtcctatgggtagttgaccaggggcacctgtttgagctggatgtgcatgggaccaccaatggtttcaaatggggtcc

SEQ ID NO: 469818 - DNA, 1633 bp, Homo sapiens
agcgcccagagagagagtaaagccatgtggaagctttctgtcatctgtgaatggcagtgtgttagcagctcagttggccccttgcctcatcatgtggggcagacactctttgctggtgaggacaaagggccggtgggacagcctttctgggtacctgcacttggaaaacaggaattagggaggggtaaggaaaaggatttggttaacaggaagcaggtgattggtatggcaatcatgatgggtgagaaatctgaagtgtcattgtacagatatgacgatctgggcaccagctggggcagtctccctgtgggctccgcagccagaccaggtgtgggcaaacgagtgcaggatctggctggccactttgggtgctggcaagagcaggctctggcgggccccacagcagcactgagctccgctgttcatgtacagagctttgctgtcagctcagtgggccccttgcctcatcaggtgaagtggctgccactctacgaggacaaagggccactgtgacagccttttttaggacaagtaggatggatatacgtcttctaagccacacaattattttacctgtgctcatgtctccatactgacttgtgatttctcaaggggtcttgctctatcagctctgtctttagtggctgtcttagttaacttgggctgctgaaacaaaatgtcatagactggttgacttaagcaaccgacattcatcatttattcctcacagttctggagggtggagaaattggacattttcagtgatcaagaatactatattttgtaaatggaaatacaactactaaaaccagaatgctataaatacaataatgtcttttgtttccaaagcggatacactagagtgacacaagaataataataaagtgaatattttgaataaaattttcaactttgaataaatttcaactgaaatataggtgttgccttacgtaatgttaaataccacacatggttctttaggttgatttataaaatagtttttccaagggcagacatttctaaaatataactgataagaggcatcagagtgcaaaagaacataatatgcagaattttgttttgttttgtacaagagctacataactaaaattttgtattttaattacattctgtctgtatgtatatgtatgagtaaactcagataactacaagttctatttcaattggtaaaatatgtcagctaataataaccttacagtagcattcagagtaatgtctgatgtttaacctttgacagaatgaatttttaatgacttcactttgatttcacaaattggattttaaaaattaacctgtatcaggaatcaacagactttgtatttgaagttatctgatggcattgatatatactgggatcactttattatctatgaagttccattagcatagccacatattgatggttatttcatttttcatagtgcataagaaaacttgcagatgaatatagtgaaaaaatttttggaaagaaatctttgaatgcaaatttggttttcatagggaggtgtgtaaacacactttcagcagttactcttgctaaattattatatttgggtgcacattttttcacatgtcaactagctttatactgattgttcaacaaattcaagtc

SEQ ID NO: 469819 - DNA, 3753 bp, Homo sapiens
agcagccactccagatgggccgctgctgccatcaaaatccaactggtaactatacacaggcgaaaatacctttgtgaatatcccagaacttgagaatgaggctaagaccctcacgtggacttggacctaccctcatccttgaagcaagcccaacttcatgcatatatgtcaagcataagctctgcccctgcccttatcatgtgactaagcagcaactccagagacttctcccagactcagagctcagcacatggccctaccctacaacagtattgttcagccagggaagacaactctgcaattctgccttatcagagacaatttcagagctcagccagaagctcaacctgatgacagagtttaaccagtggtctcattggacaatggagcacagccagcagtaccatatgactgcagtgcataggaagttatctatcccagctatagaacctggtaccaagaactgcctgtttgtggctcctactagccagcccactcagaatcctgggctagactaaatagtaaaggtctatcactaccaaagatcacctgcaagggctggaaaatgtggccatctcctgaagtgttcagacacaactgtaagggtactaaaattatgaaattctaggaaaataggacaccactaaaagaaactaatgaagctccaaaaatggacttagaggaaatgcagatctatgaaatggctatcaaagaatacagaattatcctcttaaggaagttctggaaactccatgaaatttccaaaaaaaaaaaaaaaagaaaaacaatttatgagcaaaatgagaatattgacaaaaaaatcaaaacaataaaaaaagtagacattttagagataagaataaataacagaactgaaaaatgtaataggaggtttcaacagcagacttaaccaagcaaaagaaagaataattgtgcttgaagatagcatattgaaaattattcagaggaggaaaaagcaaatgaaaaagaatacagaaagcttatgggaattatgaaacaatatgaaatgaactaacttttgcataatagggattaaagaaagaagaggaggggaaagatgtagaaagcctgaagaaataatagcagaaaattttcaatgtctggaaaaaacagcaacatctagtgtgcctacagtggtggtcttctgtttatactggttggtgttttttaagctttttgattatattgactaatattttcatcaaactgacaaaactacacccatgattaattcatgttaagttaatttattgtcaatattctctacttttgtatgcatttatgtttccttcatgtcttttcatggcttgataactcatttccttttagcactgggtaatattccattacctgaaagtaccagagtttattcaatcacctactaaaggattacatcatattatgttttggtaattatgaataatactgctataaacaactatacccaagtttttgtggtgatataagctttcacctcttctgggtaaataacaaggagcataatttttgaatcgtgtgataagaatatgtttagttttgtaagaaactggcaaaccgtcatccaagtgactgccattttggattctcattgggattctcaccagcaatgaataagagttcctgttgctccacatccttgaaagtatttagtgctgtcagtgtcctggattctggccaatctaatggctgtgtactgctatctgattgtcattttaatttccatttccctgatgacatgtgaattggaagatcttttcatatgtttatttcccatccatgtgtcttttttggtgaggtataagtgcttggaccatttttaaagtgagttgttgtattagtccattttcacactgctaataaagacataccctagactgggtaatttaaaaagaaaaagaggtttaatagactcacaattccacatggctggggtggcctcacaattatggtggaaggtgaaagacatgtcttacatgatggcagaaaagagagaatttgtgcaacgaagctggcatctataaaagcatcagatttcatgagacttactaccaccagaacagcatgggaaagacctgccaccatgatgcaattacctcccacggagttcctcccacaacttgtgggaattatggaagacagaattcaagatgagatttccagttgctctggggaaagccagctgtcattttgtgaggaccgtcaggcagcctgcagagaggcctatatggcaaagaagaaacatcttctgccagcaaccagaaaggactgatgatttctaacaaccatatgagttaacctgggggagaattctctagttccagtccaggcctagaaagactgctgcctggatggcaggtggaatacaacctggtgattgagcacaggacagagcacctagaagtttcttcctgggtcactgaccctgagaaactgtattatataacacatttttttacgctgctaaattttaggataatttgttacacagaaatagttcattaatataagttatttagaagaaagctatagtattaattttgtatttagctaatgggttgtaaaataaaattattgatagtataaacataaatattaaatgtatatattccttttggcaaattcattcagaaaaacttggaacatgaggttataaaattctagcttattgatttaattattatactcttattacatgggaaaatgcagaacattttttgttctcataagatatattgtcattcaacaacaaaatatgacgcttgtatcttctgatatgtttttttatttttagttacatgaagatagatagaaatataggcagacacgtagaagtcagatagagagtgagaaagataatgagagaatgtttgctagtttgatttccattatagttgtaatccatatatggcatttcatttcagaatacataatactggaaataagttctgattttgtctttttgaagaccacttttttcttggaggaattatcatttcatgtacccagtttctaaaactctttagcaattaagacaccaatactaccatatttaaaagatctaaaatgaaatatggcataagctctgccatatttaactatatttaaatcatttcaaaatgacactactatgtataatacgttattttctatttattgctttcaatacttcactcattttaggacatatattactttattcaaaataaaccatctggatatgtcaagaaatgatattttcatgcaaagtaaaagaggtataaaatgtttatctctatactgaacttgaaatatatgaacttgcaataattgatttggtactaagttatttccagtatcattaaaatagaagagattttattcactaagttgatcttataaggcaaagccctattatattgtactaattatggtagctgagcagcggaaaataaataaatattttcataccaatggatatctggctagttaataccttccatcacttttacttggcaggtcttgccttagcacaaaattgtccctctttctaataggtccaacatatctatcattagtctacttcctctttgcttttgaagatattgttaagtccattatttcctaaaatggaaaatgtttaaatgtcagcatcatataaactcattttaatatttttaactgctagtaaatcatcaattggtctacaaagagccctagttgaatatactattaagtttggatgttgccatgaac

SEQ ID NO: 469820 - DNA, 3977 bp, Homo sapiens
tgcaaggaaaaatatttagaggctctctctcttgcccactaccatgtaacaagtcccttcgctctcttttcatcttctgtcatgattgtgaggcttccctcgccatatggaactgagtcaattaaacctctttgctttataaattacccggtcttggtttcacatcactggggatacctcacaatcatggtggaaggtgaaggaggagcaaaaacatgccttacatggcagcaggcaagagagcatttgcagcttacatctttctcctgtgctggatgcttcctgccctcaaacactggactccaggttcttcagctttgggactcggactggcttccttgctcttcagcttgcagacagcctattgtgggatttgtgattgtctgggaaggtccagaagatatacccttgactaaagctttgcaaaacagatttgtgagtgtagcacctgcatctttgaagagccctgtaatagctcttttctgtgccattaagaacattcatgatacattggagaaggtcaaaatatcaacattaacaggggtttggaagaagatgattaaaaccctcattgatgacttcgagaagttcaagatttcagtggaggaagtaactgcagatggggtggaaatagcaagagaactagagttagaaatggatcccgaagatgatttctctaatgggtctagagtagcttatattcgccagtgcattaagccctacatctaagtaaaagcttttctgacactttgagtattcaataaggttgatccactctggctgatagattttcaatttctcactaacctgaatgtgggttattaataataaagatgctgtatgcattcatgtgtagactttgtgtaaaaatgcatttatttctctcggatgtatgccaaggagtataatgctggtttgtactgtatttgcatgtttagttttttaaaaaactgccaaaatattttcagagcatttttgctatttaacattaccattagcaaggatgcagaatgctgacatctcatctatggccttaccacccttatgtgcctgatgttgtctgacctcagaagctaagcagggttgggtctggttatctcttttgtccctcatgtactggttgcttcgaagagggaatacaacataaaaataggcctagttttaatcatttgttccttgtaaaacttttctgattgacttcttgttcaggatttctctgacctcactgtgttggacctgccttccttcctgatctatcaaattcaagttttgtatttttttctttgtactatacgtatattttctctcatcttttttcccccagacaatcaatctctttacttcttgcaattacgtatgatttaccttgtagaattattaaagaaaattgaatatacatatatggacatgtttcccaaatctattctgatctttttatgtatacatctatatttaaagaaacagcccactatgttgataaatgtaaatttaaaatatatcttgcaacaaggtaggttaaaacttctaactttgtttcttgtaaccaatctctctgaaattctgtataaattttaaaatcatcttttcattctctcttataaatccaactatgattgtaattgggaatgtgtttaatgtatgcatcaacataatgagaactgacataatcatacattactttcaggactatgaacctgaaataagtttacccatgtatattttcttgaatttttctctatagtttcttagtgtttattatatagcacttttatatatgttgtcaaactgaaatatttcatatttccaatagtactataaaatatacttacaatgctactataaaatattttttaaaattatttcatttttaaaatttttctcagcaaagttttatggtttttattatatagcacgtaagcatatcttatttaatttaaacataaatctttcctattaataatcctaatataaaatatttttaaaaattcatttcagctttttattgtgcatatgtagaaatacaatcaatttggtaccctattaccttgctaaattcacatattagttccaacatcttttctataaattcctttacagtgtctgcataactttcatggattctgtaagcaaatataaacttaatttactttgcaaacatatttgccatttatgtatggatttttttgttgttgtttattgcacatgctaggacctccagtataatgttgaatacataggtgctaaattttatcaaatgttttgtgtcttttgtcatgattctacattttctctcttttagtttcttaatatgttggatgttattgcttgatttgcataacagttaaacttaccttttattactgagataaaatgcaatttacttttatatattatcctattaacatgtttctcatttcaatttgatagctttttaaaacaatttgtgaatctatgttcacaaggaatattaatatttagctataatttgtttctttgattttcatcttgaggcctttctgcttgtgacatcttactctatcgaggtaatatcaggttgacactacttttgtaaaacaatctggaaaatatttattcctcgtttattttctggaagagtttttctgagttttgctggtattaattatttcttaaatagctggtgtaattcactgttaaagtcatacaggcctgcagttttatttataggaaatattttaaatgataaatttaactttttaacttgtgtaggtatatgcaggataccttttttcttaattgagtttataaagatttcttggaaagtaaattttatactgttgtttcataaataactagcatgatgaacatgagggctttgaagggttatatattcttattcttttttctaagataaaaaaaaaactctgccatatattagtaatcaggcttcttaatcttgcaggcatacactgttctgaaatagagctgcttcttttgggatagactcagatgtacactggctattaaagtggaaaatatcattttccttaagccagattgtagctataaattgcatttatatttttgaactgaattttacagaaaatcttatacattactatgttgtttggaaagtacttcttctgatcttattttctttatttttactttatgagaactatcctccatttcaaaacatatttttgctttttataacatccaatcgacgatacatgtatccattttctctttctccgtctaatccctaatataaagattcttattccaattcaacactattgcctataacattttctaggcacttttgcatatattgcatcaaatttcagttaggtccccttgatcagttaagcaactcctcaaataagttcatttctttcacttgtgagatcataactctaatcaatggttgacaatgcctgtgctttaaacaatgttccaattcatgttatcttatctgtttacattatgtagccagttacttaatttttgcatctatttctattctaatgtctaattttgaacattgatgaagaaattgcattttcaaaattcttccattataaataaaatttattctacctgcttttcagcctcaaaggttttgacgtatcaatactcaccattcatgtccacttaccagaggaattattaatttgtactaaagtgtgaaccatatgtcgtgcatactcattatctctggaccacaaactataatccatttcaagtctcttctcaagattattttagttcttttcaacagggagtctgaaattactattgtatatatttttgttattgttagttctttaactgtgtgtttgagaacatctctgatattcaatttggtttcagttatgtttttcctcagggtttttgtgaatattatgcaatatattgattgatacttaaatgtaaaaatgtttgagttcctggtataaactcaaatgcaaataatgtatttaatcttttatata

SEQ ID NO: 469821 - DNA, 4067 bp, Homo sapiens
ggagacctttgacttcagaagatattccgtcataaacaacagaaaacaaactaagacagtgtgtctttctcaggatgtcctgcaatattctgaccacgttgcaaagttgctttctaggaaaaatcttcccctataatggaagaagtcacaaaagttggaagtgtgagaacaattccacagaccacttctggtttgaagatagaggtctcatgagaggaaatgcaggatttccaaatctgaaatctgtccgggaactcattttgaaacagggacaagccaaggtcaagaataagaccattcctctaacagacaacacagtgattgaggagcacttggggaagtttggtgtcatttgcttggaaaacctcattcatgaaattgccttcccagagaagcatttccaggagatctcatggttcttgcaccctttccacctctcagtggcctgtcatgctaccaaaaatacagtggacttcctcaaggagatggactcacttggccatcagggtaaacgcaccaatcagctcatccaccagctgaactagacccaggtgccaaactgcagtacatttttatcagtgaagtggaagcatgtgtttttgcttttttgggaatttttatcaagtatcttcagagaagattatttcctgctttagtcttcaaaaactagaaaggaaggatcaaagaaaagacagtaggtcattttcatggcaagcacctctcatcgcagtccagttccaaggaaaaattccagtgttttctacattggctgctgcctcctctgaaatcagcacattccacggaggaaggagtctggctttgttgcatcttgtctcctagtatttaatgttggtaaatgagtaactctagcatttgtacaaggctccctaagactccagcagcagttgatctagcccagggacataattcaatctggagattcctggtgccttgttttgaaaaagatttgaaatacacataggaaaaaaggcacctaaataaatgttcacttgtttctgatgtgaaaaaaaagagatttttataatctgattgacaatgagaatagtgaaaatattgaattggttgggggttgtaagcaaatttttgtggaaagaatgtataaaggaaattagaaaatgaaaagtaaattgacacagagttatatgtttgatttttgagaagaacttagaagaaaattcagatactacattttatgcaaatgatacttctcaacaaagagttgtctttttcttgttggaatgcatagaatgttgtcctctttcctgacattccaatttattaagggcaaagacataaattccatttttctgtcttttgaagcttgaagccttagtgcttattaagactaagtctagtaaataatgctttacctagaaattgtaaataggttagattatttcttggagaaaacaagtctttctaaaaataaaattattaaagaatacctttcagataaactttccttcacctcatttacttttctatttctctatttaattaatttatccaaagaaatgatcattttagtaatgattctgataaattaatttaaaatctttatttcatcttgccttctaattcaactttgattagttctaaatgaattagataaataaaactaagggagaaacatttgcttagccattgatacttcattagtacattgttgttatgttttatttatattacataatttactcagcaaaaattatgtactccagtctttttgtctggaattataacaaaactggaattgtgacagagaactattttatttcatctatactcattaaaagaccaaggcatacaagaaaaactatattttaaataatattaggtttttataatttgggactaaagatattcaataataaatttaaaaaatatactttttatctagattttaagacaaaagtattgtccactgtatatcactgcatgaccctaaaagatttctgaatccatacaactaaaaagaggccaaatatcaaagggatatcaaatacgatggcagctttttctctgccattactgacaacagcttccaaatcttttcagccttaaagctttggagatcaaagaactatcataaaggctcctgacacataagtgtgatctctttaaacattatactaatccaggcaagaaatatacagtgaaataacccatgttcctatattcagtgttttgggtagatatacctgcttatttaagttgcatcactgaggagttttcaagaattcacctcgctacttatttacatcatattattgagagaaaaaaatgagagaatagttttgagcacttcatctgcacaatcaccttcacatctttttgtcctatgcttttctcacattttaaaaacaaaaactgaggctgacaattatgcccttattgtcgattttagtattatttatgtgttagttatgttttattatttaagctaattttacttccaatttacaaatatactttgaccaaattccatgtccccttgcccagttatagtccatttctcaatcctgagttagtactcacagtttataacccgtttgcctttatcatactctccattttcttcaaataccatatgataccatatgtaaatgttagattttctaggttcttgcatttataaaaacattttcgtggcctccatttatgaaagagaatttggctggatgttaatttcgtgtgtcataaactttgttatttaaagatctgataacattcttatataaatattcccgacattcttatataaatattgttgagaaatcagcaatccagtacttgttatttgataaaaaaaaaattttacttgacatattatgatattttatccaactatgtaaaaatgtatatgtgatatatttccaggccctctaaagatctcaattgcttttttcggggaaatatagtaataattgcttctttaaaacgtggctccttaatcatcttggaaatatttggtttatagctttcattgtgattacacttactcatttttccaaagtgcctgcgttcttatgttagagttctgcttttttacgtatatatcacctcatccctccttcttttcaaaaagattttctacttgcatttagagagatctcttctgcatgttcctgattcatattttatctatcagtattaattttacaacttatatcatgttttttaaattttgctgttggactttttagggaaaaaaaagctgacaatcatttttatgctcacactacctaatactgtgcttgctgcttataaaaagaataagttaaatcattagtcaattgcttgagttcctcatacctaacttaaaatagcatactaagaacaacattatagctagtttccaatgatgccaacattttaaaaatgtatacggtatacatttatataaatgtataatttcaaagtgtttgcaatattgcaataataatttcaaagtgttttctgatttcttttgatttgttcttgtgccttttgtaccactgaatgcaatttttatttaatcctgcaaaaatattgcaggatgttgctgcaatatagcacttcattgcaaaactcttgacttcatgtttgcgccataaccatttaacatcccattcaaatttgaagattgtaacttttaaaatgtattagctgtaataaataaagcagaggttcctttttatttcattaagcaaaagcataaaaagacacgaagtgaatccaatttgtgtggttcctgttgttatattctcagaaatagtcattgcaaaagttttagtgagtatacatttacttccaaatggtttaagtagtagaaatttaagcaaaataaaatacttaatattatgttccttgctaaggtttctatttgttccaaggtataaaagcaatacttttaaacctcattggaaattctgaaattttgattcattctaaaggagcagttaaacggtgtcgtgctttttaaatatagaaaagaacaggattataataattacttttcccgatgatattcagatgtgtgcgtttaggaagacaaattatttcac

SEQ ID NO: 469822 - DNA, 785 bp, Homo sapiens
ttcatctttcatcttcatgacatgacactttatcacatagtgcgacacctgctgcaggcatggcttttcttgcaggtcatcccaccaagtgtcaagctctcagcagagaggagacctgtaacgggtagtccctctctacaggcaggtcatcccagcaagtgtgtagctcttggtggagagaaaatccgcagggagagttcgtttctgcagggaggttgtcctgacaagtgtgtgagtctgggtttttttaatgtgctcagaatggaggaagtatatgttgattggtctatgggcggccacaagtttcaggccttccctggcttgaaggtggggtttcactggggactcgccgcttcctgcctaggaacctgtctgcctttaacatgccatcagtggtgtccaggctgtccatgctatgaggatcctgcagtccaggaccaagctgccttcagcaacccctggaccccctaccaagctgtttcttaaattctaagctggggtcatgtatttggaagttttccttaggtgtttcttgctgttgttaatacagtatacatatacacacatatataaatgcatatacatagttaataccttaattatctccaaaatcgtattttatttaccattaaaggggacaccctaatattctttaaatacttttgtccttactgcattatttatctaaatggtatgttatgatcttttcagtagtaactcataataatttgctctcatttagtttgcaggaaactttaaaacctaagtaatatttttactatatt

SEQ ID NO: 469823 - DNA, 991 bp, Homo sapiens
tacaaagaattgcaaatatgctagaaaaagaacaatttcagaagagaaaatattcaggagagcctgttgttaccaggggtccttgctcccagagctctcaagatggtggcgggccacttccaaaatggcgggtggcttccaagatggtggcaagactcacgttctctgacctggggttcttggcctcacagatcccaagtattagaatctggggccatgctccctatcagaagtggcaatgggtgcgtcactggatcagaagcacagcagacaccctgccggatccagagggatggaagttagcagtgggtctacaacggcggcaaacggcagtggtggacggcgagcgaaagctcagctcgagccgtaacaaacacagaccagaagatagttcagttgcaagatttaatagagtgaaaacagagctcccatacaaagggaggggacccaaaaagggagctcccacacaaagagaggggacacaaaaagggtagccattgccggctagaatgcctgggtttatatcctgatcattttccctctgctgtgctctcaggcgatagatgattggctatttctttacctcctgtttttgcctaattagcattttagtgagctctctttactacctgattggtcaggtgtgagctaagttgcaagccccgtgtttaaaggtggatgtggtcaccttcccagctaggtttagggattcttagttggcctaggaaatccaggtagtcctatctctcactgtcatcttagaacagagagatttattacactgttcttttcaccttgatcacaagttatttctgcataagatggttatcttcccatttcctttgttaatgggaaatatactgtaatttttttatatgatggtttggttttcatattttatttatttaataaattaatgttatgctatcattcaattatttttcaaatctatttatagaaattcacattctggggttttaaaatctaaaaa

SEQ ID NO: 469824 - DNA, 1891 bp, Homo sapiens
ggtgatcagcctgacgtggatggtttacaccatcataatgtggcaatacatcaaggctttcctcaattcactatggttagatgctgctgctgacgcgacccaaactgcagagctgaagcatacatggcctttgggagaactttgcaccagccgtgcaaagtattgcaacctagttggagttgtaattgtgacttcaaaagaccattccactgttccatcaatccagctgcttcaggatgatggggaaagtgggaaagggtgcaatataatcaacctgccaccaggtagctggctgatcacccagaggaacggtaacatattgagggctcagcgttggtctctgctgctggcaaattgggcactcagcagtggttatagccaggtcagccttgtcgctgatcatccagccaaaccactggctacagcccatgaatccttatataatcgcacatctggccatttctccttccatgcaaaatgcataaccagatgcactgctcaaagttctgccaactgggaagatttcctttcactgctgttcttcagggatgtcctagaaaggggctgtagtgcagctgctgtccactttcgggtagtgcctgcatattgtgcagaatcatctgtgaaccagatgtgtccagagttccttcctttgggtgtgttcatggtcttgctgacttcaggaatgaaaccacagaccttcacagtgagtgttacagctcttaaaggtggcatgtctgaagttgtttgttccccccctgggtgggttcgtggtctgacttcaggagtgaagctgcataccttcacatgccttcaataaccctagcccctaaatattatttatttccttacattcactggtagtgttagtaaatagaaaagtcatatttttctgaatattggttataacttgtttggctataatgtatccaacacattttactgtgatatgaaaaaaataataaaattattatgtgtcaatttagaatctgctttttcccaaatttattgataatgcttttctgaaccccttcaaatttaactaaattttaaagatatacctccaggtagtacataatcctgaatatagtggaatatctgcaaacacaagtctttgcaaagaggcctgagtttcagcaattttccatggcacctctaaattttgaaaaactcattgtataaatgaatgtgtttatccactttcctactctaagagtatctgctaaactgaaactgaactagcttcctactaagcaatctagggcattctgtatataacagaatttaaacaaaccaatcttttgcaataatctgcacacatattaattttctctgattttatctgccctataacaatactcaattaacatgggcttggtactttgagataatactattaagtagcaattctttaatgagatccttcaaataattgactttccttgacgaaaataattactgtagaacactgcccaatcattctgggcagtgaaaatgttagatgaaactgccactctagcataggttatttcacatctcaataatgaaggataaaaaatggctctcagctaaaattttgtaggtattgtagaattataggagctaaagctattcaaatcagaccttttgtcttttaatcagctagtgtaagacagaagttgcctcatactgccttgcagcctctatctcctggtttcccaggatgcactaaacgtgtagttcaatttaaagtagttaccagtcactggctgaaaccaccaaatcatgaaccaaacctttaagtggaaggagctagtccctttaattctggcaacttttgatagattagtagtgttgaataatattcaatagcagtgtactgttcagaaattctctcatctccaaaaccact

SEQ ID NO: 469825 - DNA, 1695 bp, Homo sapiens
aacctactggcagagaagagctacgcacttcaatctttctgctaagagctgcagagacgatgggatgacctggctgcagagaggagccacccactccagggccttctttttgctgacagctgaacactcaaggggacaacctgcctacagagatgagctaccaactgcaggtcacctctcagctgttctaacactccatcaagctccacgtcatctagcacaccctccacttgtctgcatactttattcttcctggatgcaggacaagaactcggccaaaggcaccacgggacacagaggtttccagccagaaaagcaacaccccaaagatcctggagaggaagataaaggaggattttgcagtcatcgcacagtcagattttacttttccactcctaactctctcctgcatcatcattccagggtccatacaactgcaggagcctttcaggttccctcaactgaggggacctccgtacccatgctgacccttcgctgaggcacaactctatgaggatgctggctggattgttgctctctgtcttccaggtaatagctgccaataggcatccccagagggagatcagtaggagggaatagagtgaggtcaaggaatctggttttaattttataaaaaacaaggcatggcaagaaagaggatcaaaatgaaaaaacccagaagaaatgagtaagatagcaattcattcccacaactaatacatatattcaatttttcagaaacaaagtttataattactttgataagactgttccttaccttgtgagaaggaacgaggtgcccagtttccagtcagtgaggtcactgaaaatgcaggaagagtataggctaggggaaagcaaatttgtgcaggaaatcttagtggaacagcattatgtggagtacataaagtatatgcaaacgtttaaaagagtggattagtattgtattgcataatgtaaatctaaatctatttatgtaatttattatttctttgtatctttttaggcaataatcacatttatcagcaaaaagcccacagagtttaactaaaagaaataataaaatttaacataacatttaactactgactttaatttactttggacatttttcatgaatttgtaactagaaacaaaatctttgagaaagttattcatgttaggggttgtaccaataattctgacaagatgaaaaccaaataacaccagactaattaagaaatgccatcatttacttcaaaagtaaaaaatgtatttaaagaaaatgtgcccaaaagtgatgctttcacaaggtacaattatagaaagtacatttctatttctgtgaaccctgtcacagaaatataatggttatctattctatatgtagttagaaatacttttatctaaatctcacaattatacttccatattaatattgctcatttttgcaagtatttggcacatacatgcaaagtgaagcaataattatgtattgactttattatcagaaaccttccacaaatgactagttttacatcaatattatcagagaattcagaatgaaaatcagtaagaataaatactaataaatgttttgaatttttaatggaatttattaaatcaaagtcaaatttttgaaagttcattttgtcaaagtagaaaatcttcattattataattgtactttacattcagttactattttaataatgc

SEQ ID NO: 469826 - DNA, 801 bp, Homo sapiens
tgagatgagataccatggaaactcccattttaaaaccatcagatctcgtgagacttattcactatcatgagaacagaatgggaaagacccactctcatgattcaattatctaccactgggtcctttccacaacacatgggaattatgggagctacaagatgagatttgggtggggacacagagccaaaccatatcaggccattaagcaacccccaactttatcagatatcaaaatagcacataacattacaccataccagagggaaggtatagctctgcagacttggcaggaaataccccaagccatttcagactcttattctcagatactctctggtgcccaagataattttctggatgaattctataaaccagtcactgctcagaatagtgaccagctaatagttttcaaaagatgttcttcaaagtcttgaaccaatatgtctctcaccttttgccaagcaactttgaatgtttattggggtgttgagacatgcttttgattttctgacactttatatctctgccttagccttcacttcctactaacatagagcattaaagttagacaaatagaaaaagttttcagacattgttggtttttcatgggcaatgaaaactcttgcacatgcccatggctttctagatcccaaggaacatgttagagcttttgaacactaactagatttacattatttcccagattttgtttttacatttttgtctagtctcctctttatttcatccagtatcacagactaaggcaactgtgatattaaacaatagcaactgatttatttg

SEQ ID NO: 469827 - DNA, 1453 bp, Homo sapiens
accacatctgaaacatcatggctgggcaggcctcaggaaacttagaatcatggcggaaggagaagcaaggcaccttcttcacaaggcaacaggaaggagaagtccgaccaaaacctaatccagagcaaggcctaagtatcttcaactctatgaaagccaagagagatgataaagctgcagaagaaaagtttgaagatagtggagaaggccaaaatatcaacattaaaaggagtttggaagaagttgatcccaacgttaaggacaactttgaggagtcaaagacttcagtggaggaagtaattgcaaacgtagtggaattagcaaaattcctaggattaaaagtggagactgaagatcatccctctattcatatcaaggcatcaagtgatggcgttgagtctgattacacagccaggcctagagctacgtgacgccagtcattttattttctccttttgtctccccatttggttcagagatgagcatgtgacacaaatcaatcactctgaatctcaggatatattttgtgtaagattattttggtatttctctaaagttgcaatatgtaatatattcatgattgtgagttagttgtaattttttctaatttccattctatttgatcatgatttctatttaattttctattttctatttgatttatggttgaagaaaaggatcatccatactgtgtacactattttaatcatattttgacacataacttatttatattgtaagaaataagtgtgttctatcacataaactctaaatattgcacaagtaattttcacaagcatgtcatatgtttttctgtaactgttgctttcagacttgtacatagctaagagattaaaaatttaaaaactttaattccgtttagcaaatttgctatatgtctgtagctttttgttgttgctgttgtttaaattaggttgaactgactactaagacatatcagatgtttcattttgatgatcaattggtctatgattttatgtataaaataagactaggcttttagctataattatttttcttgtgtaaattactattcatataggaattctttaggtttgtgtatttaggtacgtattcaatctctttttttaaaaaaggctggtttaagaataatttcctccagaaattatttatatttgtttctgtcagaaatttaaggtcagccacctgggaataataaaccacatgtttaggctgtttttctggaaaacgtatattacatgaatttagtgtaacaacactttttatctctggtttatgttgaagatttcttatgtgagatgtttttccatttatttttgcattttatggtcagttccaaagataaaattctagtaatccagtgatggttagggaagtggagacaaagagcttatagacagagttaattcaaatttataagaaagtagtctttgggcaccagactgtcaac

SEQ ID NO: 469828 - DNA, 949 bp, Homo sapiens
gtaacacaaacagtgatgaaacatgcccgtcattcaccatattgtgggtgacaagaaggagaaaagagaggaggagagaaaagctgtgggacttcagggaccccagataggagctccccgaaccagggtggtgataccagccttggggctctgtggttcctggtatctccaagcttctggacactactgtgtttcttggtgcctgaagtggaagctgcctggtccggccacagccttgcagggagccagcacccatgctggtgcctggagctgcctgccccgccacagctgttgtgcctggctgtgcgcagtggcaggactctgtgcatgctcgctcactcacccctctccactctgtgcctggctcgcccttggcagttgtgggatctgggctggtagcatgagccaagtgcagcttgccaggccaagtgggtggaataagcccaataggcccaagcaaaactcaggcaaaggcaccaccagccacacaggcttctggctggtgaagagacaccccaaggaacctgtgacagtatgcttttacctaatctatattcaccttctaataacagtattccattctaggtaccttatataacataattccagtttattttgcgtattacttatgacattgctgtcactcatattacatgtttaaatgcaacaatcactcaatggagtgttattgttacaacattaatatctccttagagaggccttatcttacagttccttccactgtaatccactgttatattagagtcctgttgtaatgtaaagttataggggaaaaatggctttatatttttattgttaaacctcgttcttttggcatgtttctctgggctgtgaacttttcaaatgtttatcagctatttttttccctttttgtagccagttttgttgctgtttcactgattgtttcattttcttcccctaagcaaag

SEQ ID NO: 469829 - DNA, 595 bp, Homo sapiens
gggccacaggtcttcaggcctgaggcttgagcggagcgttgatgggggtgatttaccaggaaaccagtatttccctgtctccttgggtactgtgctgcttttgcatggtagtgcccttcctgttactagaacttccttcccctggtgacatctatcacagatgggctgtctcaggcaggatggggctacaggatggagaaaccacttcagctattttaagcagaaagaaatttactactgaaagattagattatccaggagataatcaactaagagtcaggcaccctttcagttctgatgataaacattttacaacctgctctctctctgaagtctgctatctgagagattcctctggacaatatgaaaaaagagacattacaattgaaacaatagaaatacaaaggattataagagaccattatgaacaattatataccaataaattgggtaacctagatgaaatggacaaattaccagacacatacaacctactgtgattcacttatgaagaaagagaaaatattaatggagcaataaagggtaatgaaattgaataagtaataaaaagacccaggacctgatggctttacta

SEQ ID NO: 469830 - DNA, 496 bp, Homo sapiens
gctctgaaggaaatgtacaaaaagattaatgatgtgttcatgcccactaacagaacattcattctacagcccatggctcaaggagtaattttgatcttcaagccccagagagatgccttgctttttccaccaaaagaagacgcagctaaaaggcaatattatgaaccagaatgtaggcccctgctagttactgaaatcttttcatgccttgatcttggacttctcaatctccagaactacaaaagtggaggaaggtgccatcagacaagaaatgcagctatagaagctgcaaaaggcaaggaaacagattacctcctagagcctgaagaaagagtgaagccctgcaggggacaagaacccagaactcgccaaactgtgggagcaaaagagctgtaatgcttctgattgctgagctgtgatctgtaagaaagagctcaattcaacaacttacccttcaccttagaaagcatatctcaacatatcccatactacggtg

SEQ ID NO: 469831 - DNA, 705 bp, Homo sapiens
taaaccagttccaggtaacaaagctggcgttggcttggagctgtgggaagggggccaccgtcctccagactccagaatggtagatccactaacatcttggcaccctgcacctggaaaagccacaggcactcaacgccagcccatgaaagcagcaccaggggctagttgtgaagagaggttgtcctatcagtgcgaggaaaatgatacggtgctacagacagctgtcaaggaggtggcaataagagtgattaaaagggctcaggcattggtacacaacgtgtttgtggttatgaagatgaggtctttggagtggaagcctgtgaataaagatcttcaacctgagaacttagtggaattctggaagttaaaaccttcaaagtgtgaggcttccactaagacagctgaccgaggagatttttactctcacttcagcccatatttagcttccaacaattcatcaaaattacagttaagtgacccaaccagtttatgggtacaatgaaatgcttttaatcttttattttgttttcacaattgttatttaacatataaagttataagttcaaaattgttatttggaacccttgatgtttattaaattttaagttgatcttgcaaaataatctcattgtttgccctaaaataatcttgccaatcatttctaggattatcagaataattttttgtctcacagactaaaatatc

SEQ ID NO: 469832 - DNA, 586 bp, Homo sapiens
ttatagctccatgactgatcctgcagagcagtgcagctaccccatagatggagagaaagggcatacatctgaccctgaagaagtgaaaaatagccatgtggtgaactgcttgtgggaggttcaacaggttggtgactacactagacctgtgggatctgtgggcagcctacatttaatagtctgtaataatgtggactttcaaccatatagtcaaaagaaatatatgtatgtgtgtttgactgtgtttgtgaatatgaagataaaacagggtagttctatggaccccttcatggtacttgtgaagaggttgactcatttacgcagtccacagctctcaacccctcatgggaacgggaacacgcagcctccaaaaattgctagagcacatcagccattcaatattcgattggttttgcttacttctgatgatctacagagctatcagagctttaagcttcctggagggaaaaaaaagactcatttttataagttctgaacagaactaatcaattctttattttgttatttggaaaagtagtctaactagtggcttatctatttgatagataaggtttggctgtgtccc

SEQ ID NO: 469833 - DNA, 771 bp, Homo sapiens
attagttaccatcaatgtctggtggcattcccagcaccagcatctctgggctcactcagaggatgatatgttcaaagagctgaaggacaagaaactgccaatgaagaatactgtgtccagcaaagaaatctgcataagtaatgaggagccaaatgttaatcatcaagacaatgggaaaaatatctccagggaatgtcagagaccttcatggaagctcctcccatcacttatccaaaggcttaggagcaaaacttggtttcttgggcccagttcagggcccccctgctctgtgcagcctcgggacatggtaccctgtttcccagctgcttcagctccattcttggctaaaagggaccaagatacagctcgagccattactacagagggtgaaagccccaagtcttggcaacttccgtgtgatattgagcctgtgggtccacagaagtcacaaattgaggtttgggagcctctgcctagatttcagagagtgtacgaaaatgcctggatgtccagggagaaatttgctgcaggggcagaaccctcagggagagcttctgctagagcagtgcagaaggaaaatatggggttggagccaccacacagtgtccccactggagcactgcctggtggagctctgagaagaggtccacagtcctccaaacctcagaatgaaacatccactgacagcttgcactgtgtacctggaaaagttgcaggcactaggaagtgtcccagtggggactctgtatggggactctgaccccacatttt

SEQ ID NO: 469834 - DNA, 653 bp, Homo sapiens
ttgctcactcaccatttccctatggtagggagcctccctttgttccatgccaatcccagtaataagtggctcttattgctacttttggcaaagaagatgaactcagataaagctatgtgggctactttgaagtttgtatgttccttttcttcagaaaaacaatatccagatgaggtaggattacatatgatccagagacctcaggttccaagtcaatattttgaaatgcaggacactgttataaggattatcagttgcctatccaatatcatttctcctcatcttccattgacattgaatcactctgctattaggaacgccctatgctcaggcacccatgaagatggagagaggataaatagtgaaaaaggaaatgagttaggatttttggtaaatacctttaaaagaagttgggacagctggagaggtttacttacttttccctttgctgttgcttttcgtgtctggaattcagaagtcacaattaggggtcctgtagtcatatgatgactgtcaccagcccgttggtagagtcaatattctaacacaagaagcaagctttccaaacttgcattcttaagctccaatcttttgcttattgttcttgtgcaaatattaatcttacaacttgagactagaaagaaatgtatttc

SEQ ID NO: 469835 - DNA, 598 bp, Homo sapiens
cacttgtttatctgctgaccttccctccactattattctcaatgtttggtaagagacatgcttagattgtgctgttcctacaacgcaaggccagataacactttgaccaacttcagaaaaagtggaaaatttggactctacacagatacttcatggaaacagagaatacaggtacctccagagatcctcagatcacatattaagaaccactggattagaggaaagatgggcgctaattataagactatgataacacttgggctgttagccacaaacaatagcatgagtgatttacgccttaaggacatgttcctgctgcaggatcaagaaaacattctgatgtttcaggtttcacatccagagaaacaaattccctatggatatagaagggaaacagaagttcttgcagcttctcatttatttaccagcgaaaggaagcaagtgggtgactctaccagaaaatccagagacacttcccagctaggaaggatgatcaaagaatctgagagttgaaacatcttctaataaacattcttttgctagaaaactctggaacagaggcaacaagtatgcatttcaaagaagtctaaaaattatg

SEQ ID NO: 469836 - DNA, 1143 bp, Homo sapiens
gtactcttttttatttcaatgcgtttttgggaaatgggcacacagtgcaagttatcagtggatgtaccattctggggtctggtgaatggtggccctcttctcacaactccactaggcagtgccccagtggggattctgtgtcaaagcaccacccctacatttcccttctgcattgccctagcagaagttctctatgagagccccacccctgtcctgtctggacattcaggcatttccatacatcctctaaaatctaggtggaatttcccaaacctcttcttgacttctgtggaatatgggccgtccaaatgcatgggtgtttttgctcaggagaagaatgatagtgattcttctgatggatctgggcaaagtgaactgaaagctgtgtggaaagaactcaccattccagatgtgattaagaacattcgtgattcatgggaggaggtcaaagtaaaattaacagaaatttgcaagaagtgtacttcagcactcttggatgactttgaggaattcagtccttcagtggaggaaatgactgcagatgtggtggcaataatggaaatcaaggtgactaagaatgttgatggtcaaaggggaggagaaatggtgcagtagcttgttgacacagtactttggagaaaaccttgtgagtgtgttttactaaagaacactagtgtaaaataactactgctataagtacagagccatataattgatttttctcccttttccaacttgcaagcatttggaaagatccagtgattgattaaaaaaggttgaaagcatattaaatagggtccacttctattataaatgaaagatttgcttgatctttactgctctaccagtagcattttgattgacacgtagaattgtgcattgttatggttacaatgtgaggttttaatatatgtttatattgtgtattaatcaaatgaaggtaaatagaaaattaagtacttcaaactttctttgtggtgagaacactgtgaatcctctcttctgttttgaaatatatgatacattgttgttaattatagtcatcttactgtccaataaacaccaaaacatattcctcatatttaactgtaactttattttctagtttatttgcatagaggtgtttatagtattctctgatgg

SEQ ID NO: 469837 - DNA, 789 bp, Homo sapiens
cgggacacttgacacctgaacaaccaatgctcaagagacaagtgttggagcagcagatctgcagctgtttcccaaccatcgctttcaccttcatcactattcattgtttgggacagttcccaacaccctatcccaagactctggaagccctccacgtgcagcttactctggtgcacaatgatgtccactgggagctcaagtgcaactccagagcaggtggtcacggacaggaagctcaacccagtgcacaccttgaacgatttatagatagttttaagatgggaacaagagatggaagtttcttagcttcttcaggatttttgcataattggtttaagagttgtggagatcatccaaaaattaaatgtgcatgcatgtgggtgttcagcatctactgcatcctatttcagatgctgacagacagccacaagacaaaggggaaattagcctccaaggttccggctcaccatcccaagcagaatttaaaagggtatgttcagaggagtgccctggcactgggtcaatcctcaaagattaagctcctgacattcaacaaaatacctgtcaaaacactgaataaacaaaggtagccttcaacaatcaagataatcaaaccttgagaaagagagataatctgatatataatgctatcaaattgtaatagtccaaagttcattaagaacgaccagaaaaaaaaaaaaaaacttaagctacaatgcatataaaaaatagtgtaggcaaataatttctgactaagccctgaaaaacaaaacacaagcaacaaaacca

SEQ ID NO: 469838 - DNA, 1704 bp, Homo sapiens
acagagagccaagcagcagtgcatgctgcctatatacaaaggcagatactgtgtgggtaagcggaagcgcttccgcctctgcaacctgcaggcctgccccgctggccgcccctccttccgccacgtccagtgcagccactttgacgctatgctctacgagggccagctgcacacatgggtgcccatggtcaatgacgtgaacccctgtgagctgcactgccggcccgcgaatgagtactttgccgagaagctgcgggacgccgtggttgatggcaccccctgctaccaggtccgagccagccgggacctctgcatcaacggcatctgtaaggtgtgcctggttaggaagaggctctcccagcactgcctgcccccagccccactggcgggccccagaacgtggggctgtgactttgagattgactctggcactatggaggaccgctgtggcgtgtgccacggcaacggctccacctgccacaccgtgagtgggaccttcgaggaggccgagggcctggggtatgtggacgtggggctgatcccagccagcacacgtgaggtccgcatccaggaggtggctgaggctgccaacttcctggcactgcagagcgaggacccggagaagtacttcctcaatggtggctggaccatccagggcaactgggagaacctcacgtccccgggtcccaccaaggagcctgtctggatccagctgctgttccaggagagcaaccctggggtgcactacgagtacaccatccacagggaggcaggtggccacggcgaggtcccgccgcccgagttctcctggcactgtgggccctggaccaagtgtacagtcacctgtggcagaggtgtgcagaggcagagtgtgtactgctcggagcggcaggcagggcccgtggacgaggagcactgtgaccccctgggccggcccgatgactgccagcggaagtgcagccagcagccctgccctgccaggctaagcccctcaccctggcttcccctgcagtgctcagtgacatatgaggaagggactcagcaccgaaatgtcctctgcatcagtgacaccggtgtcccctgtgacgaggcccagcagccagccagcgaagtcgcctgctctctgccaccctgtcggtggcccctggacacactgggccctgaaggctcaggcagcggctcctccagccacgagctcttcaacgaggctgacttcatcccgtgccacctggccccacgcccttcacccgcctcatcacccaagccaggcaccatgggcaacgccattgaggaggaggctccagagctggacctgccggggcccgtgtttgtggacgacttctactacgactacaatttcatcagcttccacgaggctctgtcctacgggccctctgaggagcccgatctagacctggcggggacaggggatcggacgcccccaccacacagccgtcctgctgcgccctccacgggtagccccgtgcctgccacagagcctcctgcagccaaggaggaaggggcaacgggaccttgtgctcaggcccctgtggtggtggcatccagtggtcacacactggtcaagtgtgtcaacacccagacggggctacccgaggaagacagtgaccagtgtggccacgaggcctggccttgtgagctcccggctgtgtggcaccgaggattgtgagcccgtcgagcctcccc

SEQ ID NO: 469839 - DNA, 902 bp, Homo sapiens
gcccctgccctgttctataaatagctatatatatatatgcagttacacatggccgaccgcctcgcctctagcactaagaataagtccctgtgctgtccttttggagtcttgtggtccagcaagagaaagctgtcccctgacatcgcccctccaaagtgtgccacctccagtgagactccctgtcatgcccagcctgtggacagccagcccccgccatccctcccaccctccaccaagcatgggggtgctgtgcaggcagccatgtggcctgacagtctctaccagtcctgctgtccctcggctgagaatcaaacccatttccggatgacggagaatgtgtgctatggcagtccccatgaaatccaccaggtgtcaccaggcagcatacaggtaacaggcctggaaggtccccaacagcccagctggacatgctcagacactctggggctcctcattcagtgggacaaactccaggacccagtgaaggaaacgggaacacaccaggctgagcagggtcttgctaccctaatggtaaagggctgactgggaaggggtggtagggacatggtgggggcggagagtccagacccacttctccaggcttatgctggaaggggcctgcttttatttatttttatttatatcccgtgactttttttaatcccataacttcttttccataactttttaaataacttttcatacaattttttctactttttttgacacacttttccacattttttatcccgtaactctttcatcccataactttgtttgttcttttaataaacacacttacatagttacaattttgtaacaataaaaacagattatctcatgccaagcatgcccattatttgcatgctatagtatttaatactgtagttttcaagacacac

SEQ ID NO: 469840 - DNA, 2318 bp, Homo sapiens
agcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacatcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggcaacgtgaacaggaggataggctacatgaacaggaggagaggctacgtgaacaggaggagaggctgtgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcggtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatc

SEQ ID NO: 469841 - DNA, 4921 bp, Homo sapiens
ccaggagccgccgccgcagctcacgctccactgcaacatcacgccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtcggggagccagacctgggagggagactcctctggggcccaggggaggtgagtcagagctggcagaggcctctggctccaggaacctccaaggaggagacctgagttgctgggaatttctgggtctgacctcctgccaagtcaaggtctgggctggacacaagaaccacccggaggtgactgtggccatggctctgactgacatagacctgcagctgcagttctccatgtcccaacccgaagccctccttctcctggcagcaggcccagctgaccacctcctgctgcagctctactctggacacctgcaggtcaggcttgtcctgggccaggaggagctgaggctgcagaccccagcagaaattctactgagtgactccgtcccccacaccacagttctgactgtctcagaggactggcccacattgtcagtcaatgggtttctgaatgcctcctctgtagtcctgggagcccccctagaagtcccctatgggctctttgttgggaacactgggagacttggcctgccctacctgaggggaaccagccatcccctgaggggttgcctccatgcagccgctctcaatggccgcagactcctccagcctctgacccccaataagcatgagggctgtgctgaagagttttctgccaatgacgatgtggccctgggcttctctaggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggaacaccgctcaggcctgacaccaggggctgccaatgcctccctgctgggctggctgcatggaagacctcagtgtcaatggctagaggcgggggctgtgggaagccttgctgacgcacaacatggtggctggctgcagactggaggaggtggaggagcccgcttcatccacgatggccctgaggacacctctgaccagctggtgctggaggtgtcagtgatggcttgggtgcctatgccctcatgcctgcggaggggccaaacagacctcctgcccatccaggtcaaccctgtcaatgacccaccccacatcatcttcccacatggcagccttatggtgatcctggaacacacacacaagcctctggggcctgaggttctccaggcctatgacctggactctacctgtgagggcctcaccttccagctccttggcaccccctctggcctccccgtggagcaccgagaccagcctggggagccggtgactgagttctcctgctgggagttggaggccggcagcctagtctatgtccactgcggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccatgtcaccggaggcctgccgttcagggagctgcagaagcagggggctggtggggtggaggatgctgagtggtgggtcacacaggcgttccaccagcaggatgtggagcagggccacgtgagatacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaaccttcaactacagggcacgatgatgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcatggtgcccgagggtggtgagtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctgcctgtgaatgaccacgcccctatgcagaccatcagctgcgtcttccatgtggcctggggtaggtggcggctgctgactacagacaacatggccttcagcaatgctgattcgggctttgctgaggcccagctggtgctgacccaccaggacctcctctctggcagaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttccctatggccacaatggcagcctcagctcctgcaacaccctggccttctcaatggatgtgggaccagtgcacacagatgccaccctacaagtgaccattgccctagagggcccagtagccccactgaagctggcccagcacaagaagatctacatcttccagggagaggcagctgagatcagaagggaccagctggagacccctgtgtaccccgctctcttctcagagcccagaccaggaccaggagggtctgtcaagggcttctgcttacccaggaacctcacagagcagccacgggccttccagagatctgacatgccctgtgacctcaggccagtccttgcccgctctcagccttactcttccacactgcttatttcggagacccttctggtctgcatctggagcttggggcccatggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcccggagccatgccttctcgctggatgtggcctcggcctgggtgctacccttgaggacgtcacgtggagctggaggtgctgcctgctgtcatccccactgggggcacaaaacttcagcagtagagggggcacagtcgcagctgcaccctggcccctccactgctccgcgttgccaggtcctacttccccactctcccgggccttggcctgcaggtgctggagccaccccggcatggggccctgcagaaggaggatgggcctcaagccaggaccctcagcaccttctgctggagagaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcagggggtggcctcatggtgcggaggccacagaagagtgggacacagcaccctggaaccacaggctgggatggctctgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatacgtgggagggggccaccgtgcccatccctacagaggctctgaggagcatggatggttactctgggcccaaggacctggtgtacaccattaagcagcccagcaatgggtgggtagtgcggtgggcggtgccgggcactgaggtgcgcagcttcatgcagacccagctggatggtgggctcagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggagccacggcccgcagcactgccccaagtacctccagaggggacccctgtcagcccttgaaaatggcagagcccaccccagcccccttttcaagctcccttgcttc

SEQ ID NO: 469842 - DNA, 911 bp, Homo sapiens
ggcacctctcgccccagtcgctgcgccctgaggtgggagcccgcgtcgcccgcagaccttttggggcccatgatcgccctcagagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcagttttggaatgtctagaagatgctaagaacaacaattcggaagttgcatctgaacatctaaagataccagttttataatagcagaaatgagttatttttcagtgtttaaaacattacatgacatacatacatgcatacatacataagtatgttcataaagttaaatgaagtaggatataaaactgggcctagtgtttaaaaaagtaaatatatttacatgaaggagaaaacaactcacctcccactcttagagcctctgccagtttatcatagcctagtttcttgagagaataagctacatgtcttcaccttttttcactgagctcattataatctggattctgccttcatcgttgcactaaaatttatctcctagttgtcaaatccagtggctcccctcttattccccaaattgacccctctgcagtattttgatactgttgattgttcctttgttgaaacattcctccattcttaatgtccaccaataaagagttggttaaataaaaattatagtgtacaattttataataaaatattctgttgttctgttgtggacc

SEQ ID NO: 469843 - DNA, 1251 bp, Homo sapiens
gggtcacggagaagagcattttgcagaggagcagagcaagtgtcaccaaccgtgcatggatggacatgtcaggacttgtagggaaatctgagaagccaggcacgtctagctggcagagtaaggccataaaggaggagctgatggagaggtctaagggaggccgtgctgcctccctgccaatatgtgggccacggccaaaagctgtggagggcctggcgccattgttggtcagcaaggccacaggcagagaaaatgacccagaagcagagcagaagaatgcaaagaccagctggaacctgccagacatctctgattctacccattaccataatgaccgcacagccttctatgagaaagtctccgtaagtagcagccaccctcatttcaacaccctgggaccccaggaccgccagagagaggtgtgggtttcactcgcccaggatggggggactggcgcgatctcggctcactgcaacctccacctcccacgctcaagtgattctagtgcctcagcctcccaagagactgggattacagatgtgtgccatcacactccactaatttttatatttttagtagagacagggtttcaccatgttagcccgactggtcttgggctcctggcctcaagtgatctgcccacttcggcctcccaaagtgcttggattacaggcgtgagccaccacacccagccttaaccatctattactaagcggaaaaaaggaagaggaaatttggacacacaaagtgacaccacggctacagatgcataaaggaaaaaccatgtgaagacatcttgagaagacgatcacctgcaagccaatgagagaggcctcagaagaaacgaaacttgtcagcaccttgattttggacttccaacctccagagcagtgagaaaataaatttctgttgtttaagccagccaatctgtggtattctgttatggcaccagctttagcgaactaatacacgtaataaaatgtaaagaaaacaaaaccaatgtaaataacattttctaagttccatctaaataaagttttccagccttccaagatgaatgcttacaccacttttttagaaacccgctgtcttgagtttagatcttttgatttcttcaactgtactgtaaaaggttttccttaatgtcttcacaggatgtgtttagctttcatacattctgagtctataagaccattcccagatgaaacactgagacggtgacaataaatgttgtatgtggttacaatgggt

SEQ ID NO: 469844 - DNA, 764 bp, Homo sapiens
gtcaaggtcttggtttttgttttttcctagccaatatttattgagcttatcttccaggtactgggctaagtgaggagcgcaaggctcagagatgttaagtgactcgcccaagtcaacagctgtcttcatggctgtctcccgactaagacgagctggagctgagctgggcaccaagaagggtgtgtcctggctccagctgcagtgctgggagcagccctgggcaagtgccgctcgtggaggccccatcctgctccgccctctcagcctgcccctcaggctccagggcacagattctgtccctgtgtctgcctgctccagctggctttatgacccggtgagcagacttgacatgtttgaagaggaggaggaacaggaggagcagctgtgtgcccaggctcagcctgcagagggacagcagctctcattcccctcatcgctgaggaccctggtgctcatgaggcctctaggtgcctgggtctggttcttttcagtctcccaggataaacaaatgtatttgggctcagtgcatgacttttcctagggcaagaaagtcatcgtattgactggtgctgttctcagatattttcacttcctttcaagttgagaaaaggccctgcagggacataaggccagtttcccaatgaccatggatgggatcccacattgctgcaacctcttccagcccatttaaagaagggccttccatagaagcacaaaccccaaggccacacagtctgacagtggacttagccttgcctgccttc

SEQ ID NO: 469845 - DNA, 731 bp, Homo sapiens
aaagaaagaaagaaagagaaagagaaagaaagaaagaaagaaagaaagaaagaaagaaagacagacagacagacagaaagaaagaaagaaagaaagaaagaaagaaagaaagaaagaaagaaagaaagacaagtaacagattctggctagaggtctgagaacctcatgtcccaaatgctgctggcccctcctggaccacacacctctctctcaagccttacaacagtcccccagaatccagcagagtacagcaatttttggtgtttattggatacctatttttcctgcctcgtttccgaaatggatttacaggcaaatataatgacctctccatcgtacaggactgatgtggaccaggaaggacagacccacatgggagtggcagcgcatgccggcccttcctcctgcagctctggggttggaactgaccccctcagccccagcccatcaccctccctggcttttagggagctgatcttctgcagacatgcctggagcctggtgagggcaggacaactgtccacccaaggatggaaatgaatgctgacagctcctgatttatgcccttgttatcctgtaaggaagacagcaaggcaatttaaaaggccagcagctttgggaagcccaacaaggagccccacagcacctggagctgcccactgtctccccagccaacgctagctagctgcttcctggaaaggccaagataccctcctcccatccccagcctg

SEQ ID NO: 469846 - DNA, 533 bp, Homo sapiens
agcagctttacattctctctctctctctctctctctctctctctctggcttcacacagacactggctttgagcagcgttctgtatgtcagtgctcctacctgcagctctcctgtcagccatctccagatcccatgctacagacaatccctttacaaagacttttaactcccagaagcagattgttcagcctgacagcattaatagatggattggaggaatatacctaaccaaggaggtaaaagacttctacgaggaaaactacaaaacactaatgaaagaaatcatagatgacacaaacaaatggaaacacatcccatgctcatggatgggtagaatcaatattgtgaaaatgactgtactaattagaaaaaacaattctaaaattcacatggaaccaaaaggagcctgcatagccaaagcaagactaagcaaaaggaacaaatctggaggcatcacattacctgatttcaagctatactctaaggccatagtcatcaaaacagcatggttctggtataaaaaataggcacat

SEQ ID NO: 469847 - DNA, 1014 bp, Homo sapiens
agtccaggaaaaccagggcacagtcaccataaactgccacatcatctcccctggctggagcgccctggcttagccctcactttgaatctaactcaacagatgaccttcatgttttgcagaggcgtgacaaatctcgaggcagaaatgggggcagggctctgctctaggcttcttgtggtgaactgggggcctcccctgctcctggattatgacagagcctctctcacatccatacccccgaagagggagttgggctcctggagacctcaaagtgttccctctaccccagcctactgatggcctgctgatggacaaggaggcagtggaaattgacaagtgggaggtgaagaaggagaagaacaggaaggcagtgactcagattttggtggtttccattggtggacatgccagctggaaggagtgttcaaaattgcttcagcagggcaagatgggggaggaaatgcatcagctgttcaccgcagtggctcagaaaggtcacagtaaagtgtcacatgtcactagagctcccatttcatttaccagacaggtcatgaaccgccctcccctagggaaccacagaggaatacatgactattcagtgagcatgacttctgtccgcctcatataatattttggaagatgaggaaaaaggaaaaagaagctgttctctaaaatgccaaaattttcatgtgatgagagtgcttcttgacataaatattttaaggccaacagaatctttagagtgaggctagagacaaggttaaagatattatattgaatgaattcaaatatgctttagcaaaggtgaccactagtatcccttccttatccttctgtcaatcgtaggttcagtctttttacagagtcccatatttctcggaggttttattaatttcttttcattcttttttctctaatcttgcctgcatactttatttcagcaaaatggtcttcaaactctgatatcctttcttttgcttggtcagttcggctactgatacttgtgtatgcttc

SEQ ID NO: 469848 - DNA, 800 bp, Homo sapiens
tctgggaggtgtacccaacagctcattgagaacgggccgggatgacaatggcggttttgtggaatagaaaggggggaaagtctccttggtgtagggcactctccggaaacaggccaaggctcttagggctttatggatcggagggtgagaggagcatcctggagctgaggaaaactttgccgagggctgccttcgcccattgcgatggagccccaagtacatccctggctcagagaaggggctctgtcaattatctgcagacaactagggggaccgtcagggtcctaggctatgatttcaaagcagaagagctacccatatttctggcaactttttaccattactccaatctgataagaatgaaattgcaaattagaagttcaaggctgaattattttaataatttttgcaatgttttccactatcttagtatcatagcctatagcagtaattttaaaaatccttttagtaaaacaaatgcttttagcaaatggtcttttcctctaggcacacaggtgttttattcttaactatatgattattgctccattatagatatatgagacataaacacctatgtcatgcatgtttacattttatacatatatgtgtgtatatataacatatatacatatatagcatatatataacttttatatatatataacatatgtctataacttttatatatacatatataacatatgtctataacttttatatatacatatataacatgtctataacttttatatatacatatataacatatatgtgtataaagttatgtgtgaaccagt

SEQ ID NO: 469849 - DNA, 771 bp, Homo sapiens
tacagagccatgtaaaagactgttaaaaagttggaaacaatcctctctgagagggaaatctccagggaaatgaatattcccagattgcagttccatccggttctcccactgccctcactgtggttctcagcagctggggacgcagaaagagtggcagcggccaggctgcccagcttcgtgaaggctctcggtgcgccgcggcccgcaggcacctggcacgcgccctccctgccgccaggatgcccaagaggaaggtcatctccaccgaaggggccgccaaggaagagcccaagaggacatcggcgagtttgtcagctaaacctcctgcaaaagtggaagcgcagccaaaaaaggcagcagcgaaggataaatcttcagacaaaaaaacgcaaacaaaagggaaaaggggagcaaagggaaaacaggcagaagtggctaaccaagaaactaaagaagatttacctgcagaaaatgatccaggactctttacacatagttctggatgattcatatgtgcttaatgcgtaatagaaaccctgtggttataggtggaacaaactcaccctcctacaataatagctacagaatctagagtctcaacaaaatgggctcctggggtccctaattccaggtttttggctcctggatggcatttctggacccatcctgggccagagagaagcctgctgccctgcagggtgagtcccaggcctgacattgttcacccacaagctgactggagagcccttgggccttgagtgaacatcagcc

SEQ ID NO: 469850 - DNA, 1939 bp, Homo sapiens
gccatttgtaaatagatgtttcagtgccttcaatcctgcatttttaaagccaagctctccagcaggactcaactcagtcctctgcctcagacccaccttcacctctccacatctagatggaagggggcttacgagtctccttgcttgaggcagctctccaaggaagttgcaatgattgttcttcttggagtatttcttggtaaggtatttcaagggccctttagagaactgcttctcagagaaaacaatgatgacttttgtgaagaagatcacatggatcccgaagctgtgcagctcctagagactaagaccctcctcttacagatggacgccacagacagacccataacacacggaactcatataagccactgctcgcccagaaaatgtcaggtggtctacagacctggctttgacccgcggctcttctctttgctaactttccacattcataggcagtggagtggagtggctgtgaacacagattctatagagccagacttcctgggttcaaatggcagcttcgccagtgatcacctggggaatcacccaggtgctgtgatggttgattttatgtatcagcttgactgggctaaggaatgctcagatagctgataaaactatttctgcgtgtatctgtgagggtgtttctggaagagatcagcatttcaatcaatcaaccaccagggcccagacacttggttttcagagagagacactgaccttcttgaaggcagagatggggtcttgttcatcttgtaccttcagtgcccagtgcagggtctggggacaccggctgggcagggaagggaaggataactgagactgtttggaggtggtgtccccaaccctcgcttacgtgggcgggtctcagcggggcgaggcttagcttgcctgctgagccctgcaaatgcagagtcagctgccctgccctcgtgggtctgtgtgtttgtgagcgtgtgtctattcgtgccatgagtgtgacacctgtgggtgtgtgcttgtgtgagctgtgtctgtgtacaccctcacatgtgtctctttgtggggctttcttccaggcctgtgattctaaaatcaacacaaccaaatccacactcgtcgctggctttccctgccctgctgtggagcacatgaacccggggacgcattcggctttcctttggtaagtgaaggcaggtctttcctctttaaaggaagcctcagagcaaccagcggccctctcccttggcctttcctggaaaggccctctgggtccgtccctgcaggagcctcctccctcctagcttgtgccacctcctgatgttgagctgcttacaagtcacactagcatcatgaatggtgcgaagtgtgtcatcacccctgcctctgcttccgtcagaaaccttagttgtaaatcagcagaatcttctgaatatccttaatccagaggctagatctaaggataagaatggcagggatcagcaggcagttgaggaagatatctgggctggagagtggctggggcagtcttcaggtcatgcctggaaataacctcttgcacaagtggatcctgcctaatttgctgagtgctttcacctgcattcccctgcttgcgcctccagctcccctgttcaggaggctgggcaggtgttgcaggcccatctaccagatgcagaaaccagggcttaccagtgcctaagatcacagagctggtaagaggaaggttcttcagccccaaccctgagcattttcagttccccaggggctttgtctaggtagcattggggcaagcactccgtccaaaaaccttcagccccaagatgttggagtgtcacttggacggtttgctccctggtgaggggtctggacttggctctttctcatgctggcatagcctgtatgcatgaaatatctgtgggggagaaagcagggtttactggttggggagcagcttcag

SEQ ID NO: 469851 - DNA, 1116 bp, Homo sapiens
ggccaacagtatctctgtagaacctacgcaggacagtcccccaaagcaggaatcccctgaatcatccgtcccaacatgtcggcagtgccaagactgagaagacctgctttagagacaccttaattcaccaaccttcccaagtgtggcagcttgcaaaaaaatgggcacaaattccccccaataccgaggaagttatgtcatggagcttctgagcccagacctcaagaggtcctgcagcttccactgttgttcccttggagcccctggcagcaatgaggagcagccatgggcgagctgccagatgacagccacatctgtgccagacctagaggggggaaatgccactctggaaaatgcagagccctgctggtctgagtgccgtggctctggggtagcgaggactcctccctggcaagcacctcctccctggggagcacctcctccctgtaacagccatgcactctgtgcatatgcatggtatcacctgcagatgtcccagttcctgacgtcaccctggctgcagagccagcctcaggccgagctgtgcaaccagggcagagggaggaaggggcgctgctgacctggacagggctgagttccagtccgcttccgtcaccacactcccactgttggccttggacaagcccccatctctctgcagcagccccttcattcctacctccttgaggggcctaaactggatcatcacttctggaaatagccattcttgtcccacctttgaaggtgtcatttctcagcaccccagactattagtcagggaatgttttctttgaattgactcacttttaaaatacaccatttatgtcaacttaccatttctgtacatgatgcaccatttgctataaagggacattgaagttaaaacccatgaaaatagtaaatgttcactcttgtaccacctaaagtcagggtacatgcctgccattgcatgagtgcacacccccaggggaaacctgcgtcctggagccaggcggcttctcaagtatgactgtgcgccggaaacacctggagaccttgcaaaaatgcaaattcaaattcagtaggtctgggtggggtctgagattctctgtttctgacaaggtcccaggagatgcc

SEQ ID NO: 469852 - DNA, 579 bp, Homo sapiens
cttagcccgtggtcatgttgcatggtcacaccaagcctgggaagtgggaattattgtctttattgtagaactgagctacctgaccctcaaaaagataaaggaggttgctcaggtcacagggcaagtaatgactggcatctggctttgcctggttgtggcttcagctctcaacctaacaccttcccagcacacagtaggtgctctatctgtgtttatccagtgagtatctccaaagcctgtgttcctcctctgtacactgaggctcgcagcagtgtggtagacagtgaggaagagcctctggacagagtcctgggtcacctctatgaaaatccaggccttgcagagcagcagcttgaggaccaattctcggaggtgggaccagacttgctctgagagggacctggacagcagagaggctcttagctgtcagtaggaaaccattttccatttctggaaaatttgtagggaatggaggatggggagttgggaagcaaagccaaggcccctccattctacacaggccccaggaagtgagcctgcacctgtctaccttccagactgcaggccagaaggaaatac

SEQ ID NO: 469853 - DNA, 2987 bp, Homo sapiens
ctcttctatgtcctcaggggaagttgtggaggtcggaggtgcctggaacaaattgggagattgctggaggggtcattcagatgaagatcaaaatatcagcacctctgacacgtgctactcagacagggatgctcgggtccctgggaggatggactcagcacatcttctgagtcagcttggcttagccttttcctccctgacgcagagccaacaggctgattgcaggcccaccctcagaggctgggcccagggcacctctcagcaggcaagcagatcccctgggggaaactcagagcggcagaactccttcacccaaactcaccattcagctgtgctgtttggagctgggctgcaaaaggcagttggtcaggctggtctcaaactcccgacctcaggtgatcagcccgcctcggcctcccaaagtgctgggattacaggcgtgagccactgcgtgcccggcagcagatgaactttcaatcggagcaatggaattctgtggggcaggggattgcacactgcacacatcacagctgctcatccagggttcagggagcacaggtgttgcggcacttgcttcatcttgagtggcacggagcacagagcagcccctgtggagtgtggaaacaccaaaccctgagtcaccactgactgttgccctgggcatagaaccccaggtgaaggcacttaacactggttatccctgtgcatccaggaagctgaatggcggccaaagaaaaaagttacaatgcagtcaggctggaccagagaattcctgcatgtgcaagtttgtgcgtgtgtatgttttggaagtcaagccagatgtcgtctttcctcatgtgacatttggtatcttttttccacagcagtgttccattatgttctagttcttgaaagaggcagtgaggcaacaagtgtacgacgaaattgatttgggaaatgatttatgtgtattatagtcttctcttagaggatcacaaagtatattagcatattaaaggctctgagaagtcctgtaataaaggagcctggttgattgaatgattgtggaactcattgtgggtggatcattcgcatactggatggaatggggtgccaggctgactgtgcagagggtgattagtccctgaaatgtagataggggccacctagagaatggtggagcgtcggacatggatgggtgaactgaccaactgggctatgcatttcagccccaaagcacttaaagcataaggtagattgtaagatcctggagttcacctgccttaaacacctcctttcataggagaaggacaccaaggtcgttagagaagaactgagttactcatgatcaccagtcagagctcttggctgcaccacatagatgccaatgttggatacctagggagaatgagatttgatggaaggatatggagaaggccactgaacccactggaagactggagaaccgggtccagaaaacaagcagaagccaagggaaagtgggctgctgagagcatagccagatcatgccacgaaatctgattagcccacttcagctagggcccatgatgcatcagaaatggacccatggctctctgtgttcttcccagtgggtacaggtgattggctgagcacagactgcgttcccctccctggctgttagggtctgggagaacaggtgggaggcttttgtggcttctgcagcagaagcccggagcccatctctcccaacgactcacacaggaaggaagcccccatctggttgggggcagaatgaggttacaaagcccatctcctgtcttgcagttcagattatgcagccaagggtactcttttacataagtgtttaaaatcttgatttaatcagcaacatagaccttgcagcgttcctgcttccatgatagaaggatatgaactatttgaaacattcgcaactactgctctccttggggattcctaccctccttccattctttactcactggcctcatggtagagtaactagagcagaaatgcagagcgagagagaaacaaatatgcagctttcgaaacccatggcagagacaatagtttgagagtctcaaaatcttgcctttcgagaatccgagtcctgacacacagaaatcaggaggactagtgtatggtttgttaagctactttttcccacctacccagtctacattaatgactccctgagcaaagaaaaaaaaaagtccttagaaggaaagagagttaaatgctggcatgaatctctgggaatggtcctgcctacacgttccacgctctcaaactctgaagttgaggggacgatagaatctccaataatttaggggatcagagagaagagagacaggtgcccccactccgtggggaggcaggaagctccatagagaagtcccagcattcagtgtcgtgaaggaccaatagataggcaggaagcaacctccggggggttcagggcgcatcacaagccctcatccccccggtgttgtgtagcgaacaacagaatgtttctgagtgtatctgatggtcctgagagccagaaaacctggagggccttgagcctgggatggtaggatgtaagagcaggtgcaggtgtggaccaagggcaggaatgaggattccccaccagtccacaaggggtggccgccaccaaggaccagctgggcaatggccagtccagtggcggccagggtggacagctgacagcagagagccaggcctgcttccccagatgcactgatgtgatgttttcgccacctcaactgaatccatcctctgggagaaggtgagaaggggaaagccttgaattgacttgaatggcggtcctgctaaaagtggaatagcggatcaaaggagaaattagatttttcttttttttaaaaaaaaaaaatctgaatgtgtggcctgtgacattcattctgatataatgtaaactgtagtttatgcatagagttaaaactagtccacaatattttctttagaaaggttgcaagcacctgtctcct

SEQ ID NO: 469854 - DNA, 705 bp, Homo sapiens
tccatagtattctactgtcagaaagggaaatagagtcaccttgaagacaagagccagctttccctgtgtagagggggtgcacagctgcctggccccagctccctagcctcaactgtcatggctccaatgtcctggggagagtctgaccatctgagcccaggcagcagatcagccacctcaaggcagacaccctcccttgctgccctcagccctgtggccaagaaagggggtggtctcctttacagcaaggctccagagcccatccccgcggctcaccaggccaagaaccaggaaatgcaggttcagctcatgaacctcttccctgatgctggctttcaggtatcttgtgtcctcgtccaagccactcctggcacggacacagggacaaacgtggaaggggagttagaagtcacccaccttacaggtttttgcatcctgagtgggtttttgcatccgtgtaccaaggatagtgactcctccctcctgggcttctgcttctgtaggaacatgagtgggacaggcttccagacaccgtctcatccagatggcagtggaggccactgaggctcagaggagtgaatgactgaccaagacctgtttacctgcctgttttgttggtttttaaaaacacctttccaagagttaatgtacactgattcttaatatgtgggacatataatataaaaatttcatactgaataaatg

SEQ ID NO: 469855 - DNA, 1496 bp, Homo sapiens
atgatcaggagccatcaaaggtgtgaagcaggagaaagaccactttggtggacctatgggggatgcaccagaggaggcaaggctggaatcaggacccccttatgaggaggttgtagtggatggggatagaagccagcacagcttggctgcaggcaggcacgacctgaaaattcagaagtgtgaatgccccaggacaaccctcaccagtggggcatgcaagctggtggaccactggcccagcctcccagctccaagagctcagtccactcagtttctcagagggagctcagagacatgtctgattccaaagcccaagctcttaaaagcctacaccacctctctcccagttgaataccagcagaaagctggacacatagtagtacttgctgccaatgtcactatcatcctcaacctcaccatcaacattaccaacatcaccatcaccattaaaatcgcaatcactatcaccaccgtcactgtcaccgtcaccattatcgtcaccatcatcaacatcaccatcagcttcactatcaatggtcctgtgattacaggcagcagggcatgtcagatcatctctctcagcttcagcttctttatctgtgaaatgaggataactatatctaccccagaggttaggagagtggtggctgacagccctccacggaagaggtgcatcctgaagggggaagccatggacgatgattttacccagtgcttctctctgttctaatatgcctaagacattgtcccaggaactttcttatgtgcttcttgacacccagagtgactgaacacagagttgttggaaagatgaaaataaacaatgaatgtagtaaaatgcatggcacagtgcatagcaaagatggaacattttgtttctcccctttgcccttcagaagaactgtaattccttagtgttgctactcactgcacaaatacagtgtaactatcttagattcttcttgatacagtggtgtactccacaataatgggttcaacctttatgtagtgccttcccgtacacaataaaatagaaaaccatattcattaccaaatatcattctttcatgatataacacacaaaaaactatttaaacaaacttcaaaacttatactgtaaaacatgtcagcaccaaaaactatgcaggcaacacagacaaatttgaaaattagaagaaaacttaaaatgtccccgttgtgatttggcattagcaaaatcaccgataagtttcgcaacttctgctgccttgtttctgcagctagtggtgttaattctgttaaacattgttgtctcagagtgttccttaaatagtttttaattggttttaatttggagaaaaaacgttttgctgaagatacaggggcaggaattgtcaaaaataaaattaacagataacattctacggaaaaacttggagacatgctgtgtcattgtatactcccttggcaaatgtatggatgctttaattttgtcagtttcacgtgttaatgatttt

SEQ ID NO: 469856 - DNA, 2846 bp, Homo sapiens
caggagcaggggctggccaggcagagggcagagggcggctgccaggagggctgacttccaggcagaaggggaaggcagctgtgtgcagggctgggactcaactgccgtggcacggtttcagcccaaatcataggctctttttatgattctttgtaattctgctcacatcaaagtcaaaattgcctgcatctggacagccactctctccaggccaattacagacaccgtttctggagtgtctcctggtagctcaccacttcctccctgcaacaccagtcctgtgggctcggccagagctagtcctggtaggaaagccagagcagtgagggaccggggtgtggggtgaaggatggacagctacagaggctgttttgggcgaggagggcccctgcggaaccgtggtctatatccccaacacatattctgcctcattggtctacgttgttctcctgcaccctggttgccagcaccctccatcacttctccctgcacaggttggaatgctgtggtcgacacccatagggtctccgcatggagtcaggtgggaacctttgccgccgtagggccggcgttgttgggcctggccttcgggagcactccccgatccctcgttcttttccccactctcactgttctggcgccgtcggtgtgaggccgcccaggacaccgttccctgcgccgctgcccgtagtgccgggcttggtgtaggtggagctgagggcgggggcgggcggcggctgctgggtctccgcctcgctgctcatggttgcagtgatggtgactggggccgggctgcggcagctgcggctcctcctgggttgtgatggtaaataggccggcggaggcggtggggctgcttagggctctctggtctgctctccactctcgctaccgatcgaactcgacatggggatttaccatgctaccgccctctatgccaaaaatcaagatggaaaattcttttcttctcccttcaaaggctttggatgcagcagcttgtcatttcttctttaccaccaatgcttggaaagaggatgctgtatcattggcagtattgtttctttcccaactgtgccaatttctctgcaaaccatcagccctttattttgtggctgagttttataatttaccaattgatgtggttagatggagacatgtggttagttcttccagtggtttgtgtccttcgttggtgcaaaatattccagcattcactttccttgcagcaaccaaggagaccgtgtgttccagtgccagtagctacaagatggcagagcctccttcagcccggatggcagagttgctgcttggaggatagtggtgctggcaagtgatcaagcatcaaactttctgtatacactgtaaagtgcttcttccaataatctttgcagcctagacttacagtttgtccttcccaggtctgtttccttataaatattccaagagtggagctggaatttgggcccaatgcagtatagtaccacatcccatgggatgcctcctgtggtactgtacagcatcccatgcttgcagctgccattgtatcccatccctgcctgtgtgcctctctctgagtttgacatgctgctcagagcatggacaactcatctgaaaacgaaaattatatcattggaaggtctcttgtcctatataattgggactagtagttggttggttaaccaaaaaatttgatcaaggtgagaaatcataaaacaggacacatacagccttattttgatgtggatcaaaggccttttctcaaagaaactggtgaagaaaattctacttttctgttttgcgtaagctacactaataatttccagtgtctgttttaatgaagaagagagaacccaaggtactcttgaagcaattcgagtgcagaatccttctagatttatacaaactttctctttttttttttaccgttatctcgtccacacctcattcaacaagtttcttagtgattcacttttatcaagtctttcctaaagcaatgtgtttgacataaaaagcaacaatttcttttgttccacactcttctttctcggtttatgttccttttggttaaattgcataatcatggtgtcaagtgtaagtggcaaggcataaatagatttgggaacatgaataattgattcttggtaaatgttctactcatttggagagcagaagtgtggaggcgtattatagataagctgctagctgggagcatcaactgctgtatttggggcagagaatggaagctggttaacctggccagttatggggaatgtggttaagaggctttgcgcaggacctgatggaagggttggggtgagagccaatggagatggcaggtgaaaggattgagtaaagtggtgtcttgtatataagccatcttcatgattttgaagccttccctgatgctgcagcacacatggtcccctcctcccatgaaccttcttccctagggaacgttagagagcccccaaccagcagccaggagacccagatctaatcccagctctgccactttctacctctgtgagtttgggcaaaaggcttaatctcatcaatcgggttttcttctctgtacactgaaggaattgggtaaaattgtctggaaaggctcttctggccctgttctaagtatcccagggccaggtttcttactaactccactcttctctttggggttctcagtcacccccagggctctagaatactccctgtctgatacggtttggctgtgtcctcacccaaatctcattttgaattctagctcccataattcccatgtgtcacgggagggacccagtgcgaggtaattgaatcatgggggcaggttcctgtgctgttcctgtgat

SEQ ID NO: 469857 - DNA, 841 bp, Homo sapiens
tggatctagaaaatattcagctcttcccacattcaccagggcaatgctgctgaaacatttaatgacggggagtatttgtagcccgaagacctactgtttcttgggcctcctctctgcacagagggcccccgagttctgccaagtgcccagagaaaggctccattcaccgggcgggctgctctccatggccactcaagcccagctggcttcacctcgtggatcctgcaccggggccgcaggtgcagctgcccgccagtcccgcccgtgtgctgcggagcaggaggtggtgctcctcagggaggctcgggccctgcggggttgggagaaggacaggaaggaaggctcgggcatggcgggctgcaggtcccaagccttgctccgccgggaggcagctgaggcccagcgagaattccagcgcagcgccggcaggccggcactgctgggggacccagcgcaccctccacagctgctggcccgggtgctaagccccttactgcccagggccagcagcaccggccggccgctcccaatgcacggcctgccaagcccacgcccgcccgccgagcccacgcccacccggaacacccgctggccagcgatcgccgcctgcagcagcccaggagactgcctttccctggagctggctgtgacggatgattccttaagagaaactgttaacaaccgcccgaccatcacctaatgttcgcctgacattcctggtggctgaaaataacctagtgtggtgggctaagaccctcctataaggacgactgcaaagacgaattatccggcagaagcctccctgtgctaaatctggcaccacaaagaagaaatacacaac

SEQ ID NO: 469858 - DNA, 596 bp, Homo sapiens
gcggtgactgtcaccatctgagggttaccagatgcccatggtgagggcggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggagagcactagcgtggccttgagtgatattgtggggacaggagaaagaccagattcttgcccattgggtttctctggcctgggagagccagcgtggagtgaggaagatggtgcaagcccatgggcagggaaggggatgggtccagaagtaaaagagaggtcagcaagcctgggtttcttcaggcactactgcttctctgcactctacataagtcagcctctagttcattatctagaaaaagccactcacccagatgattctcagttctgtgttcctgatgacatccctagcatatactgaaaggaaactttctagtgctctgagacacaaaggccccctctctgttttagatggtcctaagcattgtgattatcttgctgaggaatgtttt

SEQ ID NO: 469859 - DNA, 695 bp, Homo sapiens
tggaggatggctaaagcatggtgtattccaggactggcaagcagtttggtgcacatcatggaccctagagagaatcaggactggaaagggcaggatggagaggagagtggagccgtggtgtggcccggctctggcccagaagctgcactaccccaggaagtgggagaccaagagcggctgctccaggaccggccttctgctgagatgggacagctcctcatgggcctgggctctcaacaaaggtgctcttgcctagcctacgaggcccagctggggctcagcttctcagggagccatcctcgacacccgtgctttccctcctacacctcccagcctttgatatcccctactctggaaggtggccccagcctgagtggaggagaagcctggattgcccgtgtggctcttcctggaggaccccgacacagccgctggcagcggaagggtgcagcatccccccagaatcctcagcgccaccaggacactcaagggagtccgacaggacccaaatttctacagtcctgtcaccagaatgctgcagaattagagaatctccctctaaaggagggcgcatcccttgcttcaaggccaaggccctactcccaacagtcaggtggagagatcatgggctgtctgagctgagaaagatcttagggaccatggcccaccctcagtctcagtcaggactgaactta

SEQ ID NO: 469860 - DNA, 1248 bp, Homo sapiens
tgggtcatcatctgctgacccctgctatatgacaacatctgaagttgagaatgtaggagcccagggccccctgcggggtcacagtgctaagccacgctacctggctccaggctgcggcagggggcctggtggggctggtttgtgtccatgtccagtgtgtgtcaggggcaggggcaggggcaggggcagctgccaagctgtcttcccaactgcagcttcccccagagcccgcacctgccctgagagacctgacagttccctcgggacactgaagagcctgaagatgcagctgctaccttgatacgaagctctcccagcccacagcgtcaccatgtgttctcttcccggggccctggcttgtccccgccccggcagcaaacagctcctgtttctgactgctgaccctaccacccatcaacaaccccccggctaccaccagtcctataagaagttgctcatggacatggtgtccccggacatggggcagggccgagcccatagcccaggctgtgacattgacgttgatgctgccccttcctctgcaaatgtctgctacaggacctctggcccctgcagcatggagccagctactgatatgctccagtctgctggctatgcccagagccaccaaagacccctgtccagtcccctgacccccaccaccagcccaacaaagccctgccagcactgggaagcaggcacaggaccccatctctggaactcacaacctcctcatctcctctcccagcagagcatccagagccaccatcttcttccagggcagttcccagcggcagggccagaaagggattctggaactctggaggctgaagacacaggtatctttatgatctagacttctccctgagacttattctttcgctctttgtaattggtatgtattttcgtgggaggccctttgatactatgtaactatcctgttcaatttattcctttatttattcatgcgaatatggactcatggtttcttattttactcaatggattaaaacctgttaccgacattacatattttggtgctaccaatgggagcccctttggggtggtgcctgtgcccttttgacatgtccccatcattctgtgagcacttccttgctttctggccccacaagatgctccaaactcatcttgcactttctctgccccagttctgaatcagtcgtttctccagggagtcctggtctacaaggcatttcagagatcttcaagggaagctcagacctagac

SEQ ID NO: 469861 - DNA, 866 bp, Homo sapiens
gaggaagagtggcaagcctgaggtggcaatgagggtggtctgcatggagtcgggtggaagaaagaacaaggacctcctgcatgcaaggcctctggagcagggaggagtagtattagggtgtctttgtgcagacaacgtgtcgagggccttgaatgctggacatgtgtgtttgagtctgctgggactcgacagaggccccacacagctcatctgccacacatactttgagtaccattggatctgccaagttgcaaggcccacagggcagcagcttttactacagcttgaactggctgcaaagccttcccctgctctacaccctactcatactatacagccttacgaatgtgatgccagcatagctagactttctgcagagcacaaaacgacctatgaggggctccagcacttgaacaaagaacagcaggctgccaaacttatcttggaaacgaaaatcaaagatgcagagggacaggaacatggaacattctaatttttgcagaaaaggcagaaatttcacacaggactggtttttgttaaattgcagtaaagacaagggacatgggtaggtggtgtgagaaaggaacaggagggagatagtctacaagttatattgactggtgacctgacttgttatggaggtaaatctgagaccttgatggattttgtaaacaataaaaattctattttctatgacgagccgttaaactgatggtagaaattccaaggtaaggttgactatcatgacagctggtagaagttgcggtcttgggtaggaattgggcttgctcctcagagaattatgtgtaaaattaagtgcttagtgcaggatgaatattttggcagtgctactggtcttgattttc

SEQ ID NO: 469862 - DNA, 543 bp, Homo sapiens
gagggcagaagatctgggtttgagtccagcagtgctttaggaaaacctctgctctggcctcttctctccctggagcccatgctgagagagcctgtggctcctctcacctgcataaatagaagggtcatgagtaccatggaaaactatgtgctcgccaatcttccagccaaacacaaaatagatcagggaataaggaggcctcctgctgcagaggagatgatagccaggtgggagagctgggccaaggatcagccaattttctggtacagaaagtgtaaccatggcaacagtagtgaaggtagctctagttccatcagcaatgacacccttaagagagagattcaaagtatgaaaaggattcagtacatcattgctgactttgaagatggagggtgccaggtaccaggactgagagtggcctttggcattgagactagtccctggttgacagccagcaaggccatggagacctcagtcctacaattgcaaggagctgaattttgctcacaacctgattgggtgtggaagtgaattcttcccaag

SEQ ID NO: 469863 - DNA, 1308 bp, Homo sapiens
ggcatagacatacttagcaactggtggaacccccaattggctccctgactggtaggctgagggttatcatggtagcaaaggccaaatggaagccattagagctgcctctacctagaaaaatagtaaatcaaaaacaatattgcatccctggagggactgtggagattagtgccaccatcaaggacttgaaagacgcaggggtgatgattccccccacatccccattcaactctcccatttgccctgtgcagaagacagatggatcttggagaatgacagtggattatcgtaagcttaaccaagtggtgagtccagttgcagctgctgtaccagatgtggttgtactgcttgagcaaattaacacatctcctggtactcggtatgcagtcattgacttggcaaatgcctttttctccattcctggccataaggcccaccggaagcaatttgccttcagctggcaaagccagcaatatacctttactgtcctacctcatgggtatatcaactctctgccttggtgtcataatctttttctgagagaccttgatcgcttttcgcttccacaagatatcacactggtccatgacattgatgacattatgctgattggatccagtgagcaagaagtaacaagcacactggacttactcatgagatatttttgtgccagaggatgggaaataaatccaactaaaattcagggaacttctatgtcagtaaaatttctacgggtctggtggacattactctctactggcctagaggtctttgttccagagggaggaaccctgccacgaggaaacacaacaatgattccattaaactggaagttaagattgccacctggactctttgggctcctcctagctttaaggcaacaggctaagaatggagttacagtattggctggggtggttgacccggactatcaagatgaaatcagtctactactacacaacagaggaatgaaggtttgggtcattccaccaggaaaaaaccacgacctgctgaggtgcttgctgaaggctaagggaatacagaatgggtagtagaagaaggtagtcatcaataccaactacgaccacatgaccagctgcagaaacaaggactgtttaactgtcatgagtatttcctccttttgttaaaaacatgtttgtgcatgtatatacttgtactaagaaaatatcttcattttatttcccttctcctttatcacgtgacataagattttattgatttcccatccgcatttaagcattgttaactttaagtaatagtatttgggttggggattggtgtgtttcc

SEQ ID NO: 469864 - DNA, 552 bp, Homo sapiens
tcggtcctcacccggcccaagcatgagcaactctgctagcacatggtgttttctttttcctgaaataaaatatcatcacctgatcttagctaaaacattgcaacctcaacaggaaaacattgtctgcaagtgcaggagccagccagggcactgggtctcaaacaagaaggctccagatgctcttgttgcccaaagggctcagctgttggagagattgccagtgaggaacttagcttttcaatatcaaggaaaatggctcctgggcagagtcataaaaagccaagtcccacagccagcagagctttgcaactgggccactactttttcacggctgtttaagaatgaatccatgatgtccagctatatgggagtcccaatcacttactcagtgaagcctgtactttcaaatcaggaattgaagacgctcaacaattttcttccctcctctgttccagagttttaacctaacactcttgtggagattcttgggtcttgcaaaaggaagcaactggggagtgcagtttagcggttttatcagtcagaacaggatac

SEQ ID NO: 469865 - DNA, 681 bp, Homo sapiens
tgccaccgagtcctagttcctgctctgatggagacctgcaaaaatgaagccacagactgagccagacctttctgaaaatggaagatctcacagggtgctccggggatcagggctcaccacactggggacgactcctaccctcgctgacaatcacttcttgggaatctctgtgagaatcacagaatgcctagaaaacttttcaagtgtaacttgccaggtgcactttgacagtgcctcaggggcctctgggccaggccctgccctctgcagcttcctctgtccacatcgtcctggcttccgccactcactctgccctgggtctccttcaaaagtactgaagatggcctccaccattctgacctctcctccaccacaggacagtcttctcactgccacacctggcagtgtttctttgtttcctggctctggaatattccctcaagagatgcccctcatttctttttgttttctctaaggtttatttgtacaaacaatgaatagtgtaacactcctattctgtctccatacaggattaacagctattagcattatgtcatatttgcttcctttttccctataacgtatgctttttcaaaattacacaatacgtgcttgcattcttttttaagaagcaaaatattgggtttgctggcaagatggccgaatagtaacagctccagt

SEQ ID NO: 469866 - DNA, 890 bp, Homo sapiens
tcctccctgtgaagagctataagatggacgacactgtgatcaggaatggaagcgccaatcctctgtttcatatgagcacctgtaagagcattcttcaggacacctgtgaccaccagaatagtgacccgaatccgctcacttcgatttcctcatccataaacaggagaacaactctaaaagctgctgtgagaattcagtatgagaagggacatgaaacttctgggaccttccacaaatgctactttcctttccttagtctatctgacaccacccacaaacagcaacttcccctccggggaccaagcctccaaagccgcacatcctggtgtttccttctcttctcccctcacactcattggctggtgggcaagcgcaacattttgggtcaggcaaccctgtgctggagtcctgctcagcaaccaatctgtgccaggttccaaatgagagaaatactgtaaggataatgttactcgtcccttctggaaacattaatcacaagggtttatttattatttggtttaagtatttaaaagttaaaacatttccaagctgtcactgttgaaatatttctaatattgcaaaacagcaattatttcagagagggtattgttaagatttccacttcagaaagaaaataataaccaatgttctatgggttaggttaatgagaatgaaagtttctcagttccaaagcaacgctcatcaaatcttcctttcctccacagtaaactataacatgtagaaagtgtgaaaaaaccatctccccatcccgtatggacttaaaaagaacttatttcatacaaatcttaagagagacgtggcaaaacagcaacttataaaatttgttactacagagcaatactttcagaaaatggaattttttaatgaac

SEQ ID NO: 469867 - DNA, 633 bp, Homo sapiens
acgggcaacggaattttaaaaagctgtccagctgactgtaaatgcacgagagtctgagaaccaaccatccagacaaaccgatcactacatttagaatggaattggcttcttcatctgaaaaaatggaacacctaaaaatgatatatgtatatcaacacatgtgtgaatttgaatatgagaagtttttccagtctcatgcctttcagggacctatcaaaatttcgttctttccattccccatgattttgctaagtttccagggaaaaaattgcatgtctacaaagaacggtgcattctcgtatttccataagagtggcccttgtgaactattttccactcctgacagaggcaaagagaaatttgtctactgtaagaaaaatcacagtgtgcatggcacacagtgtgatggcaacacattctcacttcaatgttgggggggcagagtccaggggactgtgactgattatacccttcaggctctgccgccggaactgtccggggaggggtcggcttttgttcagttctagctaaggtggtgtttctgagggaatacaagccccatgtggataggtctgagtttctgagaaatgtcagaaatgtactttgtgtgaaatctctcattttaaatgtttg

SEQ ID NO: 469868 - DNA, 867 bp, Homo sapiens
ccgctgacaacccacgacatgatgcctcctttggcatcatcaattacaaaatgtgccatatttgtcacttgtcctacctcttcccttgggaacccagtgatctgttgcttgtccttgaacactgtcccaaacctgcttgcagagccgtcattcacactcagttgtgaccaagtgatagtgctccttttgctcctcttgcacctctttgcagatgacgggcaagtcgacctcttcagccatgaccctttcctgtgccccacaccgcatttccaaccgctgacaggacatctccactctcagccttggctggtcttgcctttccttcctgttcccactgccgccatgttggttcagtctcctgtcactcacaacaagatgaacagcaatgttctcttctctgtctccttgatggaacagatgccttcctcgttgtttggacttgagtcagtcccggcaaatgtttaagtggcctggcctggagagctaagagagtgctagaagggagactgctgtccccacaatggctgcagccccattcctttttccaagctgcctgggtgaacattccaggatcctgacattctgtggaaattgatgagtgcttgctcaaaggtcgatgatgtgctacagatggcatcacctgttagagacagagctttctcaagaggagctttgatttcctttacttcccgaactgctatttcacagtctctcagtagatgtcagcagcacagcaaacatctcactgcccatcatggaagcaggttggttcaaaaacttttccaattaaagaaaaaaaaaaaaaaggaattagttctttcctttgcaattttcttcagaagccccagaaccaaaatggtaagatct

SEQ ID NO: 469869 - DNA, 709 bp, Homo sapiens
ttggttctcaagactgatcccaattcatatgtcacagaagccacagcattcgcagaggaagacctggacatttccttcggatgagaatatgcccgaggtgatgacatgggcactcagctttggagtacctgtggtggtcctgcaggagatcttgcaggcaggtctagggggccactggcaaggcaagcctgacttgcgggagaaaggtggtggctgggagagcacagagcaggaagagaaaaggaccagcgacagagccctgggaggcaccatggcaggtaagcagtttgggcttcacatgcagcagcagaccacgctggactcaaatcctgtcctcgcagaccttctagagctgccacaagcacacagcatccttatccacagtagacaggaccacaggaaaaagaaagcaccaatggcatcagtcacaagcatggggccaatgacgggttgataggtgcagcaaaccaccacggcacatgtatacctgtgtaacaaacctgcacattctgcacatgtatctcagaacttaaagttaaaaaaaaagcaaatttgaatttcagataacaatgaatactttttaaagtataacattgcatgtaatatttgtgacatactgtacttttactgaaaaattatttgttgattctttgaaatgcaaattgaacggagtgttccttatttcatccggccaccctatattcagagc

SEQ ID NO: 469870 - DNA, 1646 bp, Homo sapiens
aaagttaagtttgaagaggggggaagaggggaacatggacatgaagaggaggatccacctggagctgaggaactggaccccgtcagctgttcgagaacttgtcttggacaattgcaaatcaaatgatggaaaaattgagggcttaacagctgaatttgtgaacttagagttccttagtttaataaatgtaggcttgatctcagtttcaaatcttcccaagctgcctaaattgaaaaagcttgaactcagtgaaaatagaatctttggaggtctggacatgttagctgaaaagcttccaaatctcacacgtctaaacttaagtggaaataaactgaaagatatcagcaccttggaacctttgaaaaagttagaatgtctgaaaagcctggacctctttaactgtgaggagggcgaagaagaagacgaagaagacgaggaggatgaagatggtgaagaagaggagtttgatgaagaagatgaaaatgtagaaggagatgacgaagatgaagtcagtgaggaggaagaagaatttggacttgaagaagatgaagatgaggatgaggatgaaggaggaggaagaaggcaggaaaggtaaaaagaggaagagagaaacggatgatgaaggagaagatgattaagaccccagatgacctgcagaaacagaactgtttagtatcggttggactgctcatggatttggtagctgttaaaaaaaaaaaaaaaaaggtagctgatacaaaccccaggacacccacccacccaaagagccaaagaatagttcctgtgacattccgtcttcctccatgtagtccctcttggtaatctaccaatctaccatcgagcttagggacttcaccccaacaaaattgtaagtgttgttaggtttttgtgtgagactcttgctgtagcgtagatagctgtgattgtgtcttgtggggtctattgttcctttttagctggattgatactaagcgtcttcttatcagtggagcttaggacatttgagaagatgaaagcctaataaccccaagccccccaatcttaagccaagtttcctcctcacgcctgcttcagttgctcttcttcatgtggtattttttccctcacaaaactgatggtaattaagaaacccaaaagttcttcatcatgttatcagcttagggacgcttgtcatctgaataacagggtagatatttatcatctgaaatgttaaaataactagagcaaacacttacatagcactaactgctgttcacagtgctttacatatattattttcctcaaaacaactctgtgaaatagacactattattgtcatccccacattttagatgaggaaatggaggcacagagagaccatgtaaccttgctaaggtggtagggccaggacttgaacccgtgttttctggttttagagcctgcacccttccccaccacaccatattgtgtagcatgatacttcatgtggttaaagtattttcttcacttgggagcattttgtgaataatctgaatcttagcataggcaatagccgggtagtgttgacagtgggccttgagcttactcaagctttaggtctgaccccgtgcagtcccagtggtggtagccatagggatgttgtatcagtccaccccagctccaagtga

SEQ ID NO: 469871 - DNA, 478 bp, Homo sapiens
taaataacgacgtctcaggtcagtgatgggctgcgtatccgatggcggtcccataggattataatggagctgacaaattcctatcacctaggctgctgcgggagaggcagaaacgaagatccactgcttctggggcaggatcaaagtaaacaccacttgcccctgtgggaggcgcaggacgcactctcctgtgttaaacccacaggagatagaaggcacgacaggagggacaggagcacttcgaagactccaccttctgagaccctagtacacaggctctgcggaggctgggccaggagaatggagcaacatcccaccgtccggaaaccctttaacacacgtccacaaactgcctccactactagcccaaccaagagtagcagcaacggcatttaccaccagggggcgggcaagagcacacagagacatttaccaccaggaggagggcaagaccacgcatcccctaggtagtgcaggc

SEQ ID NO: 469872 - DNA, 670 bp, Homo sapiens
tctgtaccctcagcagatgagctatggccctgaacacagaattggatggaaggagagaaggaggctttcacccaaaggagaagagagatagagagagaagagagaagacagccgtgacgcgcagggaccagggcagccctcaccgcttcctggctgacctgtcagggccctatcagtgcagcttcacggcactgcccagcagcaatttggacacaacattcacttctgtggtcctaagcgccccctctcaggaagcaaagagtaaaatgaagcaggtgtccaaagcttgcaaatatgcagaaaggctacagcttggattactgctgttgactggcaacatagttaaccacaatatcctgttagatgcctgtcgtgccctgggaaaccgaatcctgggcccaagggacatgatccagctggtagtgcccctgtgccagggagtcatgccctacaaatcctaaattctcatcagatgggttttatttatatattgtgacttacttttcaatctgactctggtataacattacgagacaaggaaaaaatatttaaccccaaaatatatttccctgccatagcttgaaattgccctgcaagtctcttgtgggaaaaatccacattctatagagaatccccttgcccctttgttttccttccttcctttccagat

SEQ ID NO: 469873 - DNA, 500 bp, Homo sapiens
caagggattaacagaaaagccagtagatggtgaaacttaagcaaaagcagggaatctatgaggaatatgaagacattcgtcgggagaactctgttggcactttccactgttccatctgtggcctaggcatggcgactctcggctttgtgactccggaggccccctttgaatcatcgaagccccccatctttgaggggcttagccccactgtttacagcaatccagagggtttcaaggaaaagttccttcgcaagacccgcgagaatccggtggtacccataggtttcctgtgcacggcggccgtcctcaccaacggcctctactgcttccaccagggcaacagccaatgttcacggcttatgatgcacacccagatcgccgcccagggcttcaccattgcagccatcttgctggccaggagcctagatctcagaatgcagtcagaaaaatccctcactgagaaatattaagactagaatgctaagaagaaatgttaacag

SEQ ID NO: 469874 - DNA, 4897 bp, Homo sapiens
caggcatctcttccctgtggttgagacggatccttccaagcagctgctctgtagaagggctgggcctgtaggttcctgcctcgcatgtaccctagagatgagaggctgcctggcagaactgccggtggctgtggcttgggctgtcggggtcttggggcctggatgcaatgtgatctgaccctgggctgcgcagaccacccagctcatagccctggctgccgccagtgcctgcaatttctcaaggtgaaagcactctccagcgggtcattcgtccgcgtctgagtggttttctgttcgtggaatcatttatttctggtgtcagggaggcccagggcgacttttcccactggctgtaaatgctccgagcatcatcgattcgtctactcccatctccggaaatctgctggagcagcaaaagcgagtgggcaggaacctgtggttacctagatgatccatctgagcttggtcctacatccggggctgtgatgcctgggaacttctgtggcaaccttgcttccagccaatacacagagtggggcaactctcagaaaaccattgagaagagagtcagagtgctgaagtaccgtgtctggaatcctgtcttcccaactccgtgtttcctgatctatcagctgaaaactgcaaatgtttatcatctctcatcttctgtgggccaggagtgtggggcgcaacttacctgggtgactctgcctcagggtctctcccaaggttgtaaccacgggatccgccagggctgtgatttcattttataggcaagacagaagtcaccacctctttgaaacctaatctcaaaagcgacatctcatcatttttgccatattctgttcattagaagtgggtcacaaggtcccgcccactctcaaggggaaggagttacacaagggttagttcattctttctattgctgaatagtatttgtacggatacaccacaatttgtttattcattcacctgttgatggacatttgagccacttattaatagttttgggctattacaaataaatctgctgtggacatccatctacaagtctttgtatggacatatgctttcatttctcttgggtaaatatttagaagtggaaaggctagaacatacggtaggtatatatttacctttttaataaactgacaaaccattttccaaagtgactgaaccattttacattcccatcagcagtgcatgagagattcagtttctctgtttccttatcaacacttgatacggtcagcctttttaattttagccattcttgtggctgtgtagctctattttgttgtggttttaatttgcatttccttaatgattactgacgttaaaaatctttctgtgcttatttgctattcacataccttctttggtaaagtgtctgtctttagaccatttttaactacgttatttgttttcctatttggttttgaaaattctctgtatatgctggatacacgtcctttggcaggcacatggtttatagacattttcttttggtctgcagcttgtcttttattctctaatggtgtctttcaaagaacattatgtttcaattttgatgaagttcaatttatcaatttttcttttacagattgtacttttggtgtcacacctaagaaatctttgcctaagtcaaggtcacaaagattttcttcatacttttttctaaaattttttgtagttttagtgtttacatttaaatctagggtcatttttagttaatttttgtaaacagtgcaagctgttggattgaagttcattttcctttgtgtggatggtccagttgttcctacatcacttgctgaaaatattatcttttctccattgaatttcctttgcaccattgccgaaaatcagtgtgtatctatttctaaattctattttttgtttcagtgatctattttttgtctttacagtagtaattatattgataattgtagctttaaaataattcttaagatcaggccgtgttagtcctccaactttgttcttttacaaagttttgcttttctaggtcttttgtgtttcaacacaaattttagaattagcttgtcaatttctaccaaaaaagcctgctggaattttcattgggattgcatggaacctacacataaatttggggagaacaaacatcttgagtctttcaacccatgaacatgatatatctctccatttatttaggttgtcattggtttttctcagcaatattttacatttttcagtgttcagatctttcatatctttctcctaagtattccatatttatttatgctattgtaaatggtgttttaaaaatttcaacttctgattgttcattgctggtatttagaagtagaattgatttttacatattgatcttgtgtccttcaactatgctaacttacttaagaattctagtagctatttttgtaaattccatcacattttctacataggggatcatgtcacctgccaataaagactggtgccttttttcttttccttggataaactccacttggtcatgatgtattatcctttcttacttattgttgaatttgatttgctaaaattttgtttagaacttctgcatttatattcatgaggaatattggtctatcttttttttttcttctgatgtctttgtctggttttgtaaccattttttaataataaaaaaaccttccattaaaaatatgattgtatcctacccctttttggataagtggtagcatactatacacacatttgccatcttactttatgtacttatatgtgttggaaactcctttgtcatgtacagaaatggttctcattcctttttacagctgcatataattccattatatagatatataggctgagtgtcccttatccaagatgcttgggaccagaagtgttttagattttggatttttttggtggtgtgcggggaggatttggaatatttgcatatatataacgagatatcttggggatggaacccaaatctaagtgtgaaattcatttgtttcatatacaccttaaacacagagactaaaagtaagtttctataatatttgtaataatcttgcatgtgaaactaagttttgactgcttttgactgcatctgtcatatgaggtcatttgtggaattttccacttgtggtgtcatgttcatgctcaaaatgttttggattttggagcattttggatttcagatgtaccatagtttattcaacaatcccctgttgttgggtgggtcagggcaggtggcttttgcatttacaaataactctgtaatgaataagcttgcacatgtgttttttttctttttgtcatatttgggagatgtttctagaagtgagattgctgagtcaaagagtgaagacagagtgaattttgccaaattctttccatggtgattgtacaacaattttgcattcctgccaccaaagtatgagagtgtctattctccagagcttcattaacagaattatgttgtcaaagctttgaatttttaccaggaatagtgattctctaacctgtgtctctcctccagaactctcccctgacccctgtcttcttcaacccaccacaaagccctttcttattctgagttggatcagtcagggtctcaccaggaaatggaaacctcttgaatatttaaaaacagagggactttaatgcagggaatttgttaaacagctttccaagagcctctactccttgtccttcagttctgttatactccagccatttgctgtctttgtgcctatattgacacagctgagcactaccccaaagcctcccatggccatgtgcattggagccattgtaacttcattgtctccaacagttccctccatgactagtaatctttctatgtctctaatggcctctgtttcctgctccacacaggccattacaattcttctctcagactccaaccccaccattcccctgcctgctgccctgcagcccctgtcaccatcagcaataaccttgcgaatgccccaacttcctgccatcaaacctaaacctctctgaacttgcacctatattttccttctctctcctgacaccacagataaatctgagcccttctctcatttttcagggaccactcttccctcccttgcttatatctgtaagctttacctctctgctggtctcttcccatcaacatttcaatatgttcaaggctttattatcttaaaaaaaaaaaaccctcaagttttctcctttactttccatctttccccctttgtcatctcctttctttctttcgcaaccacatttcctgagtgttttctgccatcattgtctcactcccttccatgcctactcttcaacacttggtcattaaatttctgtcccatcctgtccattgagattgatttcctcaaaatcattgggacatgcttctgctaaatccaatgggcatttccatttcctgtttgtgtgacccgctagctgcacttggcactgtggaccattcccttcttccgagtctcacttcctttgtcttctgtcactctccctattttcttcccatctctctggtcactaattttttgtctcctttaatgcttttgctgaatgttgcttgaatgttcctgccctttgggatccttccttaggccctctgctcttgtcagccttcatactttgaccaggctctgtcagcgtctaaccacgatgacatctatatagtcaggactttgggttgcaaatgacagcaacccaattcacactagctcaagcaaaactaaagagaaatgtttggctagcataataggctagtttagaagtagagtgaaactcggcatgtctggatctaaggactcaaatgatgttgtcaggcctctttctctctgtattagtttgttctcacgctgctaataaagacataccctagagtggg

SEQ ID NO: 469875 - DNA, 568 bp, Homo sapiens
gaagattaaggccagtgggctgaatgaatatttttctgggaaacctttgaaggacatcttggttgcttcgcagttatgagtaaaggcactataaacatttgtatgctttgtggggacataagctttcaactcactcagcggcaagttttacttgtttctgtggaaccttgctaccacctccaggggcatcactttccagatatacttaagagtttcacatcctccttctcttcgtcttctgattctgcagcttcctccacagctactaagtgctgtccactaatatgcactggccccgaaccaagcttcaaccataagaccactggtggtgttatttcaaagtccccaagggaaaccagtgacaatgcagaagccatgcccagtcggccaggagatgaggacatgggtcagagtcagagaagggctaaaaggacaagcagcatgtggctgaggccaaaagggaaaggaaaccacatggatttgaagcagcttggaaaggtttgagatgggatagctttggaggcaggtcttgaggagtggaggaggaggaatcttaacaagtagcagc

SEQ ID NO: 469876 - DNA, 594 bp, Homo sapiens
ctccgttaaatcttttgtacagccatgtgccacataacgatgtttcagtcaaggatcgaccatgtttccgacatgagcttctcaggagacactgaggagaaaacagggttgacatttaccgaagtgatcctggaccatctgcatcagtattggctggacctctgtttaaaaattcatgttcctggacgccactgcagacctcctgagttaagaatctggagtaggatattctctgccctgggagagggagctcaatgccctgtggccacaggaccaaattcctggggcctagagcaaccacagaactctttggcagtaggccagttctggtgcaaaattctttacatatttgtaatgttaaataaaagatgcacatttttttctggttgtctttttactttgcttgtggcactctttttggtcataaaaaatttgatgtaataaaatttatctttttccttatgatttctagattttgaatcataattaggacatattttccaactattgagctataaagactaatttgtattagttcatttaaaaatatttaaatctctgacccatttggaaaatatcctgagatcccttggc

SEQ ID NO: 469877 - DNA, 821 bp, Homo sapiens
gccaggactgccctcctccagaccgggctgactctcttccagggtgcagatggaggttagagctaagatgacggaaataggaaggagtggaacgtgcccttttccgctgccagctccagagggtatcgcccttacaactgcatagtgcacatcccgttacatcctgcggcacctctgagtgaacagattgaagaggaggaccaagaggtggtttgattgaaatcaaagatgacttgcaggtttctgacttgggagctgctcaaccccacatttgcaccagggtctactgctcgctgctctgcagagaacattaaaagcattcacaaaagagatatcacagattttgttggttgtaaacctgaaagacgaatttttctgttatattttatgagtatgggttttaaagccttcataatacctggctacgcctctccagtacccatgcatttaagatgcaaagaagctggattctttgtcaccagctgccatccttcattggttgagggctgctcccagcatcttcctgcctgcaaggcagaggcaggctcctcgtgttcagtagagttgctggtgtgcatgaatgggaagtgctggggacatggggtgcccacagcagccgtaactggaattggagcctctgctgtgtgcttggtgcttcacgtgcatttgctggcctgcctctagtttcagggatttttcagaggaggaaagaagagagtaagcagcttgcctaaggccacacagcttgttgggtggcccgtctactccagagcctaaaccattttgctgctgcttgctttgaggtgtcctgtctggcccct

SEQ ID NO: 469878 - DNA, 1931 bp, Homo sapiens
cttgccactctggcatatcgtgagaaaccagaatgggaaatatctactggagggtgaagatacaggaggaagcagaggtaatgcgtgaagcagagcctcagaggaggtggaggagggttgaactcagggccaacgtgtgggggctggtctcaaacaggagggtgtatccctgaggctggagaggagtgagaaaaaaatggtcaggaacgcagagcagcgcctctcgggaagtggctgccaacgttacttgtgaggtggaaatgtccaaagtgggtctaggatgcatcaacacaggggtgaaggtttgggctccacactgtggggaacaggagaaacagccatccacccggggccatccccaaactgaccttttctgtgtccctaaccctcagaggcccgagctctgcctgggaattaaaacacaaattcctgcaaacgtgaggtctaactccactgtcacggagaggctgacgatgccagctgtgggaattgcagtggggacaggtatggagaggatgtttctggacatgggagtgactgccacttggagctgcaggcagaagcaacagctggtgtgttttcctgagcaggttgggggatggctcaaaatcaatatttactttacaaacagccatccggagggtgaaccgccctgcctctcaccctcagcttttctggggaaagatgtctgtggcctgcttagctctgccctgctggtcttcgcctctcgatccaaagcaactttgatgtgtatgggaaaagtactgcactgtgaaaggaactgtggacagatggtccacctgagctcaaaggtggggtccctccacgtatgcacctcaggactttccatcctgtgggaatctcctaaaaagttgctccatgggtggcactctctgagcagcacgattggtggggagggctctgtcagcaatattatgtcgtcactgacgtctgcaggctctcctaggggacacttcagaaactttcatagaaatatttctctttggcaacagctcgctgtttccatggtttgacgatactagccagctgtaaagtaggccagcacgggagagggcggccctggggacacgggctgcatggcacgctcatttccaaccctggggcaagtcagataacctcattaggtctccatttcctaatcttcaaaatggaacaacagtgtgagcctcagtggcctggtgttgtgagaatgaggattaaagaactgcaaatttttgagtttttttggtgaataattgtgaagtcttttggaggacatatttcagaaacaaatgaaataataaagcagaccttaaatgtattgatataaattttgcataggtccagtaaccttttctttgctacgcttagtgatctactgatttaaaaagagtcctctcatatgatactgacagaacatttttaacctatttttttttaaccagcaataagtttacatagttcaacattccaaatgcatgaagggatacagttactattccctttcctgcccctgttccagccatccagagttcccctgcctaggcaaagtatggagaccttttataagctcaagtgtgcgcagaagctggttttatggaattatttgtatacactaattctgccagcctcagtttcttcatctgtgacaggaggtgataaccgtattttctccttaggcctgatgtaaagcgcctgacgctaagtaaatgctcaataaatattagctagtattcaagcttgcctggctgctcagagacacagaggggcggggtccctaaattgacaagcctctgtttccccctctgtaaaatagagatgctaatgcctatttcccatagggttgaaaggtatgtgtgattatgcctgcaaagctcaatgcatggtggacgttgttatctggaatttccttacccctcttcagtctaccc

SEQ ID NO: 469879 - DNA, 2989 bp, Homo sapiens
tccttactctgatcagctagtcatgcctgcagagggcttggggccacttcgactgggattaggggcggtgtgggaacctagagtgggagagattaagctgaaggaagattttgtggcttccgaggagatccggcagtgtcagtcttcagctgcaaagccaagaagatttgggaaggagtcagtcaaagagccttgggccagagttccaggggctctgggagtggttgccaggatgagcctggagaaggaatttcaaaagataatgtcatcaattaagccaggaacaggccattttcacttcttttgtggtggaacgtcatcagttaaggcaggaacagaccattttcacttcttttgtggtggaatgtcatcagttaaggcaggaactggccatctggatgtgtacgtgcaggtcacaggggatatgatggcttagcttgggctcagaggcctgacattaacttttatctttttggaggaaatgtcagttaattatctctcaccttgacactctctccatcaggttgcatctgggtgcagattgtctttttcttactgattacatatatatgatattactttctgtctttacttttcactttcattttgatgccttttgaatacttttaatatagtagtagtattcatctttttctatgtggtttatgctttctaggtcttgtttaagaaataaatccttatcctcaaagtcttaaatttctttctctgtattttgttcttaaattaaaattttgttcttcacacttgtgtttaatctctctggaattaatttttctgcattatataaggtaaggggccaattttgtttgtttctatataaataaccaattactctagcaccacttattgattagttcttctttgctactgaaatgttaggtctgtaataaaccaatttcttgtatgtaagaaagtttattgatggctattctatttcactggtccatttgctcattttgtgctaataccatactgacttcattggcacctgctgagataaattattcaaattcattctaatgtcttagttatttttggccctttgttcttccaaatatacatactggaatcagcaaggtctattaaaataaaaactttgaaatttatttagaattttatttattctgaaggttagtttggggataactgaccattatatgacattaatcctctcaatccattaatacggtatggctctctatttattctttaataactttcaatataggtcttgtacaatttttattacatttattcttagatactctatattgatatttgttgttaaaattatgtactgttataaattatattactctgtcagtaatgatcactcagaaaacctctttgacacacaagtagaactacaataaacatctctgtgtatattccttacagaccttcataagagtatacttgggatctatccctgggaatggaattgtaggctcatgaggaatacatattcctaatttgatgaagtaatcccaaaggtacttctgaacagttctcaccagcagtatatggggtttctgtgtctccacttctccaacacttgaccctagaggcattcctattttttgccaatctaataggtgtaaagggatatctcactgttattttaatttgattttgattcctaataagtttgagcatctcttcatatacttaatagttttttctcttgtaaaatgttttaaaatatttttgctcacttttgggtttctgtttttcttcgtgatttgcagtaattgtatagtctagatattatttccttgttgattttagtcattgcaaagatcttctaatctattgtcctacattaaacagacatctttccttttgatgtaattaatttaatgctttttgccttataatttatatttttgaaaatgtttaaaaaatccttccttgcctctaatatgatcacaaaaatattctgaattttgtgaaattaattttatatttgtattacctgtcatatttaggcctttaattcattagaagtccacctttgattgcagttataggtttaaattcagttctaatgacctattctttctcaattgattcatggtatcacctttgtcacatattcaatttcgatacacacacgtgcacatgcatgtatacataggtttggctcaaacctgtaggttttactctctatcttcttccattggtctgtttatatattctttctccacaataaaaatgtttctattaatatgttaatatggctttgtgtactgtcttactgtctgttaggaaaagaccctttattttttaaaggtttttatgttgatatgtgttttatttcttttaagtaaatatccaggagtaggacttctggattgcaagcaaatgtatgtttaactttatacaacactgccagagctttctccaaagttgccataccattttgcattcccactagcagtgcgtgagagttccagttgctccatatccttttcagcacttgataatgtcaattgtttaaagtctagccattgtaatgggtgtgtagtgtttgtgacatgtattttcaattcaattattatattttccatttctagaagttctatttatgctttttttaatctgcttaattatttttagatacacttgcttcttacttatctctcctttacttttttccctttagattttattcatttatttttaatagactttagtttttagagcagttttaggttcacagcaaaattgcacagagttcccatattccccttgccctcacacatgcacagcctctccatcatcaacatcctacaccagagtagtacagttgttacaatcaacaaacctacattggcacatcattatcagccaaagcccatagtttacaagagttcactttcagtgttgtacattgtatgggttttgaaaagcatataataacatgtttctactattacaataccacataaaatagtttcactgccct

SEQ ID NO: 469880 - DNA, 1316 bp, Homo sapiens
ttaagtgacttcctgaagtcttcatggttaatccctttccagtgtcagcctggtgccaccctgacagctgccacgtgtggtcctggaaccttgttcctggttccatcctagaggagtgggcagagatggggactcacctactctagggggcttgggtctttcagattcaccaagatggcaaagagaatgtttttctcttggcccctgcaccactgggaaaggctgcaggctgcattgcctctacaaggctgccatctgcagctgcttcaagtgggctgtgacctacgttggggcactccattctcgggcattgaggcagcccagctcctccacggccggcaacactgggcatacgccctccccactgccaaagaggaagaggaagatcagctccacagacgctgctgccaaggaagagcccaggaggaggttggcacggttcgtctgagagcaaagagagtaaatccgggctggggcactggctcctctgaggagaaaccccactggagctgtgagcttcgggcagctcctggctcctggcactcccctccagcccagccagcaggcctggacccaggagctgaaaatgcccgtcttgctgctgatgactttagagtcaagtatgagacacagctggccatgcgccagtctgtggagagtgacatccatgagatctgcgaggtcgttgatgtcacttggctgcagccagagacagagatcaaggctctcaaggaggagctgctcttcatggagaagaaccatgaagaggaagtaaaagacctacaagcccagattgccagctgtgggttaatcgtggaggtagatgcccccagatctcggtacatcagcaagatcagggcagacatccagtcccagtatgacgagctggctcagaagaaccgagaggagctggacaagtactggtcccagcagactgaggagggcaccacagtggtcaccacgcacttggagaacagcctgagggtggtggaggttcactacaccatgcagagggagcagctcaatggggtcctgctgcacttggagtcagagtcggcacagacccagacagaggggcagcaccagacccaagagtacgaggccctgatgaacatcaaggtcaagctggaagctgagttcaccacctaccactgcctgctggaagacagggaggacttcattctcggtgatgccctgtacagcagcaactccatacaaaccatccaaaagagcaccatcggcaggctggtggatggcaaagtggggtctgagaccaatgacaccaaagttctgaggcgttgagccagcagaagcag

SEQ ID NO: 469881 - DNA, 3560 bp, Homo sapiens
aaatctcagaccacatcatgcagatacaggaatatttcctgggagacctggaatgctacttgggaggggactctctgaaacaagagatagcttggggacatagaagttgcccagagaggacagagcagcaggacaggaggtgaacgtgcatcctcctatggccaccggtggaaaatcatatgtatgggatgcccaaggatcagctctctccagggaggttttgtgcaaagtggggttgtttcctttaatgtgggagaaaaccccaatgagatcttttgctttgcagacaaggtaaccaaggctcggaggatttatgtagttggaaataaaggaactaagagttacctcatcaccactgccaccaccatcaccaccatcatcatcagaatggaggtgatgcggtggggcttcctggcgctgctcttcacggcttgtgaggagctctgtgcagcagctaggccaggccctaccttcatggatgaaaacctcccagagagggagttcggaatagcccaacacctacagcctcagggttattctgcagatgccttgagcagcctcatcatgctgccaacaccgactgggggcttcaataatggaagcttattttcacacagttctggaggctggagttccaagatcaaggttttggcagcaaactccaatgtcatctcctccatgaagccctggctgccactcacagagaagcaggctgagtcctgcaccaggatgcctggctgaggagcagagtggcataaaagcatttgctctttgtttgcaggccgctgggcccaggaggctgggtctgttcagaatttttgccaaaggtgccaagaacactcattggggaaaggacagtctgttcaataaatggtgctgggaaaactgggtatccatatacagaacactggaactagatcttgatctctcactatttacaaaaatcaaatcagaatggattaaagacttaaatgtaagacctgaaactatgaaactattaggcaaaaacattggggaaatgctccaggacattggtctgggtaaagatttcttgagtaagacctcacaaacacaggaaaccaaagcaaagatggacaaatgggatcacatcaaacataaaagcttctgcacaaacgcaaagaaaacaatcaggaaagtgaagagacaacctacaaaaatgggagaatatattttcaaattgttcatctgacaacaaattaataatcagaatataaggaactcaaacgactcatatattattttatgtattatttatatattaattgctgaatacaatttctcaaatcagtggcgtttataatgtatgtagatgtaccataatgacaatagtggtagaaaggactaggcgaggttaatgaaacgataatgtcgcaagtgactcaaaagccaatagaggagttaaaatagaatactaaaaaagtttgattaacccaaaggacagtagaaaagaaggaacagaggaacaaaaaagagataggacaaatagaaaacaaataataaaatgatagaccaacatatcaacatttgcattaaatgtaaaaggacaaaacataacaattaaaagacagagattatcaggctgaataaaaaagcaattcccgtctttatgctctataaagtgtgcctataaggacacccttctaatgtaaagacacagatagtttaaaagtaaaagaatggaaaagtacataccatgaaaatagtaagtataagaaagctggtgtgattataacaatattagacaaaatagacctcaaggcaaggagtattatgagatacaatacagattattttataataataaaagaaccaaatcagcaggaacatacaccccttctatatgcatatgtgaccaatgacagaacttccaaatgtatgaaacacaaactgagaagattaaagggacaactaggcaagtcaacgatcctggttgaatatttttaacatccctttttcagtaattaatagaacaattagacaaaggcatcagtaagaatatagaatatgtaaatactatcagttacctggacctaattgccatttataggagattatacccaagaacagaatacacattcttttcaaatgcacctggaatatttaccaagttagaccatatgctgggtgataaaataagtcttaataaaattcaaaagattaggaaaaaaaaaaagcttaacagtgcaggttgctggactgatatttaaacagctccctgggtcatgatcccaaagctaatgtgggagagctctatgactggaaatggacatttacaagtcagcagatgattccggcagcattttgcataggagatgaatggacatctggattcacagaagctggatttgaaataaattctctatgtcgtccagcctgtctgtctcagtccctgagaatatttctggtaatctatttatcactgatttgagaacaaaaggggattaaactggcctgaccctcgaattttcagctccagactttctggttcttcagcacctgggaagaatattaactactcatagtagaatgaatcacgttgagatacaatattaaataatgtgttttattaaaggagcacactgggttgtaaaatgtgacactgagtatttctctacaagcagacttgaaatcttgcgattctttctaaacatgtaaagcctgtgatgggtgctccagatgataactagctctatatttcccagagtagtacctttccaacccaatccttacccatttttcttatttttctctctatttccgtctcccctgtagctagcatcagccctgtgacggtttcagccaatgcaatgtgggaggcggtgatgaaaaaccatttccaggcctggccctacagcccctgcacagctctctcccccacctttcctcctgtgtctgctatatgaacacagaggatccaggggagacttctgccctaaggggtgccacaccgatccatggaaggcatccacatccttgaactgctgtttgatgcagggagggcctcactgccagttcacgttaatttgtgatgtgaacaagaaataaacctttattacctcaggccactgatattttggggtcgtttcttaccccagttagcctgtcctgactcgtagagtttcttcagtgcccactgctggtcctgggagggagtgaagaaagtgaggtggaccagtgccattcatcaccaccatcagaaaacaatcttaagctcttttgttcacaagccaatagtactgtttttggaatgaaggatagctgctggtttggctctgttgtaagccagcaataagagaattaaaggactcattaaggtcctccaatgatgtagacaagtgctctcagtggtcattccccattaaaagtgaataagactatcaatcgagtcagatattagacttgagttcctttctctaagtgcaaaagggtgttttctggatcatgaaaacgaaatgcccatttctcttcaatcaagttaacacaagggacctgtggggagagtctttctgttctcgtgatggaggatttgctgaattatc

SEQ ID NO: 469882 - DNA, 653 bp, Homo sapiens
gtggatttttttcaatgttcagctgacattcttctggtcagcgacagtgggctcaagtgttgttgcactgtgttcacgtgatacaataaatgaagactatggtcttgaaatatgggtcagaattagaatgaaggaaaggaaatggcattccaagcaacacaagcatcttaagcaaattcacatagtgaaaaaaaagagtggtatgattattacacagagagattactggccagactggacaacatactcatattatgtgatagttgcggccaaatttgaagagttagaacaaaaatcttacatgacaaacatttcaggcccctctgctgcaggtctgctgaagtttgctggaggtccactccagaccctgtttgcctgggtatcaccagcagaggctgcagaacagcaaagatttctgcctgttccttcctctggaagcttcatcccagaggggcccccccccacccaccagatgccagccagagctctcctgtatgaggtgtctgtcatcccctactgggagatgtctctgagtcaggagacacgggggacaattcagaattagaaaaatgaaatattttatttttcctctctctgtcttcttttcttatttttccgtaaatttcagagactaaaccaggaagaagttgaat

SEQ ID NO: 469883 - DNA, 701 bp, Homo sapiens
ggtgcaggattcacatgttgttttggatcttatcgatgggagcctgcaatcaccactgctcctacaaactggttaaacttgcaagtgtccttgcatctggcatatacaacctacagctaggctatctgtgtcagccccttcttgtactacttgctgaatgccagcaacctattgtagagaaggttcagtgcaaacatgtggctggagccctgcaactatcaatgttgtgtggaaaaacaagtgtagtggccgatcatctccggcttgatctccacctggctgaaggttttgccgttgtagacgcccaccatgctgcccatcatctcaggcaagatgatcatgtcctacaggtgcgtcttcaccacttccggcttctccatgggcggtacctccttcttggccttgcgcaggcgcttcagcggcgagtgctgtttccgccccagacccggttcaaacgctgctgccgacgcgcactgtatagctgcataagctgctcgtagggcacgtccagcatctggtccaggcccacaccgcgattttaattttcagtagcaataaatgagggagatttaacttgaaatttccttgagcctctttctacttcatcaatactgatgtctagatgaggttatatttctgttcttaaattttgttatatttaagtcatttaaaatttcacacatttaattaaaaataattat

SEQ ID NO: 469884 - DNA, 674 bp, Homo sapiens
ctggattgcctggctccccagtgagagtgtgtatcatgagagactattccctcgttctttttattggaaagttgaattacaaatggagacctgcgcctggacgaccctcagctgcaggtctgttggagtttgccggaggtccactccagaccctgtttgcctgggtatcagcagcagaggctgcagaacagcagatattggtgaacagcaaatgttgctgcctgatcattcctctggaagttttgtcttaggggtacccggccgtggcagggaagtgaatctgaagaccaatcacatgagcttggaaggagacccttctccaactgagcctcagcatgggtcatcatctacatctggactgaagactcagagaaactctgctcccacagctccagccacagctgcaatcctccctgccaaagctccatctagtttgcccaagacggcttcccttcattctggggctattgccttcaggttaaacaatgatttctatgccatgaatgcacaagcataagaaacagatgaaaaaatagatatattaaaatttctcagaattaaacacttttatgactcaaagcataccattaaaagacatccaaaatattgaagaaaatcttttcaagtcatatagcaaataagcttctactgcccagaatatatgaaagcacctt

SEQ ID NO: 469885 - DNA, 605 bp, Homo sapiens
cgtggcttctccctcatctaagatgtgggtttcgaaaacagaaactgggaagactcaaggacattacagatgtaaccttaccgaagtcccgagtaatttaatgagcagagatgtgactgtgtccttgaatgggggaaatgaagagaaaaatacgaggtggaacaaaataaagttatatccccaagtatgttcgtgctacatcatttggatggtaaccatgggtgcgcctgacagcgcactgccgcaggagcgccggtcagacaggaggctacctcgcggtgtgctgtgggaaggtcatgtgggcggggaggccttcggctacgggggtcgggccaggagcttccgctcagcgctgacttcagattcttcatctcaaataaaaaagttttccaagatctttgccactggaaaatttttggaatcattaaactgggggcattactaggacaaaggtcattgtttcaaatctttcacgtgtcactgcaccgaccttcaatatttgatatacactgtcttgcaaaccattgatttacatatgtacccattttttatatgtttacatgtgttggcaaaattaaggtgaagaaggaacactgtgaatcaaa

SEQ ID NO: 469886 - DNA, 735 bp, Homo sapiens
catcaagggggcagtttctcatcaactgttcagcaccattgcccttggtattgtcattgcgatagtgaacgccccctagttaatcacacgccctcgcacagacaccttccgcagggacctcgtcccacggcagaggcccagcaggtcacagctcacatcctggaatattagagattttgttcactttatacttatgtccgtacatccccacccaaagtcctggaccaaggagctgtatctagtttccaactgtgggtctaacccaatcacatcaggcagccacggcttcccctctggctccttggcctggggtgaggagagcagctgctcccaagaacaactttggtcacaaagagcatgctcagaaagagaagagtgtgggccggaagagatggagatgaagatatctggaaatgaagctgacgtggatcactttcagcttcttattcacggttccataataacttcacctccagaactccatctggcactgtttttccttagatctttggctagtttcctttgcaaacttagaatgccaatgcgttccaaaaaagttatgaatgtgaaaaaccaaacatatatacatcttccctttcacaatattccttgtccccttccatgttgcaagggaaacattcaggaacttggggtaaccaagccactgcccacagttcatgcgtgggctctggaagaagcccattccacctccattctctaaacaccctcccagag

SEQ ID NO: 469887 - DNA, 755 bp, Homo sapiens
ggccttgcactctcttctttgatgcctggcaagttcttcattgtgtttgtgtctcttttagggtcacagcagaagcaggggcagacttcagtgcctccaaataaattgcctttatgcctatctgctccccatccaaatacaactgtgggtgtggacatttgggatggaatattggggccttcgattcaggtgtggatgaatggagaagtcctgatcatctgtggtttaagatgtggaattaaaaggcagatggaattcgacaagagaatgatagatccaccaacagttcgcactgtgcacctggaagagctacacactcaatgccagcctgtgaaagcagccaggagggaggctgtaccctgcaaagccacaggggcagagctgcccaagaccatgggaacccacctcttgcatcagtgtgacctggatgtgggaattgaacaatgagaacacatggacacaggaaggggaacatcacactctggggactgttgtggggtgggggtagggggggagggatagcattgggagatatacctaatgctagatgacgagttagtgggtgcagcgcaccagcatggcacatgtatacatatgtaactaacctgcacattgtgcacatgtaccctaaaacttaaagtataataataataaatttaaaaaaaatgtaaaaaaaaaagatttataagagaagacatccattccttgtgaaacagaaggggtggagtgtacgtttctctggttatgtttcacaa

SEQ ID NO: 469888 - DNA, 1565 bp, Homo sapiens
tgtgcagcaaggggctttcccaggaggcctgcagctgggatggaggccaggactagtgcaaggtggggattagagactccaagccagggtgcttctacttgtaagaaaaccagcaagagggtcaaggagcccacgggcgtccttctgagatgagacatcggtgcatcctgaagaaggctacagaccccagtgttctcaccaggcaaggaaacactgagacaattaccctggcagggagagcgtgccatcatctccagggacctgagtcttcctaggaaggtaaaaatggctgccacataggtgcccccttctgcttgggatccccgtctttacctcgtaatcactgacaatgccgcaagtcccagtacttcagagaattactgagtgcgagcggtagtctggggaagctaccatgaggcccggggaggggactggaattgcccagttccggagcagccagggctacagtccaggtctccagagtccgcaaaaagggtaccgctccccactccacactgccccagtccagttcacagcactgagatgttgacctgggaggcagtgaggccagacctggatggccagccctggcagatgtcctctgttccttcacgtgagctgggaaacagggctgaataatattccattgtatggctagaccacattctgtttacacattcatctgttggtagacatgtgggttgcttctaccttttggcccctgctgccaggtgcagacttgggcactgatcttagcaacagtggctccacttttgattatttcatcatttcaaatgctgtcacatcagcagctgcttataccaccatcaggaaacacgcttcccacacaaacctcaccaccgtccacccaggctcctgcagactggccagggcaccagatgctaccagttcactggaaagtacactgaccttggagtccatagccctgggttggagtctcccctctgccatcgactatctgtctgattctagtttccagttcaagttcaccttgactgagattcaggatggagtggtgatttggccccagccccgagacattgcaatgctagcactgactacgccacttgtgaaggcttgtgtcgcagctgacctgagcaacagcttctgaacttttccacccaagtccactgtcttcaatttctcttcattcagcagccggagccattttttttggagtaccatctgatttcatttgcctgcttaaagcctccaatgactttggccttaagcccttctccgctcctccctccaacttcatgctgtttcctcccatgatgtctcctgctgtgtccctctcaggaccctctgagtgcctggcactgagctgagcattggaaatgcaatgaacactcaaggagactgctcagagccaagcccagagttgggcactgcaaggccagagaggaatcagactgaagccacaccttcaaggggccccacagtcccagggaaagatgtaccctcctccatagcctccagggacaaggagaagagatgaggagcaccctgctgccaactggcagctccatggtgctaaggac

SEQ ID NO: 469889 - DNA, 643 bp, Homo sapiens
tgacgtgtccatgtacgttatattcctaggggcacagagcaagatgaaaaaagagaatgaatctagaagaagcttttctgagaaagaagaactgactcagagtgctatgatggtcttgtttcaagcagatctgttcttagagcctgttggaagaaagcatttttcagtgactttccttgtttcctttgcaacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttatttctgataataccaagtctgacgctgaggttatgaatcattaccatggcttggagctattggatgcttggggtcttgggatagatagaagataattcacctttaagactctgttcggcatcattttctctaggaagtcttctatatcagtcactttaagccatggtatgcttccctaacaagcagttccccaaatctcagttacttatgacaacggtttgcttatttcccatgtcacatgttcatcatgggtcaggtgcagctggatttcatgtcttcttaattat

SEQ ID NO: 469890 - DNA, 802 bp, Homo sapiens
agcccacccgctacctattcccagggcctcctgtggagtcgggatgagggttctcattcaactttggtgcaaggttatgaattcggctgtgaatccatctggtcctggactctttttggttgaggtggtacagggacaatggtctgggtggctggaaaccatcttgggcaagctgcctgaaaaccagattgcaagatctgaatgcattcacagctcccaaaagcctcttttcctcccaaacagaatggggcatgacccccttggaacttctttaccatcaccccttccagttgaggaaatgaaagctatgggaaaccagcagaggcagagagctgacaatattctctttatgccaaatgtgtgctgccatctccacttgggctctttatctcttcactctaaagagactgtatcgaaggtgtcattgcaacataaacgcaacaatattatgactgccctcttcttcccaccctctgctaaaggctcctacagaaattgcttttgtcttttcagaattaaatttctttataaaaatagtcagcaaatatttcagcaaaaataaatgtccctaaatagccactctatccagtataagtcatcatcaccagtgctcctccaaaatgcctaaaatagagtccatgctcgcagttccctccaaggaacgtccttgtttagctaacctagttagaagctgtgagcttgtgcttttgggtcctgtgagagccttgtgtttttaaaataatcttgtctaaaaaccctctcttctcccaaaggaggttcaggatatgcaaatttccaagaa

SEQ ID NO: 469891 - DNA, 687 bp, Homo sapiens
ttcagaagatgaagccccagtgccagtccagtcctagaggggcctgggatggtgggaagaggaacaagatagaaccaaggttgagggcgatgcagcaacccagtgagccaatttggaaggagacagaggtgagaagcagcctcaatcctgtagacttatggggccacaggaactatttctgtaatatcattgcatcctgggacctgatagcccagccaggatgctgtcatctacttggaagccatggagatgtgaccagggaacttgggtcaagtccagctcagggatggtggtgtttatctggagtgacaagatgttacacagcaaacacaatggccagcaacgttaccaacaagacaaatccttgctccatgaactcccatgtgttcattgggaatctcaacactcttgtggtcaagaaatctgatgtggaggcaatcttttcgaatccgctcttgcacaacaccctgaatgccccactcaattccaacatctgtggcacccttctgctggcaatgctgagggttaaattggagaacctggcaagagccttagaggcctccaaggcaattgaaatggacaagcaacaaatggaggataggaatgaaaatgttaagaggcttcagctcaaggagtgaggggagggttgacggttgaactggcctgactaggttagtggcttttgct

SEQ ID NO: 469892 - DNA, 688 bp, Homo sapiens
ctagtgccatcgttccagtcctagggaccccaaggactcagtggtgctgatttttcttcacaaataatgaaaataggctagatggctaagccttttcattcagtcttaattttccctacactatcaccatcttttcttctcatttgctctcttcatggaagcagagtttgcaggattgaggttcttaatctggcctttctttatctaaactcttttattcggaagtctgttacagaagccaagaaaacttcagggaaggggcactgttctaagtgctttagatcaattaagccattgaatcgtcatgcaacccaatgtaaattttcctctgaaaagctccggatacctaagatgtcagaggaatccagggtggtgtgtgccaaagacattgccttatttctagggaggcggacggccaaggagcctgtcaatgaagtccataaagataagcttcttagaacatggatcaaggtggagagtgaatcaggagaggcggatctggaagagatccagcatcatccataaacagacctattggaaacaagtcttgctgtgcagggattatataataggaaaaataaaaataaaaaatatatagttgtttgaataatagtggcaagagtacttgttcttgccttattcttgatcttagggagaaagcatttaagctttcacctttaagtatgtt

SEQ ID NO: 469893 - DNA, 827 bp, Homo sapiens
cacccaagggctgaggagtgcgggcgcatggcgggggactggcaggcagctccacctgcagccccagtgcgggatccactgggtgaagccagctgggctcctgagtctggtggggacatggagaacctttatgtctgcagcttcactcctgaagccagtgagaccacgagcccactgggaggaatgaacaactccagaaacgccgccttaagagctgtaacactcaccatgaaggtctgcagcttcactcctgagccagcgagaccacgaacccaccagaaggaagaaactccgaacacatctgaacatcagaaggaacaaactccggacacgctgcctttaagaactgtaacactcactgtgagggtccacggcttcattcttgaagtcagtgagaccaagaacctaccaattctggacacagtgagaccaagaacccaccaattccggacacaacactgaaaaagagaagtgaaagaggacacccttaccttgtttctgagctgagaaagcttcttgtttctcaccattaataggtgttagctatagggttttgttaatgttctttatcaaatagaggaagttctcttctagtcctagtttgaagtttctattgacatatctttaagctgagagagtctttcctcagccttatgcacattactaatgagcccgtcaaaggcattctttatttctgttacaatgtttttgatctctagcatttactttttattctttcttagaatttccatctctctgcattgcccatctgttcttgcatgctttctactttatccattagatcccttagcatattcatcatagtt

SEQ ID NO: 469894 - DNA, 701 bp, Homo sapiens
acagacagttactcatgaggccacagcacagaaactgcaagaaatgtcagacttggggggcatccttcttcatccaggactggggggttatccttctccattcaggactgggtttgtccttctccatgtagaactagggggcatccttctccattcaggaattggggagcatccttctccatccaggacttgggggacatctttttccatccagacttggacgaccatctttctctatcgaggacttgggggaccatccttctccatccaggactcaggggacatcattctccatctaaagtacgagttccagtgtccctctctagacctgctctatcctgttagtttctttgtatgtcctggagggacatggatgaaattggaaatcatcattctcagcaaactatcgcaagaacaaaaaatcaaacaccgcatattctcactcataggtgggaattgaacaatgagaacacatggacacaggaaggggaacatcacactctggggactgttgtggggtggggggtagggtttggagggttagcattgggagatatacctaatgctagatgacgggttagtgggtgcagcgcaccagcatggcacatgtatacatatgtaactaacctgcacattgtgcacatgtaccctaaaacttaaagtataataataataaaaaaaaaaagaaaatgtacttttct

SEQ ID NO: 469895 - DNA, 691 bp, Homo sapiens
agcatgtagatatgataggcatacaaagaagcaatgacattagaagcagaggagggagaaggattaaaaggctataccttaggtcggttaagagaaaaagaaaaactaggaggagacaaattcttgttagaaaaaaataatgatcgaggcagagcaagacagtggtgcagacctctccagctatcatacccctatagaaacatcaatatgaacaactgtccacatgtgaaattaccattacaagagccaacagaacctcaatacatgaacaaggttatgaagcacctttggcctgtgaagatgggtaaaaccatggcttacagagtgagagaaccaatactctgtgactgtgatactcctccctcagtgccattatgccaggggctccctgtggatcacccatgggcccatccagcaaatgttgcagcagtggtggagccattggaagacttatgtctaacgtgggatttggactctctctaatgctaaaatggaatacgatggaaaagttgcctctccaaatggacaaaacaaggtgtcagcaactgaacttaaagacatacagatgaatgatctggcaggcaaagaattcaaaatggctgttttaagaagagcctgaacactgagaaagcagagacataattcagaaatttaccagtagaaattcaacaaagaaatcaaaataatggtg

SEQ ID NO: 469896 - DNA, 768 bp, Homo sapiens
gtggtgataaatgtccaggtttacaagttgaaaagtagcagtcaatgtgctacaatggatggatttgatccactcgatgtccagtggtccctggtcttcaggactaagcgtaaatttgcatggcagataggcagtttcccctttggctttttcaatcatctgctcaggagtagtgatactccaacctctgatgaaatccgcgactctgcacaggagcacgaagcgcagcaggagcgccacggtggctgccgtgccgtgggcggcggctgcagatgtggcttcccaggtcagccactgagcccaccgctgtcctcctgcctgcagaagtggctctgtgagccgtttgaggagaaaatgggggactttgggcttcagcccgaggagaacacggtggagatggaggagcccctgggcgtccgcaggttaactgaaaacatgagaggacacaagcacgggaccaagtctgtcactaacctggggcgcgccttgccatgcgtctccctgcgggcggcgcggtggtgctcctggatgtcacctccaggcgcttttgagactgcgaccggcaccgggcaccaggcacctgcggattggcctccccacgccgggttcagggacctccagcgctccgcggtgcaggctgcaggcgacctcaacgtggagctgctgccagcgccacaggccccaggggaggcccaggatgctgcttccccgccccaagaagggcagtttggaggaaagtctttggcctgatggaaggcggcgcccatc

SEQ ID NO: 469897 - DNA, 2710 bp, Homo sapiens
gccaacaccggaaggtggagtgatgggcacctgtgggacagccaggtagagacatctgaggcggcagctggggaactgtctggaactccggttgatgtgctacctgggcttaagatgtactcccaagagttaccaacacctacacttgggagtgggtacattatccagggaggagccaagattgaacacagtctgagtggaggaggccacacagcacaaccggggccagactgcagctctctgctccggggcccacctggggctgtcatctgccagccctgctttcctgtagaagatcccacccgtaccagccccaggaatctaggcaaggccagagcacctcaggagcctcctggagtgagggccacgacacctgggcaggctggctggtggcccctgggcagccttcctccccagcccaaggacagccaattacagcacagggcagccctggacagacagcaccagctagaaggacaggggcgttccctgcagtccagagcagcccccggggatgagcaaagagggccccagtcatcctgccagaggctctgcccccaggagcccctgcctgcctccctgaagcccacaaggaaggtgtcaactggggcctaagacgaaggcagttgaccatacccagggaacagagagcggcctgaggaaacgagacagcgaggggagtgaactccgggagggaaaaaccccaaggtttttccttggaggagggagcagatgagcggataagaccggtaaatccgtcacataccctcaggacgcagggagagcgcggctggaattggcagttatgcagaagatgcagccgggaatactggactggaacatgccggcgcttaagtgatgaacttggtgggaaggttggagaccagaaaatgaatgagtgaggcaggtcaggctctgagctcttctagaaggagctgaaggggttgaggaggcagaggtgagggaggaaaaatattcagtgcttaaaagaggaaaaatgaatagataagaggaagtatctgaaaaatgattaggaaatttccccaattaagaaaagatgcacatcctcaaactgaaagggcctgcagagtgttaattacattttaaagttaaaatcttatgtgtactttcaaagaaaagcatctacattttgagtcaaaattgctaaaaacttccaaagagaaaaagcaggtgatatctcattgtggttttgatttgcatttatctaataattagtgatatttagtgtcttttcatatgctcattggccacatttgcctgtttttaaatcaggtaatttgttgatttgttgttgaaccatggagacatatttttaaaccacaacagctatcttgcagattgcggtgagaactaaaagatttatgtatgcaaatcatattacctgtcacgtagtaggcactcaaaaattattacttgtcttcttagggttgttatgttaaataatgttatgttaataacatatgtaaaactgcttcttaaattataaagtgctatgcaaatgtgagttaatactacaaagctgtatgcaaaatattttaatatttttctgaggttctccatacttaaatatataaatctttccatctctagactttattctttttttagctgtaatcccttttttccattttacttcaagttttatcaaaaaaaaaatagcagccaaaatagaacaagtaaagacggagaaacaataactaatttcactaaagcaaagtcagagtaagatctatttaaaaataaaacgtgaagaaaagctgcaatggattacactattgaaaaatcctaagacaaccagaactgccgttccttcagagaatgtgagtgatgttgaaagattaataacatttggataacattaattacagtgatgttataaactctggtattccagttgccataacaacccgctatatgttggttttctaatgacatttcgaacaagtgttgaggcgaactgcatcacttcagaactttgattgctgtcactcagtgattttaaaattgaattgttttgttcttaaagagtcagaatatgtcactgtcttcagaaatattctcaaaattatggggaggaagtgatacacattcctatacaattatagagcactcaaaaaaaaagaaatgtattttgtttttaatacaaaattaacaggttttttctatagggaatagaaaaaaacagaaaggagaaagattatgcttcatgcttctcagaagactttgttcccttgcagaattatttgacaataaaattctttctagaaaaactcacttttcttgcttatatttctctcgtctccattctctcctttcttttcacctccctatttctttcttccaatgaattcttttagaagccatggattctggtcaaggtagatgcaacactttggagttagtgagaggaggtcattcctccatccagctttctgctttctgatctctcttccctctgctgaccaacgcgttgcccaatggatataataaaagaaagactacttgccactggcttatattatattggattttaatattcccaagagaatgtgttaaatatatatattgtgccactgaccagaagcaaagcatgattgtaacagacatgcttctaagtatttgctcagcccacagcctactctgctcctgctgccccacccatccacaaatatgaatcgtttgattaaat

SEQ ID NO: 469898 - DNA, 664 bp, Homo sapiens
ttagtttgggatgagtaaaggtgtgtggggtaattgccatgctttttggcaatcgggcatgcaaatgggaaggtcacaaatcacccagtcataccactttggacaaagaaatcgggagtgtgcatttctttttcttcttatttttgctttgttagaagtgtgggctatgaagatgggaaaaggccgtcgatcactctggattcttcctgcagacagggggcatagtggggtaggtgttgaccccaaggtgagaggagtggaactgctttgcagctgtctgagctgtttgagtgtactcacgcaggccaggctgagcttccaaggctttcatgacaaaggcattcgtattctcatctacagttttagtacgacatttacacaaacagtgtacaataagaaaagagactcagcttctcaaactacaagacccagtgaagccgtcccctgaattggtcacttctctctcccctcccttaaaaggcaaacaaaattttttcattgcttctcaatattacacaagaatctttttcaaaagagaaaaccaaatttcatgtttgcattattgcacctttaatgctaaagctagtttttattaaaattttataaatctatccagttttaattagtttgaccataagttaatgttcttataaaccttttataa

SEQ ID NO: 469899 - DNA, 789 bp, Homo sapiens
actacgttcggagcgaactgcagtttgcctgtgagggaccaatgtatttagaacctctctctatgaatcggtttaccacagccttaataggtcagttggtggtgtgtactttatgctcctgtgtcatgaaaacaaagcagatttggctgttttcagctcacgtgcttcctctgctagcacgactctgccttgttcctttggagacaattgttatcatcaataaatttgctatgatttttactggattggaagttctctattttcttgggtctaatcttttgctaccttataaccttgctaaatctgcatacagagaattggttcaggtagtggaggtatatggccttctcaccttgggaatgtccttgtggaatcaactggtagtccctgttcttttcatggttttctggctcatcttatttgctcttcagatttactcctatttcagtactcgagatcagccggcatcacgtgagaggcttcttttcctttttctgacaagtattgcagaatgctgcagcactccttactctcttttgggtttggtcttcacggtttcttttgttgccttgggtgttctcacactctgcgagttttacttgcagggttatcgagctttcaggaatgatcctgccatgaattggggcatgacaggaggacttctatcctacagtctatgttagaaattgcagatcctatttttttggcactgggagcatccagagacaagagcttgtggaaacacttccgtgctgttctgggaacactttttatttatgtctgatttac

SEQ ID NO: 469900 - DNA, 1782 bp, Homo sapiens
aagaagcttagtggggtagacagacaagtgacaagtttgtgctttcaataaagtatgatggcagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaattcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaggaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggtcccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaacgtggaaattctctagaggctatttccagcttctgtgtggattgtagagcaggctgctacctgt

SEQ ID NO: 469901 - DNA, 903 bp, Homo sapiens
tctcaggctcggtgtactcgcgatccagaggccgcccaggccatgttccactgcctggacacccaagctctcgctcgcgctcccagcatcgcagaaccagggccaaatgtcaccgtggctgcggccaagccaggcggtctgcccggcggcggctgcagaggggcgagaactgagaacctgccgctcaaccccatctctgtaggctgcggagtggggtccggactccctcggacggcctggccagcagttctgaggtccggcagaggaggagggcaggaggcacggcgaaggcagctgccaggcaacctccaagcccgccagcacccccagcctcgcagaactcgggccagtgtcgccgtggctgcagccaagcccggcggtcggcctggcggcggctgcactaaaaacaaaaactggcctcagccccatccccggtggctgcggagggcccctgccagcggccctatctttcttcaaaggaggagcagggcggccagagcggccgggagggctgcgcgcctgcgatcctacggcgtcccaggggagcccaagagaaccgcactgctctaagccttttcctgctctggaatagctactattgttacctccattgtagagaaaacagatgggggaggttgttgtggaaggaccagggaaactgactaggaaattgacttagattctggattttatttttttttttggggaagttcaagtatgtctttgcaaggattatccagcatgtctacctactcaatcatattatcagaaacagaaaaagtgtccagattcttgtcttgtcctgttcagattttttaaattccaagaacagtcaccttctaccagacactctgatgttggaagacaaagcatatttggtaagtggcatgatttctgggctcc

SEQ ID NO: 469902 - DNA, 483 bp, Homo sapiens
gggtggtgcaagatgtgctttgttaaacagatgcttgaaggcagcatgctcgttaagagtcatcaccactccctaattgcaagtacccagggacacaaacactgcggatctgagctttgcgtgaaggtggaaggtgctaggggaggcaatgatacggcggtccgaggcctgttcatggagggccttccaggccacaagcaccttgacaagctgttgccaggacacgcaagtgggatggtgtctcttgtgcaactgataagaggaagtgacccttggattgaaggaagtagaaagattaaatcagaaagaatcaaggttcagagtctgcaaagccacaagccctctgtatgggccagcaagcccctgggcctgagaggcatcagtaattgtcacccgagttggattgaactgaaataaagaagtaaagatcctatatcatctattgaaatctttaaaagggttgcaagatatgcattactaatc

SEQ ID NO: 469903 - DNA, 877 bp, Homo sapiens
aggagtgggccaacttgggaggatggcctggcttccagagagcctgggcaccactgctgttttgtttgaaacgttgaagacttggagcaagtttggaagcaattcgaggatgattggagaaaccgatcaagtccatcgcccttggtggcttgcatccaaattcattaactcacccaacaagcactcaaggattgccatctacgagggaggaggaggagggggagtgtgtgcagaatcagtgactatgataggatgtcactcctgtgattgtcacaagtcagttgacattgaattaatcaagagggagactatccaggttatcctgggtgggcctggcccaaccagaggagcctttgaaagaagccatgtaagacgacgtatctgcttccccttcaccttctgccctgattgtaactgccaaaccgcatcccagaatggctgtgccactttatattcccgcagcaatagatgagtgatccatttttctatacatcttcaccagcatttttaaaatgttgaattgtggtaaaatatatataacataaaatttaccatcttagccatttataaatgtacagctcagtcatgttaagtacattcacattattgtgcagccagtttccagaactctttccaagttgcatatctgaaattctgtatccattaaacaacaactcctcattccctcctgcccccagcccctggcaaccgtcattctacttcctgttgctatggatttgactactcgaggttatccaatttgttgagagtcgttcatagtattctcttacaatccttttttatttctgcaaaatcagttttaatgtaccctctgtcatttctgattttagttatttaagtcttctctttttttctt

SEQ ID NO: 469904 - DNA, 1073 bp, Homo sapiens
gaggcacagagattgtgcagtttgtctactgtgttctcagccttccccaagatttccataacaatgtgtccttgtggggaatggggcagtccaggctgaccccaagggtctaacaaagggacaaaaccaagagacaacttttctgagtcaaagattctcaaatgaaatggatctgaatggtaggccaactaaacaaagcggccaagtgttttataccctcctggccagagtcctccctggagttcacagggctgccttctgcccagcacccactcctgccaaggtgtgcaggaaccaggcaagtgccctttttgccatcccgctaaaagtagaggatacagaagaacaaggaatccaagagaacgagcaacactctctgggaaatggaggtgctgtagcctcaaagggagccaagcgtggtcctagtgcttcgggcccagggagaggtgagagctgctgtcccctgagccgggggcgtgcctgctactcagttgctctgaagagtgggagactgcagtgggggagcttggtgaaggaggctcctgcctgcagctccaaccacacatggttagacaaggaagctcagataaccaaggggagtttgcagaagttcttcttagctccactctatcacctgtttgtgccttaggcaggcacaaaccgttgaggctgtgctcctcagcttcaccctcactcttcctgtggctcgcttgcgaagtatcaaaacatgtttaaattgtgaaaacatttaattcaaaattaaatttcaaaatcatagacaagactgatataacagacaagtgaagacccacaattctgttttacagatgttgtgactttacatgtgtacttatatatatttttctctcttaaaaggagggaaggaagaagggagaaagggagggggagagagagagagaatgaacattactgaggactaaactctgaccttttttctctcttgcccaaattcctatctaagggactggggagtcatgccttacagaccataaaatctcatcagttgggtttcatttaactgtatataatgtgacttactttccaacctgact

SEQ ID NO: 469905 - DNA, 731 bp, Homo sapiens
aaggaaaatgaggttaagcaaccagcacaggctctcacagcctttccctagatctcagaagtgaaggatggagtcaagaacttcagggcttccaaaccgaacttctcctagtacattttactgcctttgcatgtatcctgtgctgaaaacatctgctcccctgagctcagctaggacaataagagcatattatcaacggttaaaggatatcccaggccctccagcaaatgccttctggaatcatctccacattcagacccatcgtaaacaacagaggggcaatactcatgcttcgcaaaagccgttcattccccttggcaaaggcgggagagagggctcaccaaccttggagaagcctggtttacatcgtcaaggtgatgagcattcagaacttggctctgactctgaaaacaagttgagcattccaaatccaaatccaaaagtcaaaaatccgaaatgctcccaaattgaaaactttttgagcgccaacgtgtactccaaggaaaagctcactggagtattttagatatcaaatgtgcagacttgggatgctcagctggaaccaccattccgggagcgtggtgttgtagcggacattactactcaacagctcacctctgaaaaggtagaagaggtatcccatctagccaaaggattaagatagtcacttttgtagcagttgctgtgggaatgattcgagaccactggcctgactttcagggaagaacagg

SEQ ID NO: 469906 - DNA, 754 bp, Homo sapiens
gaaacggacctagaattggtttaatgaagatgtggctcatgagggcaatgagcagcaggtgggctctgctctctgggcaagcagaggagtctctctccatggccaccactgtccaggcccatggcaagtactgcctgggtaccacggatgttgactcaaggccaagggaagggcacttcagtcagcttgaggtaaatgttgccagtgctgaatctctcccttcagggcagtgggctcccctctggccaagggaaggtccagaaatgccatccaggaaccaaggcctggaactggggaccccaggagtccacttggtgctctatcccactgtggtcaagctggtgcccaagctgttttgggcccgaccttctgcactcttgttctgtgaagccttgggcccagagtacaaacagttggtattggcgaatagcctcatggaaaatgctgcagtcgtcacagctcacgactggtgtccttatgagaaaaggaaatttgaatatacagagaagcaccaggggtgtgcatgggtagaaaaagactatctaaggggtcatgaagcagtgctggattccctctgcaagctgagtccacgtcctttggggatagctgtcacctatagtatagtcatcatggtggagtctccaaagctttgagaagcaggcataaattcattttatttatttactgggttttaaaagttatcttacttgctagacaatttattatttgcatattagactttcattagttaaac

SEQ ID NO: 469907 - DNA, 1996 bp, Homo sapiens
gtgcattcgagtctgagggctgctgggcttttttagcgacgtctgcatgcatcaatgtccctgtagcctcatccgcttctctgatcattttcttccccttctttctctaattgttttctgaggatatgtactgtttcccctgcagcccacctaaactgttttttactctcacagactttaggcctgagagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggatttaatcgaaatctctgttatcagttctgttttgaaggtggtggtttcttgatgataccagaaggtgtcaacagaaggttgtacatctctcagtaacaaaaatgtagtgcggcctcatctactttgggcatcttctttcttagaacttttctgcattcacaatcacttttttaatgctaatcacagtatagtctttttgaagacatgtcatggcagttagactcaatacatgaggtacaaacagtgcagtgactttgttgacatgctgacagtactaatagctatgactaagttctcacaagcatgagcagtaacaaccgcaaggcagctgccatttagccatcagcagttctaagacatatcttgacctcaggaatgctaaattgtgaaaaggtgtgtgtcttagaattgatgaaatttggtattttatgatatgttatttctaggcgattagtgtagtttcttaactgtcctccttacctccagctgtgaatgtgatgtacattttaatctttcaaaacctagtaaaactacaacagcttcccagataaagtatacattttatcaagggtctacatttcttcctgcctctcctactttatctttcattaaacccccttcataaaccttctgttctgtccacagtctcttgcttttcctctaaacatgggaatgatgtgaaaatcacagatgggaaaggatttgaaatccactctttgctcagctcaaatacataggaatggttactccctcactacccagagccagtgcatcagtcagtcctacagagccagcctccaaaactcacccaagcttgcttcactgtgtctccactactgcattccagttcactccatcctcactcgctcctgcaatggcttccaccaggctcccggattctactctttcctttacagtcaagttcttaaacagcagccagggtggcctttaaatgacaggcttgtctagctgcaagactgatatgc

SEQ ID NO: 469908 - DNA, 2021 bp, Homo sapiens
tcctgggtgcatgcggaacagaatagggagtccccactggggcaggcgctggcagctcttcaccgtgtcagctcactcagccctcaggtcgtcctatcctcagcattttccaaacctccccactgctcctggtggggcttcacaatcgaacattgtcagcccagagctgacacccaagccgaccacagccctaaagcatgctgagtgcctcttggacctgaattcccatagtctgtaccgaaagccacgccccaaggctgcagtttacctcaatctcagtttgcctttgaaatctgttcacaggctatctctgaaaaagtcctttgggtttggaaaacgggactttgaaaacaattccgtttttattgtagattcagggggcacgtgtgcagatctgagagaattcttctggtggtccaataatctgtgtggagctcgcgccaggagcctggaagctggcctccgtaccccgacccctgccccgccttaactctcccatttcatcagctattgtccagttgattctacttagcaaaggtccctggaattatccaaatgcctgtcacccccactgctactcctctagttcaggccaccattacctctcactagattggtcccctcaccctccactaaccttgcttgcattcaatctaatttccacaagatacatggcgtaagctttctagagcccacctcagctcctagcattacccccttgaacttcttcaggggttgcttacatgcttgcaaattcccaacatgatatgtgtggaccttcacaatttggcttcttcctgattttatatgtcttgacaacctgtttccccctcattcccctcaccctctcagacccctaatatgctccaaccattttgaactactttcagccaattcctggctgggggatcttggggaagtcaatcaaccttcctgtacctcagtttcttcatttgtaaagtgaagatggtagcagcacctgcatgggttgttgaggataaaataggttcatatatgcccagtgcttttagcagagcctggcactgattctgccacctcctcgtgcctctttgtatgcagaaactttgtacctggaacttcctcccacttccttcggcttgcttttgtagcgtggtggtcaccacttctgtagaatgagccgcaggccatgttgcatcgtaatcgtctgcatttcattctgtccacgcaccacactagaagctctttgagagtagggactgtttctccgttgccttgacacaccatagtcaatcaatatttgctgatataaagaaaaaaaaacagctcacaaggagagactacgccaaattccagaatcaaataaaaggacaaaagaaaaagaaacaaagaagaatatttgatattatcccctgctttcttggtacacctgcaactggccgccagtgagaatgtactaccaggtaattttcataaccaacccagtgtaccttgaagcacagctggtttttcaggcatttagaatttcctagttttcattctaatcttactgaattttggggggtggtggggggtgtgggggggcgggaacactgatggggtagggcgaagagatacctgggcctgctctcaggctcagaataccagggaaatttcagttttttttttttttttttttttcgcccagtagtctaggctcaaaaacaccctgtggtttctacagtgtgggtgctgttctgttcccaccgctctgaaagatgacggtaacaatgtggatttcgactgcagtgggcatttctgtgagacggctcctttctcccactgaagctgcagtttgagattggataatcttaggtgttggacccttgaccgtgcttttcatattttgagtcattttgtggaatcttctaatgttagagtgtaatgtttgcctaacattggctgattgtcactgttttaacattggctgactagacgtgaaacttttatcctcaaaatggcccagtcacgtctggttaaatgtgtagcatcatttttacctg

SEQ ID NO: 469909 - DNA, 1059 bp, Homo sapiens
tccagaaaacagagaagcaggaagaagtgagaatcccgagaaggaatgaaagagacaaagcatagagatgctcacagattggcctgtcacgcagcccctagatggtggttctgggccagggtactccaatgttcatgtcagcaaggtggaggaacttagagaaccacaaatccacactatcaaaggatttgatatgcttgaggtctgcaaattcctccgtaacagccaaatggggacccagccctacccgccctgcctgttgttccaccctaatctgaggccagttaccaggaggctgagcctcactcagatgctcagaggcggcaggccagcatcaagctgtcagccaggtggaggcgaggtgctgccgtgcaaaagccggacggacagcgagtggggaagtgtaggagagatggcctttatcctcgacggcaactatctggtaggctccaatggggacatagggaagccttaggtgaaattatttctaaggttctgcatgaactgtccattattatggaattaattcttttgtttcaggggtctggataagtttctgatgttgttgtctaggatctaggcgtagattcaacagatacctccaggtggaccttcaaaacctttgtgtattcaatgtatttcaataatttgccttgaagaaaccagatatgtgcacaaagttatctttttggtaatgtatcacagtattgatacatttataaaataatgggaaaagtctacatggagagaaataagatcagtcaaattcactgtgtcttattttattctggcaaaagaatcatttttcattcactcattctacagctgcatgttggccctgtgctgatggccagagagcaacagtgagcaaaacagacatggcctctccttaatgaaacttagagatacagtcagataactcagaaataaatgcaattcacaaatcatgccatgtaagatgtgcctccttcctcttcacctttttcaatgaatcgaagtttcccgcagtctccccagccatgcttcctgtacagcccacggaaccatgagccaattaaa

SEQ ID NO: 469910 - DNA, 891 bp, Homo sapiens
tagctactgattctacctcatgatgcccttgccattgggcctctgccctatttccccatttgccaccacactcgttcagttgttcatcaccttctacctggaccattggaacagcctcctagctgctctgctgcctccagactttgccatcatccagcgtcccctgcaccaggtgtctctcacggcagttcagctagagacacagaagaaaaaagatgggctcgatgtaagtcaggtgaatgggtgtctgggtaagagtttgtgtgtagcagatgccaatggggtgggggagggagagcgggaggatattggctatctcatggctggaagatttgctaccacactggctaggctttctcagtcactgattgggtctgcaccaggcagcaaagatttcactgtcatagacctgcaggcagatgagctctaactttagagaatgagaatatcgccttaaaattagcatggcctctactagagcactttaagctaaagacatttcttgtcaacaaatacttgttgttgttgttgttattttgctattttaagctaaaaaaggtttaacaataatttttcaaattaataatatacaagtcctcaataaaaagaatgaaagcaaagggttttataaacttttttagaaataagaggtttttattgcaggagcaatacatgtttatttttgcaaatttagaaaatgaagaaaagaacaaagtattttaaattgcttagagtccaactaatcatgaagtgtgtatatgagcatatagatatgtatatatgtatatgtacttatgtgtacgttaccattttactttttctgcccaaaattaaagtcatacataccttctattttgtaactttctatttttcagttcacataatgcaaac

SEQ ID NO: 469911 - DNA, 811 bp, Homo sapiens
gattcagaaggtggtggtttcccaggggacaatgggaacttccacggaatgaggggctctcgggccttcagtgtcccaaacctgctcctcccatgatctttccagtcatggtaaatggcaccaccatttccccaggtgctcagacccctggggaagacatctcggacacatcattcctacactcaaagcccgtgaacggcttcctctggcaactggagtcaaacatcaagtcctcccggagccggagagccctgcagtactttggctgctctgtggcctcacctgggacccctggccgcaggcctccgcggagctggcagccaggaacctccagaggctcccaacctagcccgtcctgcaagatgaagctgcttcttgggaatcttttagctcaggatgctgtgttccatattcacgacggcatttccatgctcgtgagggcaaccagtagaactgttctctgtgccggacgagcaccaatggctccgctcctccttgctgcctccctgagtcgctctgtccctgggactgctaagggcacggggcctgtagtgacggttccggccgccagggaagatgctggagaacagcatgcaggctcagagaggtgaagtgacttgcccatggtcacactgctggggaggtggagaagccaggatgtaggctggcttaactgtgctgctattctgcctcatggcatttagtttgaagagaaggggcttcaggacaatactaacctaggtgcacaggttgtccttcccgttgctaaggagccctaggcaagtcagttaatctcagagtctgtttcatc

SEQ ID NO: 469912 - DNA, 1017 bp, Homo sapiens
cagattgttatagaaaataaacttgctctttaatggggaatgggagagagggctgtctgcgcaggaatgagggtagggtgtctgtgggctgagtcagctttgggctcctggttctgattatgcagctcatgtatggtgtccttgctatcaggcaacgtggccgctccataacccacagtgcccagggcatagcacctggaggataccagcaagtaggcgggcagtcaccacaggacctcccagcaggacaagggcagctccaggcccagggctcccatggtcagggccaaccagggcctctggtggcctgtggcctgcaggtgaaagggagcccccagcctcttctttacactcccagcgaacgacatgagcagtcattttctgggactggagctctgcctgcacccctgccctggccactcacacctcagccgtgctcccctgtcctgcccctgagagcagaaaccagagagtggaggccctatggcaacccaggggcctccagtttaaggaaaatgcttcacagggctttgctctatggtccaagcagctactccctctggaaagaaggttttgatgtgcttcctccttctcgttcctctccaaagaccctcctccaaccccatatctcaggcagatctaggaggtaaggaccaggtttcaggactggcttatttcattcatccaacaaatacttgttaggtctttaatatgtgctagcactagacaatcaaaaactacttatttaacacagattttattctcagcacagtgtctgatactcatccccttccctgagaatgaataggtaccagaggcagtgggaagagagtatctgagaaagactgaaggctgcagggtcaccaaagataaagaaaagaccctcctggttagtgagcatttagtcgagggcatgaggggaaggtatgtcttcaaacagtggtgctcaaagctgcagtgtgctatgatagggtatagctgcagacacggtacctgcctttgagaagtttcaaaact

SEQ ID NO: 469913 - DNA, 925 bp, Homo sapiens
agctgcattctcaggcaagggtatggcccgagggctgctaatcagcaggaggcctcctcttgggcaagctgccctcattgtctcgccttgcctaggcctgctggccaggttcacaggccagagacagtgccactcttcctcaccttctcgggaacgggaccagcagatgctgtgggaggctgggaaggagggaatccagccccttgcaggttcatcatttgaacagcaaggagctgcaggccccttccacacttgcgagggtcggctatggattgtaacagagctgccggctttcaggaaccccaggttctttcccaccattgcagtgtttcctagccgggacagcagagggcgccagctctcctgccagcactgggtcccgggccgtcctcccgcacatctggaaatgggctctatcactctcttgcgaaataaggccagggatctgtctgtgtcggatgaattggcacccgaagcacttgtggaatgtggggaatttgccttgccaaggcggccaacacatctgagtcttgggcttggtcaggcctcggtggagcgcttggcgggaccacctctggtctgaagactttgcccttccctccgacatgcagagagggggaaaaagtaaacgggaggacaggacctcccagatcttttcccctggggaagaaaactaaaaatgtttggtcctgaccttccgggccctcctgaagaaagcaaatgtcccacattaacaggtccttgagaaagaagatataattccaagaaagcattttcttaaattacaagtgatcagaaataccaaagaagatttaaggtttgcctgcaacagaccatctacaaatgtgagacttctcttcacctaagcagactggattggggcctcattttgcagagcaagcaggcctacttcattttcagattc

SEQ ID NO: 469914 - DNA, 627 bp, Homo sapiens
cagggtagagctgctcaagaccatgagaacccccctcttacatcagcatgacctggatatgagacatggtgtcaaaggaaattattctggagctttaagatttgactgccctgctggatttcagccttgtgtggggccggaagtcctttttttggccagtttctcccatttggaatgcctgtatttatccaatgcctgtacccccattgcaagaagaacaaaacaagaagtagaagcagaagcagaagcagaagcagaagaagaagaagaagaagaagaagaagaagaagaaggcaaaaaggaggaggaggagaaggaggaggaggaagaggaggaaaacgtaaagaagcagcagccgcagccctattttactttcgcttcaggacaggcccctaggccattaactttgtttcttccccaagacctagacaccggcagttccatcaaggaggtgatcataatggacgcttagtgtattatgcacttactaggattagagtgccaggctttatgtaagttatctcatttaatctacatggaaagcattacttgcattttgcagaataatttaaggtcttacctcactcatgggggctacttggaaagccccagtagaccaataaacac

SEQ ID NO: 469915 - DNA, 1066 bp, Homo sapiens
tgggaagcttcttcttttttttttttttttgtcatttaaaagcagggcctccatgtgatttctctctccctgcttttgccaatgttcagccaatgtctagactgccctaggaagagaatgaaggcgctgaaggcgctaagccactgcagatgcacgctgcctctgtggaggtcccaccctcctgagctctctggaaatcctgccccaggccagaagtattcagggacgctgaccttggagccccaggcccggtcacatttccagctgctccctgcctatgaggacagccagaggaatgttcccccaacatgtccttggctcacagtcctttctcctaccacctcacagaggctgtcctttttgttcctgtcatatccaaactcagctgcagaactcatttcttcccatggaacccccacactgcagactggctggcttgcccagagcagcgtgaaaacccacagaatctggattaggactaaaccttgagaagatctattaaaactccctggcagctttcaagcaaacacattacagtgggttttgttactcattaaggaaaacaccgtgcttctccgtcctcacctggagaaattaggtaatcagcacagattagttaaggatttcaatgcaaattgcatcattttcatggtcattaacagtggtgtggtttatatctgttttcagtcctaaaaaaacgtttcccaggtaactaaagaaaatattcaagggcagaaatatcaggcgggtaagatacttaaaataaatgagccatttgttcctgcttctgtataaagttgctttttcaatttcagatgacatgatactgcagatcaaagtggggaaaaacctttggagtaagagcgcttttcttccctagatatgactgacttcgttgcttgatttacagcacttgattaacctggttaaatttctgcttctgtgcaagtctcagatgcagaactagggatcgtcaaagcgtatcattatgatttgtgcttgtctttcctccctcacaacacaggacctcttcctcaaagacttatttgttatatttctggtgtct

SEQ ID NO: 469916 - DNA, 3553 bp, Homo sapiens
cggttggatttgatcctcctgtcaatcattaggggcagctggaaaccatggagctggagcaaagggaggagcaagccagacagaatccaaggcatgtgagggtcaggggtcaaacaagggagatcaatcaaagagtcagttgtcaatttacccaaagcaagccttggcgccctggaagagaagttgcttctgtgcttcccaaaggagatgcaggctcaggactcagccaaagtggggaaaaaaaaaaaaaagtgatagctaacattcaagtggcacttttctacacgcctgagatagttttgagcattttccaggtggaaaaactacagcccaagaggccaaggaacctgttcaaggcccaaaacttggtagagccaaggctcaaactcaggacctggctccagagtgctctcctcctcagcaccaccacgctgctgcctggccggggaaaggaggtgggctccctcttccttcacatcacaagtgatcagagacgcgacatttcagggggaaaagtatgtctggcaactacaaatttgtagcttgctgatatggcgcgcgcggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggtaaatgcagaagtatttaagagctcatacaggagtacctgcctcaggacagggaatctgagatgctctgcagagctggatcttaaagaacggattaagttgataaatgatgcatacgacatcctatagaagactgtcaccaccccacctcactgatcagccctctgcctacagccacacccacagaacattcagccatttctcctgtggttcccagcctgcagcacagcgtctgcacgtggtgagggctcccaaatctctgaggaatgaatggctcactgctgagagcaaccttctgggagttcagggcatgtggaactggaataagagcaacgtgtgaacagattacaggaaggcaatgcaggacagctggaccctttggggggaaacttatggggaacacagttttcttacttataagcactgagattgcctgagaggggagagatgatgcagagtgtcccaaatgtatttgacgtggaatccttttaccagcgaaacatctcttgggcctagagttctgaaaattgcactttgaaaaacactgctctcagctcttacaaacctcgtgttttcatcctaactgtgcttcagagaattgtgtcccagcaggaaaggaaacccccgtataattccctacgttgctagcatttggaagtgggatgaaaatggacctacattcaaacccctaatttcaagctctgaaggaggtaccaggatccatcacgatgcttgtaaaattgttcctttcattttcctggttgtaaacttatgcagactgtaaagtcaaggcaagcctgtgcccagcaaataataagaaaataagggaggcatggtaaacaaaacaaaacactttgagagttggtcaacttgctgttattttgagctgtttctaaaaatctcagggtagattccctcccctgcttgcctccttaacccagtcctttttcttcctcctccaggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaatatcctgcgtaattgcaaaaggaaagaaaacaggaacacattgtttctttttgattgattaagttaattgcacatgtcaaactttttacttgtcagcatctgaagtttccttgaagctaataagaactttcttctggataac

SEQ ID NO: 469917 - DNA, 824 bp, Homo sapiens
cctccaccattggaaagtcaactcctgctacgtcctgttcagcaaggatttgagcaggtttggtgaagattgcttacgcctgtatagagggggtatgatactctggccagcatatgcacacgaactgccaaaatatggtgtgaaggttggcttgtcaaattatgctgcagcatattgtactggcctgctgctggcccgcaggcttttcaatatgtttggcatggacaagatctatgaagcccaagtggaggtgactggcgatgaatacaatgtggaaagcattaatggtcagccaggtgcctttacgtgctatttggatgcaggccttgccagaactaccagtggcaataaagtttttggtgccctgaagggggctgtggatggaggcttgtctatccctcacggtaccaaacgattccctggttatgattctgaaagcaaggaatttaatgcagaagtacactggaagcacatcatgggccagaatgttgcagattatacgtgctacttaatgcaagaagatgaagatgcttacaagaaacagttctctcaatacataaagaacagcataactccagacatgatggaggagatgtgttagaaagctcatgctgctatacaagagaatccagtctatgaaaagaagcccaagaaaaaaagttaaaaagaagaggtggcactgtcccaaaatgtcccttgctcagaagaaagatcgggtaactcagaagaaggcaagcttcctcagagctcaggagtgggctgctgagagctaaaccaaacaattttctatgaggatttttcagataaagacaataaacttgtgg

SEQ ID NO: 469918 - DNA, 463 bp, Homo sapiens
tggaggcattaaatgtgcctggtgtgttggggacacctcctcttaaggagaagcagctggaggggggctggggaggcgctggatgctgcggacccaccagccctgcggaccctcctggtggtctgctgccaggctggctccttgggctattgggatgaagataatgagaacatgtttgtcaactgtgcagccctggtaactcaacaggtggtcatcacaatagtgacatcttcttcttcgtatccatttatcaaaccaactgtcatgccagcccatggacaacagaaggcacagaccccttggatgatgggcaccttcactaaacagagtcagctcagatttccaaatacaagtattaagcaggggccccattactgcactctgttccatgactgatgtgcccattcccctctcattgccgtgtaggtggttttggatttggggattggctttgaacctgcaa

SEQ ID NO: 469919 - DNA, 626 bp, Homo sapiens
gggaagccaaaatgccactggggctgtccagcaaccctgaacgtgctgtttgtgtcctcattgtggtgctgtttgccagccaggcaggcagggaggttcggggagagccggaagccacggatgccccagcgagtcatgctgtcaattctgtgcctcagtcccgtctaaccaaggataagccagtaccttggcagcccaagaaggcagtccttaggcagacgtctgctgcccgcaggaaactctcagagcagccacgctctcctctcagacttttggcagagcccccgccatttcttcatgtgggcacaggtggcctggctggtggctgccccacttcccaaagcctggatcttgagccgctatctggaacacagcacactcagctccagatcaaccacccaagccctctgctgactgcaatcctctggaccacatgataagttgtgttgttttgttttgttttgttttttgttttttaattatggtaaaaaatacataacataaaatttgccatcttaaccatcttaaatgtataatagtattaaatatattcacattattgtgaaaacatacaaatatattctgttgaaatatttaaaaataagttgctgaaattttgatacttc

SEQ ID NO: 469920 - DNA, 890 bp, Homo sapiens
ggctccattgcctgtggttccagagtcacctgggctgaagggtaggtagatgtggcctaatccataagctccgtgctggtcagaagtttgctgggcaagaggcaaggctgtgcaatggttcagagatagcccagcaaatgctctgtaatgaggcttggagtttcaacctcactgtcttgagcagaagagaaatgggcaatatgacatatggaggtgccactgaaacaaaacaccccaaaatcttgagtcaacacagtggggatagcactctggagtccacactggaacggcagtgggtttgtctgaatgacaaatacacttgtggcctagaggaagaggaagtgagaggtagagtagaagcaagcccctgtcagggtcctggcagggaacggattcactcggatggctcaaatgaggagagtgaatgcagggacttcttaccgaggggtgggcagggtggaaggggtgaaggagagacgctgcagcctccagagcccggcgacggcgggaagctgcctccagagcccggcgacggcgggaagctgcctccagagcccggcgacggcgggaagctgcctccagagcccggcgacggcgggaagctgcctccagagcccggcgacggcgggaagctgcctccagagcccggcgacggcgggaagctgcctccagagcccggcgacggcgggaagctgcctccagagcccggcgacggtgggaagctgctaccagccctggcctgttatggaaacctggtgacagtgggacccctggaggaggaggcatgggcacagaggatgcagggatgccagagacaccccctaacttctctcctacctcctcatctcctgctggcgactccctatggctgaaccccaactgaagccagc

SEQ ID NO: 469921 - DNA, 542 bp, Homo sapiens
ggagagagatgcatgaaagctttcacccatgttgctctgtgttcagaggcggcggagtggaaggagaactggctttggagccaggaggcccagctcagagcctggctttgccactagctctgccaaaggacggcgggcaattcacggtaacggcagcttctttgtctataaagcagagacacgatgcaggtcccaccagctccactgacaagttgcattttgcaaagcattgtgcacggcaggagcatgcggtggacttaggaggacacactgtggtgttggagctccttggtggcttccagctcttcagtgcctccaccgacacatatgaaggctcacagaatgccttctccacctacatggcagcgcctacgtcagtgactcctatcaagggtgggccctactgcaaaagaggaaagtaaagcggaaaaaagttcagtccttgatccagaaccagataaccaaggcacaaagacagagcttgcgtctggctctgattccaagcctggggcttgttccggggtgggagactgctgcctctg

SEQ ID NO: 469922 - DNA, 558 bp, Homo sapiens
gttcatctgtacatccatccttccacctacccatctatacattcacccaactgtccaatgcccagagctccccttcctgctagtctgccctctccaagtagatatccagaccagatgatccatggagactcagccctggtcttcctatgggctgcactccgagatggggggactcatccactccgaatcaccagcagctacctcggggccccctgcgacactgatgagccaaccagcgtgtttgtttatgtgcccacagtagtgggagggccttttgtgaaggggagaggcagcttggcattactagaaggacatgttcagacacccaaggatgtgtgtgccaggaccagaaacacttcccttcctgggagacaggaagggctggtggaggagttggaactgctggaggacattccaggcacagcatgggatatgacttgtgagcgggatggagctcatgggcatcatgagggcctctgagaacctgtttacaacaagaagcagaggaggggcgaatttgctctctgggacattcctttcctcctgccctcatacaac

SEQ ID NO: 469923 - DNA, 1008 bp, Homo sapiens
ttgtgatggggctgtgtgtgtcaagagggaattggtctaataggatggatttctggggagagaaagggagagcatgctgggagcaaagacaaactgaaacagagaagtccagtgaaataagtacccgatgtgagattcacagaacaactcaaaatatttctagccagtattatattgtcaccccagattctcctgttgaatggagcacagcttctgatcagatttgtgtctttgggagaagagcttgcgaacaaataaacaaacttgtttctgagagccaaaggagggatttcgtaagacaagagttcacaaaatttacctgtgaacacatgggtattggagaggtcctcagagatggtttcatccaactggtcaattttccagatgaggactgtgagcatccaagaggggaaataacttgcccccagtcacccatacattcaattggtagcagaccctgactacaaccttggtctacctcctcctctttcctcctccccaagcttagaaaattagaggcagcaaccagtgtcatgttaatggacatttatgtggtttttgaaattttgctattataaatctgtgacaagcattgtgtgacatatatatatctttgcccccaattctgacaatttccttggattagattcctagaaggagacttactgtgtcaaaagattttttgggggcagggttcttaaaatgtagcaccaaattgctttctaatgtaaggtgctgttagtttatacctgtgtccacatagagtaatattacttttttgaagtttttgctaacttaatagtttaaaaatgacttaaaaattatttatggcacatttttatttgtttgtgtttttgtggtcattaatttgcatttatcttgtgaattttccatgtatattttgttgatttttccattggcattctagttgttttcttatcaatttgactgactctatatattcagatcaatctttctttttattacaaatgttttcaagtttgtaat

SEQ ID NO: 469924 - DNA, 984 bp, Homo sapiens
gcacacaggacggagaggatggggagagtggccaccgcatcccctgggatgagaagatttcagtcagcggcctggctgtgttgcagcccttcccctaagaggaaggaagccacggttcttgcctagcagagagaaagcacagattttggagtccagcagacttggaggtggatctcagctattctgcttcctgctgtgtggcttcaggcaagtcccatagccttcctgagcctcagcttctcacctgtaaaatggaagcaagagttcctctttcatggagtggcttgatgtggagggacagcaggcccacgagaagcccccagaccgtagggaataaaggacaaccaccacgggtcctgctttcacagcaggaatggatgccattatcaacttacacagattcaccagaacttggtgctggggcaaactgcaggagacctgaagctaaacaagatatatacagccacagaagaccaggccaggcagttacaacagtctactcctttctcttgcctacgggtaaaatgggtacacacattctagaaagcagtttggcaacatttatcaaaatatgtttaaaaggttcacaacctttggatacgggaatatatcccaagaaaacaataccaaatacagaaagagccatatgcataaaggtgttcattatgtgaaaaattaaagcaaattaaatgtctatcaataagggattgggtaagtaaaccatcccacatcttcttaatggattgtaaaatactatacagcaatttaaaaagaaatccgtaaaacttccataatatggatatggacatatatatgaactttcagcctccagtactgtgagccaagtaaatttctgttgattacaaattatcaagtctcaggtaacacatgttaacagcttattatgtgtctttccatgtttatatgcagatttgtataatcctgtacagacctgtgtcaacatacatgtatatgcatacaaac

SEQ ID NO: 469925 - DNA, 631 bp, Homo sapiens
gcctcctagaaagacagccctggctccaattcagaaatcggatgagagaaaagccagctggaagcagggagggtcattaccaagccactgccacaatctgggcaaaaggtgatggaggcttctaccaagggatggaaagaagaggagcatttgagggagatccagaaggtggagcaaaccctagagggatgaggaagaatgaagactcaaggaaggctcctgagggttctgccctggcaccagcagataaaggacatgatgtcttggagcatgtcctctctggatcgggcctggagctgggggatgctggggctcagaattctcaaggaaaagtcagccagatcctcttctccacatcaatttcatccttggccttcttcccaggcctttcactcacctgccacaggaaacttcaggacctaccccccatggaagtgccaataaatgccctgaataggcattctcttatttgccactactttaaaactgatgtaaagtgaccaaagcattctttccagtgccttcctctctccagctgatattgcatgctttacaaatgagagagcaacaaagcaggttttgggaaataacccatgagattaaacctttcccaacaggggagatgaatacc

SEQ ID NO: 469926 - DNA, 951 bp, Homo sapiens
cccagcagcccctcagctctcctcgtaaccacgggtgggcagtctccaccgtcacagcccaaagggtcttagccatcgggtgcctgtccctagtgtggcaggcagatcgctcgagtccaggagttctagacctgcctgggcaacatggcgaaaacctgtttgtattaaaaatacaaaaaattgggcgtttccgggagcgccccgtggagttggtgtagccgccttttggcatggcggccttttccggcccggctgccaatcctgtcgctgaacccacagaaagatgtgggtttcagaaggaggtggcacaggttctgcgcataacccagcgagaaaaacaagaacaacttactcctggagtggtctacgtgtgccacctacataacctactgaacgaaacccagattctttcatattcctcccagtgtggcactgttacaagcttcagactatccagacagaaaaggactggaaatagcaaaggctatgcatgtgtggagtatgagtctgaggatgttgccaagatagttgctgaaacaatgaacaactacctgtttggcgaaagactctgggagtgtcattttatgacacctgaaaaagtacagaaagaactctttaaagactgggatattccgtttaagcaggcatcatatccatcagtgaaacgctgagcacctctaggcaataactcagcagctatttcttaaatacctaatgagtttcaggctttgctgttgggctgggaatcttgacatagatattgcttcacgattctccaagtctcccctcctcaccccagctcacagtgagctttcttatgcactgtgtaaatttctctcctaacaggcccaactctctctccaacctgcttcccagggcagttgtgaggatcaaatgagagagaatatggatgaaagcaaattgtaaatgattttaaaatgcaataaaaat

SEQ ID NO: 469927 - DNA, 997 bp, Homo sapiens
ggatctggtaacatggcaaaagatgccggtctaattgaagccaatggagacctcaaggtcttcacagaccagaaccttagtcctggaaaaggcgtggtgtccctcgtggccgttcacccctccaccgtcaacccgctcggggagcagctcttggcaaaaacctctggacagtccaatgtcaacattgcccagcaagtggtagttggtacacctcagagaccggcagcgtcaaacgccctggggaaccagccttccgactcctcaccttggtctgccgggaagcgcaacagaaaaggagaggataatggcaggggcctgcggcatttctccatgaaggtctgcgagaaggtgcagaggaaagggaccacttcctacaaccaagtggcggatgagctggtcgcgaagttcagtgctgccgacaaccacatcttaccaaacgagtcagcttgtgaccagaagaacataagacggcgcgtctgcgatgccttaaacgtgctgagggccgtgagcatcatctccaaggagaaaaaggagatcaagtggattgaaacagtctcaacttcaaaacttattctacagcaaattgccttcaagaacctggtgcagagaaacctgcacgcggagcggcaggccagccagccgccgccagccaactcggtcatccacctgcccttcatcatcatcaacaccagcaagaagacggtcatcgactgcagcatctccaacgacaaattcgactatctgtttaattttgacaacacatttcaaatccacgatgacatagaagtgctgaagcgggtggagtccgggagcttctctgctgaggaccttaaaatggccaaaagtctggtcccaaagactctggagcgacgctggccacaaagttccaatgggtctcagtacagcagctccagggtggagaccccggtgtcttacgtcggggaggacgacgaggaggataatgacttcaacgagaatgaggaggacgactgacgtg

SEQ ID NO: 469928 - DNA, 664 bp, Homo sapiens
accatggctggtccggaagcagttcctccaggggtattgggagaaggaagaaaggacctctctctccagtgtgatggccacagctgtggccacgaaaatgctttactcccccggtccaccctgtgaggttcttcagctccccctagaggctggagtatgttatgagcaggaaccacagcttcacctgtgggtaggagcccatggtccaccctgtgaggttcttgagctcctcctagaggctggagtatgttatgatcaggaaccacagcttcacctagacttctgtggccaaagatttagtatccaggaagagcatcagacactcctatgtccatcggaagaaatcgatggccctcagcctcattttaatgctaaagacatgagacatcagtggaaaatgaagatgtgggtattgtatttgcaacctgaattcatggcaagcttgcagaaggcaggaacatcttacacctttttttgttacccatttcctaccaagggttgggctcagcacgtggtacagagagggcacttcatgaatgtttgttgaattgaattgagtgccataaattataaaatagattcatgaagattcagttcctggatttaaatatatcagaaagatttcctcagaattaacacaatttagcaattttaccagcctaaa

SEQ ID NO: 469929 - DNA, 2694 bp, Homo sapiens
tagatacggcaggaactcgcatccaggaacagagccctttgctcctccctcagaatgaatggggaccagaaatcagatgtttatgcccaagaaaagcaggatttctttcagcacttctcccagatcgttggggtgctgactgaggatgagatggggcactcagagataggagatgctattgcccggctcaaggacgtcctggagtacaatgccattggaggcaagtatcaccggggtttgacggtgctagtagcgttccaggagctggatgccatcaattatgctatccttctggaagcatgtatctactacctgctgaagctctattgccaagcacagccctattacctgaacctgatcgagctcttcctgcagatttcctgtcagcctgagattgggcagaccctggacctcatcacagcccctaggacaatgtggattttggcagattcactgaaaacagaagatcctactggagatcgagagttttttcaaattcaggatggttaccttgacctctttggggaccccactgtgacccgcaaagttggcactgacatccaggacaacaaatgcagctggctggtggttcagtgtctgcaacgatccactctggaacagtaccagatcctgaaggaaaattacggacagaagaaggccaagaaggtagtccaggtgaaggcactgtatgaggagctggatctgccggccgtgttcttgcagtatgaggaagacggttacagccacattatgggtctcactgaacagtacgcagcgcccctgctcccagccatgtttctggggcttgtgtacaaaatctacaagcagaaaaagcaataaatcatagtcctaggctcagtcagctgtcttgaaaatgctgcctctagtcataaggcagatgaatctacaaaaacccaaactgtagaaaaacgatttggcgttgtcctgtcctggtgatgggatcctaatagcatcttcaagcagaaataaccacacagagctcccaattataaataaaggatttgttgtatttccatgtctgtgggatgttaccaagcaaggtttccctgtgagcaactttggacactatgcaaaacgtgtccagatccaaaatagtggcaagcagtttaagttggggacaatacaactgggaggacacatgcaaaagggtggaaggtgaaaaagagggagtatggggatggccacctggccaccaaaggtcctcaccatcagtggggaaaccagtttcacccagttggccttcatgcagagtttcagcctgtgaaagggatggggaaggaagcatagggtctgagtggccccatgggatcaggaggaagtggtgtaggaggaggacgcccagtgactgagagccagtgaggactgctgggaggtcagatgcccccaactctgtgacattgggcatgtttcttactggttttaagcctgtttcttcaacagtaaaatacggaaaatatctacttcagagggacatcatgaagattaaaaattatgtatctaaagttcttcacagatggacaacaaccattaaacagccattacactctcccatgctgcattagtcaattttctgttgtttataacgaaatacctgaaatgggtaatttgtaaaggaaagaaatgtatttttgtactgctatggaagtcaggaagtccaaggttgaggaggtgcatctgtcaacttcattgagatattatttatctacaataaaatgcaccagttttaagtgtacatctctatgagttttgacaaatttatacacccatgtaactactaccacaatcaagatgaagaatatttctatcaccctaggcaaagttcttagtcaatactcacatcccagcctcaggcaacaactgacctgctttctgacactacgtattgtccttttttgagtttcacataaaggagttaatacactatgtactcttgtgactggcttttttcactcgacatgttttagagatttatctattctgttgcatgtaccagtagttcattcctttttattgctgagtgacattctgtctcatggatattccaaagtgtgtttattcactcccctgttgatgaacatttgggttccagtttggactattatgaataaagctatgaataatataggcatatgttttatttctttggggtaaatatccaggagaggaatttctgggtcctacaataagtgtatgtttaactttataagaaatttccaagctgttttccaaagtagtagtacaattttatattatcatcagtagtgtgtaagacttccagttgctcattttcccaaaagcttggcattatctatctttttcattttagctgttctggaggatatgtagtggtctcttgctgtggttttaaatgcatttctctgatgactaatggtgctcaacatgttctccagaacatcttttccatgtctactggccatttgtgtatctgcttttgtgaagtgtctgttcaaatcttttacccatgcttagtattaggttgatgatgatcttgttattgaattataagagtatcacctatcacaagtcctttatcagatattagtgtggtacagattgtctcccattctgtggtttgcctttttgagagcttttttaaatagctttattgagacgtgacttcttaagtaaaccaaagctgcctctgccaaaaac

SEQ ID NO: 469930 - DNA, 441 bp, Homo sapiens
tgcggcaggatggatgtgagggttgaagaaaacgggatcaagctccctgggtttatcagtggggcaggtgaagtaggaccatttaatatgatggggaagactgagggaggaccagggctcctcagctgtgatgaaagccacctaactatccagcaactttctggacccctctgcattgccctgatggcacttggaagaccaggggaccaacagaagcatgatacttatgtgatggttaaatggcatgtagtacctgggcttcaatatcaaagatctggtatggagtggaagacactgtggaaaattggagggcacatcccatctgaagtaccagtcagaccagccaactgctgccaccgggccctgatgttgccagatctgctacttttccaagagaatccagaaatacggattttaaaatgtaaactctattgactttaa

SEQ ID NO: 469931 - DNA, 603 bp, Homo sapiens
tactcagagctgctcacagatattgttgacagcatctggcgccacccccatcaggtaccaagggtccctctcccctgctgagtctgttcagacatggggcactggggcttccgagtccctctcccctgctctgagtccgttcagacatggggcactggggcttccccgccaccttcatccaagtataaaaggcatcctcaaaaaaacccgcagttaatatcatacatacttaatggtaacagactggatgctttccctcctaagatcaggaaaaaggtagtgcagggtttatctcctgagacagagatggaaaggctgatggcagcatgggtcggggaggagatgttgtcactactggggatgggaaagccgttccttctggcaaaaaatggttcatcagagtttacaaactcagggtccccagcctcaccagggtcctcccacacatcctcattccaagttgcagggtcccattcttttccaatccatgccctcactttaacagtagacacctagcgaggctgtgcatgcatctttcattgcaggtcagcctctcacatgataagagcttgtgtctgtttttccacaatttcagttctttct

SEQ ID NO: 469932 - DNA, 657 bp, Homo sapiens
tatcctgtacttagagctgttcctcagacttttctgcagccagggttacctggcagaccccctttctgtagccatggcattggctgagcaaggctcagtggtagcagtttcacagcttgggttctccgggttacactctggcagctgtcaggtgtcttttacactgagccttaaaagttggacttttctggatgaaaaggagttgggtggcttgagcagaggcccaggtgtgtgggggacaggcttgaaatgtggtgtcccaagaacaccaggtgaaggcatcagtgctggaggtgtcatggaccttaatactgctttacaagaggtcctgaaggctgccctcatccatgatggcctagcacgtggaattcgagaagctgccaaagccttagacaagtgctgggcccatccttgtgctgcccccaactctggaatgtgggaggaacaatttcagcccaagagcaagttgaaagttttctcggggaggagccaagttggccgaataggaagagctctggtctgcagctcccagtgtgagcgacgcagaaaacgggtgatttctgcatttccatctgaggtatcaggttcatctcactagggagtgccagacagtgggcgcagtcaaagaaaggggtgacagatgacacctggaaaatc

SEQ ID NO: 469933 - DNA, 806 bp, Homo sapiens
tctctctttttttttttcatggaatgcttcacagatttgcacgtcatctagcaaaggggccatgctcatctctcacccctcttttggacccaacaattttgctgactctccattccagaaagaggctttagcaaggcctaatatggaacctcatggaaaagctgtcctctacccacttaaaacaggaaaggacaatgggcacttctgcagtacatacatagcagaagcacccacctgcccaaaatctgagtcatccttgattcctcctttttcattttcctctacaatcaaaccatcagcaagcactagcaatactaccttcaaaatatatcttcagtatccacccacttattttcacaaccaccacttgacccaaggtgccctcatgtcttactggcatgactggaagggcctcttgccttatctcctcacatcctctcctgccctcctaccaatcactctccaccagcaaccaaagcagccacttccctgcttaacacctttccatggctgcccaatgtacccaatgcataaaatcctaaccgtttggccctgcagccttgcataatccatcctgtgactctctctccaagtttatgcgacattttccatggctcactcttctccatcaaactggattagaaaaaaccagggcctttatcaagctgttccatgcctgggatgctcttcccactggtcctagcataaatctacttttcttatttttcaggtctcatcttgaaagtcatttcctagagaggctttctatggccccctaactaaagtaggtcccctctgttattttc

SEQ ID NO: 469934 - DNA, 921 bp, Homo sapiens
ctatgatgcaggtactgatactgctgccattttcagataggaaatggaagcccaaaagtgaagaagcaacatcttaaactagcatagagagaatgtactagttagcatgatggatgcagagtatcaaggggaccggaaagcagcccggaatttagcaacattaaggtcaaggatgaccttcacaagaacaggtacctgccatggagtgattggagggaatcagataaaggcagtgaagaaggacatgtttgcttccccttctgccatgataccatgtgggccttctttcaattcccatgagagaagccgtgctttctgccctctagatccccctgcatgtgctcaccaactccgctcatcccttaggtgtcagctgaagtgcctcttcttcaaggagacatatctgagccctgctcccatggagaaagagagaatgcccaagagtcaagccctcccagtcggacctggcatagggctacgtccttcatgaaacacagcaattagaacatagaaggtgctcaatgcatagtttttgaataaacataataaatacacaagcaaatgaataaataaataattgaataaattattgtgggtatgccagagtgtaggaaaggatttgtggttaccctggtcaaaaaagacatcttggagaagctgaaattcagctgagtcttaaagggtaagcagaattcacacaaagagaaagtgaaaagatgcttgcagaatgggagaaaatgtttgcaaattatacttcagataaggaacttgtaaccaaaatacacaaagaactcacaactctacaataaaaggacagacagcccaatttaaaaatggacaaagggtttgaataaacacttctccaaagatatatgtatgtgtacattcacacaagctagacaagatgaacaagaagcacac

SEQ ID NO: 469935 - DNA, 634 bp, Homo sapiens
tgggaaaacacctcttgcatcagcatgccccaaatgaagaagcttttgttctcagtgctgccaaaacttccatttttcagcagtgacctcagtttagcacctgcttataagatgtgtttgcacatcgttggaaatggctcacatattatggtggctaagaagtcctacgatctgctgtcttcaaactggagaaccataaatgtcaatggtgtaattcagtctgaatctgaaggcctaagaaccaagagaaatgatggtataattcctggtctgaatccaaaagcaggagaagatgtcccagttcaagcagaaggaataaattcattctttatcttccttcttgttctatttgtgtcttccatggactggatgttgactgtccacattggtgagggcacatcttttttgttcagtgtacttatagaaatgctaatctcttccagaaacaccctcacagacatatccagaagtaatattttaatagctatctggatatcccttaacccaatcaagttgacacataaaattaaccatcaaaagctctgacatgtaaaaagcttttttttttttttaatacttttactggacccattagagaactgaggttccagagtatattgctaccttgaaatat

SEQ ID NO: 469936 - DNA, 2091 bp, Homo sapiens
aggattgctggatcctacaagcccagaggcttaggaggaaaaatggctttgagggctgggccctgggccttgctgctttgtgcagtctagggatttggtgccctgcatcccagatgtggctgaaagaggccaagatgtccaggcagacagttgctgcaggggcagagctctcatggagagcctctgctagggcagtgcagaaggaaaatgtggggttgaagccctcacacagagtccccactgggatactgcctagtggagctgtgaaaagagggccaccatcctccagcccccagaattgtagatccaccaaagcttgcactgggcacctggaaaagccacagaaacccagccagcctatgaaggcacctgggatgggggctgtaccctgcaaagccacaggggtggagctgtccaaggctgtggaccatggcaagcaaagaggacagcagcttgcccagaagctggggaatcgggaagttgccagatcatgtgaagacttgggctatgaagaatgctggatttcacatcaatcagagttcaaagccactgaaggattttaagcagcatgattgtttttgttgctgtttttaagtgtatttcagttgtggactaagctctttgtctagtcttagacaaataaatgtgttaagtcttctaacggaggctgtaaactgcctcttggagagtcaaatatggagtacagacatttatttgtttttcaatacgctggcccagttttaaatgtttgtttgtaactaacatctggatttccaggatttctggaatgatcttccaggagctctgtgaaaggagaatatcaggcaatgttggttggcatttcccatgacaacaatcttcagttgtgtttagatgtcttatgaaacagaaaatgagaatattgagactataggctatagggctctggtcaaaaagaggtgacaaaaaggtagtaaagattcagaagatgacaactgctattttacttaatctgttagtatccatatgcctgtttcatttataaagacactccttacaaagcagtatacattttacgtattcaataatgcttatgaaaaaggaattgacgaaaattaatttgcgaagatgagagactaatagaaggaaaaagtatattgactaaagttagacaaataatggcaataaaaagcttaagatattatggccaaatttgaatctaatgctattcaaaagaatttagcatttataagaagttaacaggcttttacaatattcccagtagctttttcctccattgctgtggatatttatatggttttaaatctagcaactgatttaagaatctggacctaaatatagcattataaaaagccttagtattcttcctatactcaagtgccatacattaatatgcatttcataatgttcactgtaatttagtgagtacatatatcatcataagtttaatattattgtatgtttaacctgttggcaaaatcgagtctaaaaaagaatctaaatggaagaaatttaacgtgggtttacaaagagaacgaaagagttgacatttagttcaagtaaatggttcttgttctcaattagagcatccagtgaatattaacctcaaaagtatattttatttgctgaccacagcattcatgagatatgtgtggttgaatatctcaactggtcctgaaactttcttaattcgtttcgtctcttcttccatgaacttacacagctgtttagttcttttgtaaacagggaaggctaggcactcttgcacagatctttttagcatatgaaacatattgacatgaatataacatatgtgccaaagcaatattattcagttaacatttcaacgaaatgcaacataaaattttaaattacatatttctgcatgtgtttgattcttgtttactgtatctgatccagaaaaaaggaagactctcattgtgaaaaaacatctctaataccttagcattttaatatcatctgaaaagaatagttataaccagtcataccagtcatttatttttccattgcttaaaattaccaggtagcaacatggtaaattcagttgatcagggcttttgattcaatagc

SEQ ID NO: 469937 - DNA, 1036 bp, Homo sapiens
agcgccctcatgttgctgctccctgcgcagcgcccggcttcaccctctgcggggatcgccgccgcaatgtcccgagagcgcttctcctctcctcctccgccaccgcgcagccagggcggccccaactcagcagctgaagttacttctccacaccggttcaaaacccgagaaaacaacgctgccaggtccctgccacaacgacttcaagtcccgccattatgccacctctccatcttcaccccggagtccctgaggcgccgggaaaagctaattaataggacaccgcgacgagagtcccaaattcgcttcgggccgagccaacctgtgtctggcgcgtgctctcagccactctgggacagagaggctctcgagcgtactaccgactctttcgaagagacagaagagaagactcccacacgcacccagtgcctcacccgacccggagcagcccggctaaatccgaccgggaccctggtgtgacccaggccaaggagctgggggcggagggccagctctggggaaggttggctatgttagtgtgcaaatagagaagggcgatccaaagaagaactttagagagaagcaggttcttggctctggagcaaagagctttaactgaaataaggatagctaataaacctgtctttgagcgttaagaacgtcccggaagttcctgtagcaaccataagactcagaaatcatatttccacgaaatgaattaatttacactttaggacctatttcagtctcccactaccccttctccgtataattttttctcgttttctctccatgttcctttgccgtgtctacatccttttgacctggggattcaccgtgatttctgtcaacgtggaaaaaaattatgcatcctttcagctacgtctgttggtagcgagcctgctaacattttctaagaaaagatgaacacttaaggccaggaccccaaagtcaggcgttaaaactcagtccaaagcagtcagttacacatattccctaccctaccccttcccctctgaaaagcactttcacttac

SEQ ID NO: 469938 - DNA, 1733 bp, Homo sapiens
gtagtccgagcctgtactcaggagccggagggctccacccctgggtctgtgcccatggacctaggtgaggatgggcatttctgttttcatgcccaaatgttgcattttccaagaccaccctgtccccccacccctgccatcctgtgcctataaaaacccaagacccagcaggcacagacacaactgtctggatgtcaagagaaatgcatgggcagaagagcatacaggcagctggacatggagaggagcggaagaacacacctgcaggcaccagcagatgccagcaggccatcgaccagaggaacaaggcagaggcttaggggaaattggttgggatggttggaggatagttcagtggaaagttcagttggaggatagttcagaggatagttcaggactgagtggccccactccaggggaaaaccaccatcccactctatcccccttctggttccccatccacctgctgagagctatttccactcaataaaaccttgcactcattctccaagcccacgtgttatttgatttttccgaaatggcagaagacagttgctaaatgttattcagcacaccactgtaaaatggtactgactttgcaatcagatatacctgaaagccttgtcttatactgtataaatttgtttcctcatctgaaaggagcaaattatgtcattactaatatcatgggtttgttgtaaggattaaatgaagtaatcatcataaaatgtttagcatgtcttggttcatatcaaactcattacattcttatttcagttacagatttcatcctcaaaacatcccaatcacgttaattattaacagcagatgctatactaagacagactgaatcagtcaacatcagataggggtcacgaccttggttgaaatgaaaaaagtcaaagaataacagatgctgttgaggttgcagagaaaagggaatgtttatacactgttagtgggaagccctatataaagacttcactcatatctataaaaaacaggctttctaatgttgccttagggaagattaggaagtattcagacataatagcttctatagttattaacatattttataaaatattgccttaaaattcacatgaaaaggacagataatttgcactatgaaatggtctattttagtttttttccttagcaaatgagtttggattagtataaacttgcctattcctagacatgaaacttaacttattctaaaagctaagcagtattttcttctgtataaaggaatgaatggagtctgtgtctgaaaataaagtatatttatctctctgtattccatgtttgttattatcttcccacataacacaggtcataagtgcaagcagagccttatgagggaggaagcaacctattcctcgaaatttaattttttcccactcaggtcaccaatgaaatcatcgaaggataacatgggaaaagtttatatttgcctttgaatctaggagagtttgcaactcacagatgggaaacatcaagaataactgttataccctgaagatataaggaacacattaaagaccaattttcaaatatgctacaaaccacaaatagtgcaggtcctgggaaaatacataattctataaaggtttagaatgtgacactagtcattaatatgacatttaaactgtctttatttaaagaaaatcaataacattcttaaaaactttcagtataggttcattagtactgtatgtcatctaactggt

SEQ ID NO: 469939 - DNA, 567 bp, Homo sapiens
ggacgatataatcagcttctccaaaagcaagtgagcggatacattcgggacgcgaaccgaatccccggtcagcaatgcgtatctcgtctgcctcgccattcagcgctgccgcccccgggcgcactgattgctgttccatcgacaagacgcaatctctttccgcttgtacaacccgtaactgcggcgcgtacagcaagtgtttgtgcggcaagtatgccaaaccagtcggcggcattccgcagccgcttcaggagagccacccagccccagacgtagcagagttgcagcatcacgaatttcgcggcggcgggttagagccccggcattacgtgccgaagtatccagttcttcgggcttaccaatatgggccagaattgctgaccagttatcttagcgcttatggggaggttccccagctctgtgtcactcccagatgggctgttgtcctgccttgcttttctccattttccatgggttgagttgtttccttgattaatctcaatgcatatacttgaatgtttcagttgaagttactgtatttaccaatcatttctgttcctctctgtg

SEQ ID NO: 469940 - DNA, 784 bp, Homo sapiens
ctgcttccctgagctggggagggtcccctgcctctgttgcaaaaagaaaactagaccaaattcagatggcgcccgctcatggagggagcatttaaaccagcccttagagaggaattgccaatgtcagcgtccgtgacacttggagagcacttctggacccacttggggcctggggtatctcgtcgccctgaagggaaggtcacaagcctggctggcattgccacctgtttattgcagagccccagggctttgggcaaacataagcagcagccagggaatggaggaaaaaatggttttgggggccaggcccagggttcccatgctgtgtacagcctagggacttggtgctctgagtgccagccactccagccactgctaaaaggggccaagattacagctcaacccatggttttggagggtgcaagccaaaagtctcgacagcttccatgtggtgttgagcctgtgggtgcacagaagtcaagaattgatatttgggaaccttcacctggatttcagaagatgtatggaaactcctggatgcctaggcaaaagtttgctgcaggagcagggagaacctctcctagggtactgtggaaggaaaacgtgggatcagaggctccacacagagtccctactggggcaactcctgttggagctgtgagaagaggaccaccattctccagacctcagaatggtagatcgaccaacagcttgcaccatgcatctggaaaagccacagacatcaacaccagcccatgaaagcagtcaggaggggtcctatact

SEQ ID NO: 469941 - DNA, 589 bp, Homo sapiens
gagcccagatattttgtgagcattacctattggcactatggccactgggcctaatgggtcagttggcctcgacaaaataataattgctacacaggaacagtaccagaaaggaagccagaggctgccgcagtttgttgggggtccactccagaccctactcacttggttcctctcccacctggaggtgtcaccagtggaggctgcagaacagcaaggatggctgcctgctccttcctctaatgtccagacccttcagagacagcaggcaggaaagactaagtctgctgaaccacagagactgtggctgcccctccccacaggagttctgcccaggaagatcagagttctgtccataaacctatggctggacaccaccaggggaaaacagccaactggagccacagtgatagtaaccaccccttcccctgggaactcagtcatcttagacagtctccagtctgctgtcactggccacagcctgagcggtgatgatagtctgcacaactctgtgcttggcacgcaaggccctggtggtgtgggctcataaggggatctcctgatctgtgagttgcacagatccatggacaaa

SEQ ID NO: 469942 - DNA, 545 bp, Homo sapiens
agcagcaaacttccattctctgcagaattaaacaccctggaaaaagacacttggctttatcagttatgtcttcctgaaccaatgatatggtgatcatttggagttggagacatgaagagcaacaaatggagggaagagtcactctgaaaactgaccatgattgtaagctttctgaggccatcaccaaaagcagatgcctgcaccatgattcctgtacagtctgcagaactgtaagatttcagagaatgtatggaaaagcctggatgcccaggcagaaacctgccacagggctaaatcccccacagagaaacactactaaggcattgccaagggaaaatgtggcattggagcccccatacaaagtctccccagatgaactgtctggtgaatctgtagaaatgggactgttgccactgacagtagaggacactgtcaaggggacagtagagccactgacagattgcagcttcaacatagagaatctgcagacactaaacttcaacccacaagagcagccccaggagaggcacccagtatagccatgg

SEQ ID NO: 469943 - DNA, 1243 bp, Homo sapiens
tgacgtgggaattgtggtagttacaattcaagtacatctcttgatgaaaagtcaaaagtttatagatctaatctggcttattcctgaaaaattactaaaagatattaaaagatatgtggacttcagtgtcaccagtggagggtgtgcaggttcttggcatcatgaacaagaattggacaaaatgcgcaagcaaagcaaggaagggatgaagagatttattgaaaatgaaagtacactccacattgtgggaggaggcctgagcataggggctcaagggcccagttacagaattttggggagtttaaataccctcttggggattccattggttacttgcggtatgccctatgtaaatgaagaggatgaagtaaagttacaaagtcatttactcggcgtacgccttgtggagaggatatttcttgacatagctaaattatttatggaccttaagttccttgcctccagaccctattttcctgcccattccccactgagagatgtcattcccataaatctttatgggaggcagaggaaccgatagtcttttttctgtaactgcttcatgctggcttcgggcgtagtctcttcctattagggatcacgaaactctcaccctgctctgtctggtggaggcgggttagcttcttgatggccaggggtggtgtcttcatctggaactggctggaacctttgttgcatggtcatctgaatgtcgatggtctctgggcaagaggaaataaatttggttaaaagatataatgggaacttcagcgggtagatacctatgctgtcaggaatgttcattatggagatttgcaggagaaaaaacaaaagctgatccgttctaagacctatgtgtttccttaaagtcttagtgcaaacgactccattttggtttggtttggtctgttgggacctagtacatgagcttagtccaaaacaatggcctcccagaattttgttaaaaaaattccccctttttggtcaggttctcattaaggtgagagtgtgaccaaagcttagagccttagcaccactcagttatcatcattttgggtttccagttttagtacatcatttataggttatggtgtccttatggtgcacatttctttcagctcattattccagttgaagagagaccatatgacattctagagatggttgtatgcaagcatttaaaacctttgagagaatacagcacaccagggagactattattatgactattggaaggataata

SEQ ID NO: 469944 - DNA, 1414 bp, Homo sapiens
gctttcctccctggatagcatgagcttcaccacttggtccaccatgttctctactaactaccagtcccttggctctatcaagccgccaagctatggcgccctgccagtcagcagcatggccaacatctatgcaggtgctgggggcttgggctcccagatctccatgtcccactccaccagtttctggggcaacttggggtctgggggcctggctgtggggatggccaggggtctggcaggagtggagggcatccagaatgagaaggagaccatgcaaggcctgaacgactccctggcctactgcctggacagagtgaggagtctggagaccaagaaatggaagctggagagcaaaatgcaggagcacctgcagaagaagggaccccaggtcagagattgggggcattacttcaagaacatcaaggatctgagggctcagatctttgcaaatactgtgagccatgcctgcatctctgtggagagcgacatccatgggctccacaagatcactgatgacaccaatgtcactcagctgcagctggagacagagatggaggttctcaaggagaagctgctcttcatgaagaaccacaaagaggaagtaaaaggcctacaagcccagattgccagctctgggttgactggggagcagtttgaaaagagcaccacagtggtcaccacgcagttcgccgagattggagctgctgagaatacactcacggagctgagacatacagtccagtccttggagatcgacctggacccaatgagaaatctgaagctcagcttgcagaacagcctgagagaggcccagaagtatgaggccctgctgaacatcaaagctaagctggaggctgagatcaccacctaccaccgcctgctggaagacagggaggacttcaatcttgatgatgccctggacagcagcaactccatgcaaaccatccacaagaccaccacctgcaggatagtggatggcaaagtagtgtctgagaccaatgacacagaaatcagcagcagcattaaattcacgtaggcacacgaaccctgttgtgaactgcacctgtgagagatctaggttggtgctccttatgagaatctaatgcctgatgatctgaggtggaacagtttcatctcaaaaccattcccacccccacccctgtccatggaaaaattgtcttctatgtaaccagtcccttgtgccaaaaaagttggggaccactgctgtatcttttttattttatccaaaaagctgcaaatagcatttgctataatatattacaagacttataatactattatctagaaaatgtactttttagcctttctttctgtagaatattagggaaaaatcgatgagataattaaaaaggaaaaagtggaaatattcatgaaataggcagaaacaactatt

SEQ ID NO: 469945 - DNA, 544 bp, Homo sapiens
aaaattaaaaattattattattattattattttctttttattattattattatagtttaagttttagggtacatgtgcacaatgtgcagcaattttagcatatttaagacagttgtttttaagtctttgtctactaccgcgcctgtccactttcctgttttttcttttgtatgccttgtgatttttattgaaaattggacatttgactattacaatgtggtaactctgaaaatcatattctccccttctccaggtatttctatgggtggacaagagagcttagagctgcctactccaccatttttgctgacatcactgccattaacttttaattcacaagaacttttgggttacaaagcacctcaaatttctatagtgactcagtgtttctggagtattttgagatctacttatttgtccaatttagttctactcttgatgacggatattgttcttaatgatgaccataatttccgtatttaggttcctggattcttcaatcttaaagaaaaggatattaatgagtaataagaaatcatctgac

SEQ ID NO: 469946 - DNA, 2075 bp, Homo sapiens
aggagtgtgtgaaaagtaagtgacagatgctttttggaggctgcaaagtccaagatcaagatgctagcagattctgtgtctgtggggagcccccttcaccaggcccttcccagcctccaacacctgctcagcgcagccctgacccacgggagctgccttgaggctggggggcatgacccaccaggtggaggcatgaaacggagggctgtcatgggcccaccccaggtgcaagcctggaaggccctggacctctgggagtcctctcaagtcatggaagggaaggccgtggtgccaatgggcaggaaccccatgatgcgcaaggccacccaaggacaactggaaaacagcccagctctggagaaactgttgcctcctctgcaggggaatgtgggctttgcgttcaccaaggaggacctcactgaggtcagggatctgctgctggccaataaggtgccagctgccacccgtgctggtgccattggcccatgtgaagtcactgtaccagcccagaacactggtctgggacccgagaagatttcttttttccaggctttaggcattaccactaaaatctccaggggcaccactgaaatcctgagtgatgtgcagctgatcaagactggagacagagtgggagccagcgaagccacactgctgaacacgccgaacatctctcccttctcctttgggctggtcatccagcaggtgttcaacaatggtagtatctacaaccctgaagtgcttgacatcacagaagaaactctgtattctggcttcctggaggtacccccttctatcatcagtgggtacaaaggatgcctggctctatctgtggagactgattacaccttcccgcctgctgaaaagatcaagaccttcttggctgatccatctgcctttgtggctgctgcccctgtggccactaccgccacggctgctcctgctgctgcggcagccccaactaagtttgaaaacgaggagtcggaggagttggatgaggatatgggatttggtctctttgactaaccaccaaaaagcaaccaactcagccagctttatttgcaaaataagcaaataaaggcttacatttttttaaaaaaaaaaaaaaaaaataaggctattaacatttaaaatttgttctcaaaaacattagtccacaggtgagcatgccccaaatacccagaggaaaaaggccagtcgggcacacagcctaacccagtggagatgggtaagcccctgcagcaagggggagaggactctggtctaattatatcctgggaagtggggcatgtttcatggcatgtttaactcctgagagccttgtgctaaaaccctgcctggatgggtctagacagctcaaggcaatgacttgaaagggggccattcttgtaagctggagagacagcccagggggtgcccacctcacacgagagcttggtttctaagtgctccttctccttgatcccaccacgtttgtacatatctcaaccaatgcatttattccccccagaaatatcacattttgtgccatttgcttgcaatcctttttcccttttaatgaccactcctggttccattcctttcccctcccatttttgcagagcgaaactccgcctcgaaaaatatatatatatatatgtatatatatatgtgtatatatatgtgtgtgtgtgtatatatagtatacatatatgtatatgtatatatgtacatatatacacacatatgtatatgtatatatatgtatatatacacacacatatatacacatatatgtgtatatgtatatgtatatatacatatacatatatatgtatatatgtacatatatacatatacatatatatgtatatatacacacacatgtgtatatatatacatatacatatatatgtgtatatataatgaaatgaccataaatgacccacctctgccagtaggaataaatcaaatggccaagtcccagaaaataatcccagttggtcccactaatcggagtcaacaccccccacccccatcccccaaaccacctgggctgcagaaggccttgtctcagccggatagcctagagatgc

SEQ ID NO: 469947 - DNA, 773 bp, Homo sapiens
gatgtagacgttccctgtgttcttgctcctcggggaagaggagagatgcttgtgtgacccatgggagggaggctggacctcctcagagtgagccaacagcggctgagggcacagaagtcacatgcccagggccggctctccctccacatccctctaagaagtaaatcaaattgcctaattgtcaacctggcaggtggggactggaacccagggaggatgtggcaccggacagaggcttccaatggaggcaacagcttggtccacccacatggcggcagatccacgcatctccctggaccttccgtgtctgagcgtccatctgggagcctccaccaaggggcatgagagaacagaagcggaggaagaccctgagagttggcttcctaagagagaaaaggggcccaaggaggagctcaggcaggtcaaggacattgccctcaacaagacaccctctccagggtcagaggccgaccgagcagaggcacaaggtgcttgtcctgaactgcagcccggggatggggtggaggtgccctatctgtggggccgtcccaaggccctcgctgaggggctgggtacaatgaggcctgtgtcgggacttgccgaactgcacctgcgctgtagctcgcaggcaggaagccaggccctgagcaggctcaggcgctgcctccgcgccctcgctgacctgcaggaaactcgcccaacccaggcctatgtcagcagcaggacgatgacctaagaagccaggctgcagagcaagatggaaaattcccaac

SEQ ID NO: 469948 - DNA, 632 bp, Homo sapiens
tgaatgtcgttggcagaactgtgtcttggagacgatggtctccacctgctgtggtcagtgatgccgaccacctcatttgctgatgccgacagcatcagcaacgcccaacgaggatgtgcatctcctcctaatgctgacatggacaacgagcatttccctctcttctcaggctcgtgctcatgtaagcattggccttaccagtgtgggattcttcatccaagccgacacagcctatttaatacgtcagtctttgaaaacttgtggacttttgtcacagcctctagggtggctatgactcagcccctgatatctgaggctgtccacatggaaagtgtcaattaccctcacaaacctgcccccagccctggttctggacctgcagaagggcttgctgtgccttcctcccactatgtgtctgctactgcttattcctgtcccttttgtgccaccagaaagatagaacagccacagatgctaacccattcaaatagcaccacatcactcccctatgcgatctatttcatttgaaatggccacatatattccactaatgtgtcatgacagttggccctccgtacctgctggttctgcatccaaggattcaatcaactgcaggatagaaaatattcttt

SEQ ID NO: 469949 - DNA, 580 bp, Homo sapiens
ctccaggatctgtaggcttcaatcaacagctcacaccacctccctaacaaatggctatggcgttgaaagcaaagaaggaagcgcttgcccctcctaaagccgaagccaaagcgaaggctttaaaggccaagaaggcagtgatgaaagatgtccacatccacaaaaaaagaagacccgcacgtcacccaccttccagaggcccaggacactgcgactcgaggccacccaaatatcctcggaagagcgcccccaggagaaacaagcttgaccgttatgccatcatcaagtttctgtggaccactgagtccgccatgaagaagatagaagacaacaccacatatgtgttcagggtggatgttaaagccaacaagcagcagatcaaacaggctgtgaagaagctccctgacaatgatgcggccaaggtcaacaccctgattcggcccgatggagagaagaaggcatatgttcaactggctccagattacgatgttttggatgcctcccagaggcaattatcctggctttgaaccccagctcaccctaccttcatttcagtgttccccgatggctacctattgcc

SEQ ID NO: 469950 - DNA, 1362 bp, Homo sapiens
acgtaaaggaaaaaaagaaaactctcgattgtggtggtcacctgtatagtccccgctatttgggaggctgaggcaggagctgctgggtacacctcccagacggggtggctgccgggcagaggggcccctcacttcccagacggggcggctgccgggtgggggctgccccccacctccctcccggacggggcggctggccaaagggggctgtcccccacctcctggagggggcggctgcccggcggagatgctcctcacttcccaaacggggcggctgctgggcggaggggctcctcacttctcagacggggcggccgggcagagacgctcctcacctcccagacggggtggcggtcgggcagagaaactcctcagttcccagacggggtcgcggccgggcagaggcgctcctcacatcccagacggggcggcggggcagaggcgctccccaagtcccagacgatgggcggctgggcagagacgctcctcccttcctagacgggatggcggccgggaagaggcgctcctcacttcccagactgggcagccgggcagatgggctcctcacatcccagacaatgggcggccaggcagagacgctcctcgcttcccagacggggtggcagccgggcagaggctgcaatctcggcgctttgggaggccaaggcaggcggctgggagagtagggactgatggtgctgacagtaaagcccctgtgtggtgggataaaagccttcactgccagctgctcatctagaaaatcacctaaagtactggcatctagactgtcagctgacatcagggttcctcgtctaccaggacatcctcgattgctccttggtttctcagaagtgactacgaccagatcagcactttttctgccctgggaaccaaatgtcacccctgcttttccatctgctggccctggaaccctctggcttttcatctcctccttttctttctcattcccccacaaacagttccctcagtgctcctggaatagctcagctgtgtcccagcaggagggactcaggtctagaacccagaggttactgtggctgtcagttggaaatacttttagtatagaaattttcttggatctgaaagtacgagatgatccacggttaataaacagggatagccagcggcagcaggaatgagaaaggtggaaagaaaagttagtttgtggtgcaagattagtttgtgtccttgaacttcagtgtccattattaaataggagccgtacttgctctgatgaaatgagataatgaaagcactctgtaaactaggaaggaccagatgattgtaatgtgttagtgataatcgttatcattttaattatatttaaatacatcctgccag

SEQ ID NO: 469951 - DNA, 755 bp, Homo sapiens
tggctctggaggacagcacgtactcagagtcaccacagcaatcgagtatgtctggagaactggctgtgaatgggtgcagaaggagactgagactaggaaggaatgcagggatgaagatcacagaaggccttgcctaccatggaaaaggagtttgggcagacagagaggagttgcctactgagaagactgagaagcagcagccagagagagaaaaggtgaattgggagcaagggaatgtctatatcagtcaggactcattggtggcaaataacagaagccagtgcaaaccgactgaaggaaagaaaggagagtcttacacagatacgggagtagtcagatatgcagatataggcatgaatggttccgaaatgaaattcaaagatgtgaagaacaagatgtcctcattaatgactgatgttgtcggggtccacagtagtttaggattcctattccagctcaacttgcaggtttagacagctgtcctttgcggacaaggttaagtgattttaatttggagggcagaggagagtttccagctttctgttttcagggtttccagtgagatgaggtgcacagctgggggcagtatgtccttctctcacttagaggttctctggtcgacatcctcccttcactctgatcgtgatggttaattttatgtatcaagttgactgaattattgtgttcagctatttgcaaatctagatgttgctgtgcaggtattttaagaataggtgactaacatttaaatcagc

SEQ ID NO: 469952 - DNA, 739 bp, Homo sapiens
tgagtcaagtgaagtatagaggcagaacgcaccttgggaaatgcgaaatgagaaaaagtgccttcagctgctgccccacggcaaggtgccttccattcctccacccttccatccaagctccctaagccaaggtcttattcggctctgcttggcactgtctgaaacccctatttcctgcttctcttgctctcagagtccaggtgtcaaatggcgaatctgttttgcaagtcagtgcgcatacaaggaggcaaatagaaacctggccctgctggggattggcagatacagtccatgggatgagactggtaagagctgtagggtcagggagtgtgcatctgccctggtccctcagtcagagccccagtccccggctcctttcctccgtgtgttctgcagccacagtccaggcagctgtggaggcagcagagcccaggacactgaccctcagctgagacctccacaagctgatgtaacagacctgtcttcaccaaaatgtttaacactcctggaaggatgaaaaagtatacttttagcaaattgtaactgttcacctcttaagtgacaagtgatttgaattgcttcacttctggtttttttaatatagtcaaatttattaattatgtctctgaattttcagttatatttagaaagcctttatgtacatcaaggttaatgaggaaatcacccattgcttacatgctatcactttttacattaaaatttcaaactcatttggaga

SEQ ID NO: 469953 - DNA, 662 bp, Homo sapiens
gtggataggtaatacactagttaagactttattgtaccatacatactatgaacgcacaggaacccctctggggacttgtatgtacaaccaaacgaactattcagtttgtgacccaggggatagctagctttatgtatactatgaccctaagcttttacctgggcctgggagtcacatctttgtattttgatatttgccagataacatccatagactcactctttcccgtaatccacagttccatggagtactataatagctgccataaaaagccggcactcacgagctcaagtgtctggctgctaaaatcttctgtcattggaagattctgcattgcccactggggaaaagcctttacaaacccagtaggggaattagtctgcctaggacagcaatattacaatgagacattagggaaaactttatggcggggcaataataagcaaggtaaagatacaaccaggttgccatgccataatccattttcccattttcactctttaaaccactcctggtatcaactagaggcaccaaatgaacacctagcaagcaccttctggcctcgactggatctgtgggccatgagcttattggcaattacctgccaattggacaggggcctgtgtgttggggacaataagaccatctttcttccttgaccc

SEQ ID NO: 469954 - DNA, 1073 bp, Homo sapiens
agtgctttgatgataaagcctaaatccctaacgtgtttgcacacttcctgaccaccctctagcaagttgtcattcctctggatacactttcagtaactatggcatgcactaggtggaccaagctccagggaagggactggagtgggtcttacattaatgctagtggtggaggcatatactactcagactctgtgaagggccggttgaccatctccagagaaaacaccaagaactcactgtatctgcaaataaacagtttcattgctgacaccatggccgtctattactgtaagagacacagtgaggagaagtcagtgttgagcccagacacaaacctctctgcagaaacacatgaagtaaatcagctacgggggcgctcaggacccactgatcagattcaacctcagaggcagatgcagatacaggctgttgtcactttttcgttttcttttctgctccctgaaaaagaaagatgtggtccatgcggtctaaattccaaggctcaagctcttccgctggagctcaggtggggctcaggctgtggctcctgcagccgcatgggagaggctgatggggctttcttctttccccagtgcttgggaccctccaccgtgtttcatggggactcatgtggaaatttgagtggcccaggggaactgaagggcataagcttgtttggtgagagtgaaacgtgactgtggaattgattctttgttgtgcaaaccagaagaaattttgaattttgtcagaatcaaaacggagtcacttttgttaaaacttttgcaaatgggactgggaaaggccatagaagcagggttctcatacacttacacttggtaacaagaactaccacaaatagagcctaaaaaacacaaccttgcacaaaatccaccacaactttaggaaaaagctacccccacaaggatatgtcctcatgtactgtgagtccaactttccactgttgccacccttgttattaatctttgcagcccaggaaaattgtctcaaagcaacttagcaacttacttagcccttcttattttaactttaactgcctaagaatttataccgtg

SEQ ID NO: 469955 - DNA, 665 bp, Homo sapiens
aaaccacaggcctcagatgcattacctggaactcagagcccccactctcacttgtggatttttgggagagctgaggatggacactttattgggctgtgagctctgcatgatggcaatcgtgaggtctgggtgggcacagccagagccaatggagctggccaaaaggaaagacaggacggaattcctgggaagtcctacagctgctgtctaccatagagttccattgtcttctcctctgctaggattaaaccagaccgaccaaccgattaagtgtgcatgcattggtcgaaggagggcatccacccttttgagggaaaatgcatggagggtaaatgaggctgggaagctgatggcatatgatggaagcctgtccctgagtgaaggagagagggaggcaggattgggtggaactttcctacatttctgtgctgtgcaaagaaactccagattatcactgagtctcctgcaagtcaaagttgcccctcaggaaacccccatcactcccagcaatgactctgccccagatgagtgcaaggctcactctattcctgagaaaggagcacaggatatgggatttagcatgagccacgtcatggacgtcagagagcaggagctgggtgcatgatccaagtgcactgttctgcctgtaggtggagagaggaagg

SEQ ID NO: 469956 - DNA, 503 bp, Homo sapiens
ttgtatcgtgggtccggatttatgaataatgcaatacgagaacacactaataaagcggacatctccctcgtttcaccagggtcccttgcagtctgcaaccacccagctaaggagagggatggtccaatctccatgactgacaccatcgaggtgctgcctcaggcccagatggtttgtgatggatgtcactttactaatcttgagttcagggagtataatgccctcctcccgcatgcctcacagatgaagaagccaccctgtgatcaactctctcttcttctgtctgaacccatttctaagtgtcagcaattccgcagtggtggaatcccacattgtggtgtgtttccttatttcaggaagaaccactcacctgataatgcaacagcctggacatctgactttcactttgtaagatgcacccactgaagaggttcttccagaacttttggcattgtggcggtatccccatactcaggcactgggccccatccatcatggataac

SEQ ID NO: 469957 - DNA, 603 bp, Homo sapiens
tcctcacacatgcatactgaacaaacatgtcttcaggccctatgtgcaaacagcagaagcagagacacaaaggtactcagggtgcagcctctgtgaacggccagagccaggccatggtcagcgcccctgagaggtggaccaagctggacacacatgagccaccgagcctggcaagcaaaagcgccagccttgatggaaatggcgagctgagcggcatctactcagtgtggtttcttttgttattaagagctttagtgtggtggctgtttcaaattcccgttgtagtagtaatatactgggtatgtgagcaggcccgtggtcttttgcggggttggaatcaccgaagtaatgagaagctaatctcattttcaactgctgtaagagccggctatggtggcagcagaagggtttatgctttactggtgattaaagtgggaaacttggcgtgttccagatcttagagaaaagatttttagttatttctcattcaacctgatactacctgaaagtctctcgaatgtaacttttattttgtcgagatgggttctttctatacccattttttatgttttttttgtgaaaggatgttgtttcatcaaatgc

SEQ ID NO: 469958 - DNA, 574 bp, Homo sapiens
aatgtggacactgttcagactcacctttgatctacctggatggtcagtcaagctggcaaagcagaatatctgtgtgtcagtgtactttattcacccgttgttgtgtcaggacctgcaggacagacccccacagccggtgccccatgtgaggatcgctgcaaagggagcgtgacagaccccatgaaaacgaaggttgaggaagactgcgtggtcaagtcagtaaaacaggatggctttagtcccattatacaaagaagaacccaaaaaggggaaggaggaagaaacgtcacttgccttaccacctgctcttcccaaaataacaaagaggaaacggaggttttgcctgagccccctctttcaatagatagaaaaaatagaggaaatacactacagctatatgtccctgtcttcgacaagcagcattaaaaggggagctcttagactgcccagtaatgcaagatcagcaaggcaatcaggttaggccagctcacaatttcaacaattttgtcacacgtggaatatccgacattcctcaggtatcccatataaaccccaaggacaagcaatagtagaa

SEQ ID NO: 469959 - DNA, 555 bp, Homo sapiens
ctcacgactgctcagagtgctgaggacaccagagcttcaggacgaacagggggtgctcaggccaccatggggggctcaggaaccaccaggcctaggggtttggagaaagagagttattcagaccatggggaagaatctgacactgtcacaccgcctggtgccttcagtactggactggctcctgccctcattggtgattgcatcaaatattggcctcctcatcagtacaacacattggaggagaacatagggaaatgcaaagacaatgggagaaaaaagtcaaggacagtagagcaattcgaagcctctgataccaatagcttgaggaccaaggtcatgactcaacttttggtggacacagagtcacttctcttagggaaactgcagtattctaaggtgacaatatgcaaacatgatgaatgtacacttgctacatctccaattgtgtactgttttccttacttctgtttgaagaagggagtcgtatactcaggtctagtatcagtgtagggggtgctccctatttgcaagatactagaaaaaaatggtaagtta

SEQ ID NO: 469960 - DNA, 829 bp, Homo sapiens
ttttcctttctcatcagctggagaagtcagcaaacccgccaggagatagatgctcaggacaccagagagaactcagttaaaccagggggcgctcagaacagcagagtgtgctcaggacaccagggggcgctcagaaccaccagcaggagctcagaacagcagagtgtgctcaggacaccagggggcgctcagaaccaccagcaggagctcagaacagcagagtgtgctcaggacaccagggggcgctcagaaccaccagcgggcgctcagaacagcagagtgtgctcaggacaccagggggcgctcagaaccaccagtgggcgctcagaacagcagagtgtgctcaggacaccagggggcgctcagaaccaccagcgggcgctcagaacagcagagtgtgctcaggacaccagggggcgctcagaaccaccagcgggcgctcagaaccaccagggggcgctcaggacggcaggggtcgctcagacaccacgaacagttgattcagaaaggcaggaaagcaggcattcctctaagtctcccctgagacaaatacatatatgatttcttcctccccactataatttatgtaaaaatgaagattcactgagtcagactaaattgtgtattcagtggaaggataataaatgacacaaaagaatgcaacctattgtctcttatcttcttctaacctgcaagcccccattttcatttgtcctggcttacaggaaaaaaaaatgtacatttcacatgtattgactgatgtctcatgtctctgtaaaatgtataaaagcaagctgtacttcaatcaccttgtgcacatgtctcagga

SEQ ID NO: 469961 - DNA, 1460 bp, Homo sapiens
aaccagacttaactggggagccctctattgtccctagtatttaccctatgcctaacgctctaagatgttgttctcatttttccatttgcttttcctgctttccgaaaaaggaagatgtttttgctgtggtcaaaattccagacctcaagcccttttcttggcgctcaggtgggtctcaggctgtggctgctgcagtcacgcaggagagtctggtgggactttcttcactcttcgtcactcaggaccctccactgtgttgcatggagactcatctggaaatgcaagttgccagtgggaactgaagggacaagcttgtctggttaatgtgggatgtggatgtgtttctaatcctgttctgaaaaaccgtcacacagtaacgttcttcactagtggagaaggaagtgggtgtgaacgttgtcagaataaaaatggagccacgtgtgttataatctttacaggcgaagctggaagaggtcatgaatagagggttctcatgcacacatccctgataacaagaattaccctaaaaatactctgcacaaccacaatcttgaacaaaggctaccacaacaataagagaattaatactgaggggatatctgccctgcaactccctgttcagccttaaactgattctacccttgttattgattcttctaccccaggataattgtctcaaaatagctcaggtaatcttctcatttatccttcagacacttgtctttctttaccaacctaaatgtgaccatggataatcccattgcaatgctcattttcaaataaatacgatttgattttggagaatctctttctctctgatgtttaggttggtttgttgaatatttgttagagaccagttctttacactatggcatgtaataaattccaaatggcagtacgtcattgtttacttagcttttgtgcttatatttttcagaggaaaaaaaatactgtaaattgtaaatacccaatacctaacagtattgtatgcaaatctgtgactgttggcagtgtcatctctgagaaacagataaagtttatttactatatataaaaaaagagtttggaaggtggactcctcaccaatttttgaaagagttagagaagcattagcattaattctttaaatgttaagactaattttatgatgtaacatataacctatcatggagaatgttcaatgggtgcttgagaaggatgtgtattacatggctcttggttggaaggttctgtaaatgtctttcaggtaaatttgttcaatactgttgttcaagttcagaggcttattaagaattttctttctggatttgcaatacattattgctaagtgaggtattaaggttttcccttatttttatatagttttctatttctctctatatatatatcttaaagtttgcttaatgcatttatatttgtatttgtactgtgtaaaaagtaaaataaaataataattgctt

SEQ ID NO: 469962 - DNA, 603 bp, Homo sapiens
gaggtaaatcaggacaccagaagagactcggtacagcagggggctctggaccattcttaactggtaaacaaattgtggaaaagtcattcattggcatactactgactgtgaccacaatatactaatgttggatacgctcaacagtatggttaaattctcatatgagaccttgagtagagcacgtctgactgtgtttgtctgttttcacgctgctgatgaagacataccagagacgaggaaacttacaacagaaagagttttattggacttacagttccacgtggctggaaaggcctcacaatcatggtggaaggtgaaaggcacatctgacatggcggcagacaagagaagagagcttgtgctggtgtctgtggattttccaggcacaaagtgcaaactgtcagtggatctaccattccagggtctggaggatagcagccctcttctcacagctccactaggcagtgccccagtagggactctgtgtgggagctcgggccctatatttcctttcctcactgccgtagcagaggttccccatgaatgagccaccactgcagccaacttgtgactggacatccaggtgttttcatacaccttctg

SEQ ID NO: 469963 - DNA, 987 bp, Homo sapiens
gccaggaaggaggcagctgccctggtgaggagccaccccatgtatattcccttgatcagtgtccacaccatggggtctgcactgatctgggcttcccttctcatcaccctcaatattagtgtcccttgtgaatcaggtccagctgcggctgttccacatggggccgttcttccatttcctcagtgtttgcagaagtcctgtgtgaagtttattgatggagtcagaggcagaaaattagagacaggagggaactgcatggtagatgctcctcataaccacaaaggggcagtcaggaccatcaggaggagctcaggacacctgggggtgctcagaaccatgaggggtgctcaggacatcgggggctctcagaaccatgaggggtgctcaggacatcagggggctctcagaaccaccagggggcgctcaggacacctgggggcgctcagaagcatcaggggtgctcaggatatcagagtgccctcagtaccacgagggggcgctcatgacaccaggggcactcagaaccaccagggggggctcaaatatgctcgtctacctggagactctctgccctcctcacccttttctagggtcctgcacacatcacactcatcccatcccctcccttccctaagtaccacagagtgggctctgcagttcctgcttccctgtgtgtgctcagccctggggctcactagtgctttgatgatgacgttcaaatccccatgtgcttagactctctaagaccaccctctaggaagatgccattgtgagtgagtcctggaaatcatgggctgtgttcagtttcatattgctggatcttctctattttaaaggaatactggcaattaagattagagtttgtattgaatattcatgccaaaaaagttttctttcaaaacttttcaaataaaacaatttttcctgcctagtttgaaaactacaatgtaaattcaacaaataatataatacaattttaaaggtgac

SEQ ID NO: 469964 - DNA, 561 bp, Homo sapiens
tggagacttatctggaaatgcaagttgcgactgagaactgaaggggacaagcttgtttggttaacatgggatcctctggattcaccttcagtagctcctggatgcactgggtctgccaggctccggagaaggggctggagtgggtggccgacataaagtgtgacggaagtgagaaatactatgtagactctgtgaagggccgattgaccatctccagagacaatgccaagaactccctctatctgcaagtgaacagcctgagagctgaggacatgaccgtgtattactgtgtgagaggcacagtgaggggaggtcagtgtgagcccagacacaaacctcctgcaggggcatctggagccacaagggggcgctcaggatacacagaggacaggggcagccccagggcaggtgcaggtggaggtcaagggctgctctccttcagggtctgtggcttcctctcatctaacagttccgcagggagcctcttgtatttacagtgatgtgctactgaggtttctaagtttgtaaagtttattactacaggaggaaccactatcaaac

SEQ ID NO: 469965 - DNA, 791 bp, Homo sapiens
tctgcagggcagggcagaagatctggaaggtgatgacactgattgagaacactagagctgtgggagggagcacctggggaaaacaggaggactctaccccagggaaaggggcaagaacacccagaccagcatctcatatggaggagggtcaggaacactcacaaggtcatgcccagactctgggtcacaatgccttcctaggaatatggaaaaaggaatatggacctaggaatatggagtctttagctcccttccctggggagctgagggatccagctccagcaggaagcactggttgtgatggagaagcagagacagcacagatgagggagagggtctgtgagggcttcgccaggccaagaacgcacgagaaatacagatgtcggcatgcacaggttctgaacaacacacctgagcagcaatcatgggccgtggaggtcgcctcacatgtggaaagatctgactctgcaaagctgtacatgggggtctctgcaggcccttagttgtacaggaacagctcctccctcagactcagagtaaggacaatgtgctctttatctgggggagattttctaattattattgaatttatgtttgatttgactgtttcttgtgtttgtttttaaatggatttttttcccttaagaatgagactttaatgcttataattaattacaacctgatttggtttttggtccttagaggggtgaagactctgtaagagttccggggttatggagaatctttgtatgatggctttcctatgtgttgattgcagtagaaatctgctc

SEQ ID NO: 469966 - DNA, 1334 bp, Homo sapiens
caacagaatacgccgcgtctgtgaaaggcagattcaccatctcaagagatgattccaaaagcatcgcctatctgcaaatgaacagcctgaaaaccgaggacacagccgtgtattactgtactagagacacagtgaggggaggtcaatatctcactggatcatctcgagggcccatcctcacccctgtctcccgaagacttctggagaggctgcaggacgggcagaaggaggagccccgtgtgagtccacacgacctggagcctccctctccttggattaggccatctcctcgggatcacagggctcttcattatccttaccccgctgttgtaccaaacaagcaacatcacacttcaattcatcagggtaaggagtgccttttacctgccaccgtgttttggaggccttcacagccatgtggaactgtaattccaattaaacctctttttgttcccagttttgggtgtgtctttgttagcagtttgaaaatggactaatgcgtgggcaaatgacacagacacttctcaaaggaatacatacaagtgaccagcaaatatatttttaaaatgtttaacatcactaatcatcagagaaatgtaaatagaaaaatgttctgatttctgtcactataggtccattttcttgttttgaatttcatatacatggaataaaatattatagctcatttttgtaagaagcttttactatctgtgaggttcattcatgtgatagcatctatcaaggttttgtcaacatatgtataaatatgtatgtactcatacacatatagatatttcatatctgaatcagtccattgcattaataaatgacagattattaaataaatcagttcattaagtgaataagtgacaatatgtatatctattttcctgttgatggaatttaaatttgtttccaatataaatatcataaacaaaactgtcatacatatctttgtacaagttcttctgtttatattcacatatttttattgataaaatatgttgaaatataagtatgcattataccttttcagctttatggagctatcactgacaaataaaattttctgtatttaaggtacaccaattgatgtattgatattcttggggaaatgctcataatgatcaaggtaattggcatgcctatcatctcagagagttaacattttatgcctttaatttattgtgtatgtgtgatgaaatcacctaatatctacttgtctggcaaaagatatgtttataatgcaacattcattagtatagtcacattgctgtaggtttgatctccagaactatttcaacctgtgtattagtccattctcaccctaatgt

SEQ ID NO: 469967 - DNA, 789 bp, Homo sapiens
ccctgaaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagacacagtgattacagtgaaattgcacagaaggtgtgagaattcccatgaatccctgccccgcacggacaccgcctcctccactacagccatcctgccccacagtcacaaataagtcacaatggatgaatctacaagaactcttggttctttctttttctggtgatcccctaatataacaagcctaaattatcttggaacacccaggtattttcaatggctttctagaagtgatattagtcagagggaaagtgagtgaggctattactatttgagcactttcttccaaaatccacaaaatatatgttaatttggagtttttctaacttctggtttacaatgtcccttcccagagagtaagatttttaagc

SEQ ID NO: 469968 - DNA, 518 bp, Homo sapiens
tcccgtgcacgcagagaagaggccatgtggagacatagtggactagaaggtgcaagccaagaagaagccgcaccaagaaccaaccctgccagcacctggaccttggacattcagacttcagaatgggagaaacaagggccataccccatagaaaaggaagaaaaaaagcagatgggcacccctggagagagctcattagatttggacacaggttttagtggatttcccctggagacagtggaggtgaatccaggcgttccacagtccttaccgttcttctcttcctgtcagcaccgcaggacagcagataagggagctgactgtggatttttcagatccccgggaaaaagcctgcaaggactaatagtttcacatctaacaccattagcacatgcatccaaaattaaaaaaaaaatcctcactaaatatttccaggttagcctgttcctctctcaataccataccgtggcacctgccctgggttcggtaacatgtgggccccagtcctctctgtaggc

SEQ ID NO: 469969 - DNA, 561 bp, Homo sapiens
acactgggcctgactgcttcctgaaccaagcccagcacaatatggttcaccccagtgacattttcagatgtttcttccttactggggatacatcacaaaatgctccagcctctaccccttgggatggtgctgtctgggaaagcaaaacagcaactacagctgaaatgcatccagacacacctccccatcaccactacattgcaagagaaattatctgcagaggagctccctcatttgatgccaatttggccttgaaaccccacaaaacccttcctgcaagtaggatgctctgccccgctccccaccaaaccatgataacaaccctgagccagtctccttccctgccctatcaagccactttggaccttaatgagagacctgccctgctctcagcagacaccttaaggatgcaggccctgagtggtacaggaacagctcctccctcagactcagtctaaggagaacttctgctctttatctggggaggtgagggtgagtgcgtggaaagtaccaaacttgctctaatcaagatctctgcatgtggggagaaccaaagtatac

SEQ ID NO: 469970 - DNA, 687 bp, Homo sapiens
tgcgcttgtttggtcaaagacctctagggagcgctcaggacgccaggggggtgctcagaaccactaggggacgctcaggacactaggtggcgctcaagacaacactgctgcactcatgtcaccacggggtactcagaaccaccagggggcgctcagaaccaccagagggcgctcagaaccaccaggtggcgctcagcaccaccagggggcgctcaggacaccagggggcgctcagaaacactcggggacactcaggacaagagggggtactcagaaccaacagggggcgctcaggaccaccaatggttgctcagaaccacaagggggcgctcaggacataggtggtgctaaagacaacaattctgggctcaggtcaccagggggcgctcagaaccaccaggggacgctcaggacatgcagagtccctaccatgacattgccaagtagagctatggaagggggctaccaacctccagaccccagaatggtagatccacaggcagcttgcagctcgagtctggaaaagccacaggcacccagctccaacccatgagagcagccttatgggctgcattagggaagtcacaaaggtagggctgcccaaggccttgggcacccacccttgcaccaggtcacaagacatggagtcaatgattattttagagccttaagattgaaggactgtcc

SEQ ID NO: 469971 - DNA, 784 bp, Homo sapiens
tcctgagaagaaacctcgaagcacaggaagggtctcatgtataatgaagtgtgttcttggcgttatctctggaggtattgaatcggtccttaccggagtctatgaggtatgtgctacccccattaggattaacttgtcaaaccaactccagcccattccctggagcctggcggacacagttcatgtagtagctactgaaggtgaattgagaggctgcacaggagagtctcggggaccacgcaggctttgccaagcctcccccagactccaccagctgcatctcacactggatacctgcaaacacagagacaccccggtcagaaactgccacacgtatccactgtttctcactcatatccattcatactcaatatctctagttctctatagatcacgttttaaaatagcaacaaggaaaacccagctcagcacaaactccatggtgagtcctctgtgttcggtgctgatcaccagatgaaaacacctgggaattcgggggctgggctcctctcccagagctgcagggtcggggttgggctggtttttatcagcagagagtgggccctatttccatgtctcctactatatagcaagctcaggggtgggacggctgaggagaaggcagtgcccggagcagatgagagtgtcctggaaaactctggagtgtttacctgaaatctacaatcagtgttcacatgtgtgtattttcaggagtccttgattattcaagtgtcggtatttatccatttcttgctctttctcagccaatatattcatttttatt

SEQ ID NO: 469972 - DNA, 816 bp, Homo sapiens
tcgtgttctaaaaataattgtaaccctcttaacatcattgtccatgaacctaattcagctcaatggtactatggtatacgagtacagtggatcagaaggacaactcctcattgctcccccggaattacatcccaggctacgcagagctgccccactactggtttctcttttagccggtcttagcatagctgggtcagcagctattagtacagctgccctagttcgaggagaaactggactaatgtctttgtcccaacaggtagatgctgatttaaataatcttcagtctgccatagatatactacattcccaggtagagtctctagctgaagtagtacttcaaaactgccgaggcttagatctgctgttcctctctcaaggaggattatgcgcagctctaggagaaagctgttgcttttacgccaatcaatctggagtcataaaagatacactccaaaaagttcaaaaaaatctagataggagccaacaagaacgagaaaataacacagcctggtatcaaagcatgttcaattggaacccctggttaactactttaatcactggtttagctggacccatcatcatcatattattgagtttaatttttggcccttgtatattaaattggttccttgattttgtaaaacaacgtattgcgtctgtcaaacttatgtatctaagaactcaatataacccccttgttgtaactgaagaatcaacgacttgattcccctaaaacacaagtggggaaatgaaatgcctaacggtgtttttactttaactcgttactttgaattttgtcctgcttgtctcttt

SEQ ID NO: 469973 - DNA, 554 bp, Homo sapiens
gcacagaagctccagggcagagtcaccatgaccacagacacatccacgagcacagcctacatggagctgaggagcctgagatctgacgacacggccgtgtattactgtgcgagagacacagaccaaggccacggcccctctgtcaatggccttagatttacctctcacggggcatccacagggttcccaggtgagaacaggcaaaaacaaggtgaagacactttccaaatctccagcagtactgagcttgctttagctctgtttgaagaaacaaaacaacaacaacaaacaacaacaaccgcaaatataaccaggattaagtctgtgggtttggaggaaggagattcagccatggggaagaatctgacactctcacaccctctgtgccttcggtactggactgctcctgccctcactatggtgattgcatcagatattgcctccccaccagacaacacgttaacatggctccttgtacctggctttaaccaagaaagttgtcgacttgactcttcgtgacattgtatagcctggtttgtcacaatctttatttc

SEQ ID NO: 469974 - DNA, 746 bp, Homo sapiens
cccgacctggtcaagcaaaagtcttccccaggatctctcaccatttcttccttgtgacctgcgggatgtgtgaggtgaatagggacttgtgtgaggtggccacaggaatgtgtgaggtgacctgggggatgtgtaaggtgacattggggatgtgtgaggtgactcagggcacatgtgaggtgacctgggggatgtgcaaggtcaccttgggtgagtgtgaggtgaccttggggatgtgcaaggtcacactgtgtgagtgtgtccagtgtgaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatcctgatactccactctgttttctggagacgcgtctgagaacgcgtgtggccattagtaatgagggcacaagcttctttggtcaaaatggggtgaggatgtggaattgatcctgtgctgtgtaaactgtcacagagtcaccttcttcaccagtagtgttagaagagcttgtaaaatttgtc

SEQ ID NO: 469975 - DNA, 648 bp, Homo sapiens
acagctgccctcgtctactgcacaacagcttctccaaagtgtgtttaccctgagcattgagattgcctttctcttagttaccagtgagctttgactgttccgaatgggaccagcatggagtcaaggtgcctgctcaatgtcagagacagcgatggtctcagaaacaatccaggtgcccactcccaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggcacagagctgcatcaggaactcacagaggataagggagaattctgagaacatgctactgtggtactgcctagagaggaaggataaatgatgacaaatacatctctgagtaacatatgggcatttgttcatgaaaactgttttttctgaaagcttatgaaggtcttgaaa

SEQ ID NO: 469976 - DNA, 5309 bp, Homo sapiens
cagcactgaacacagaggactcaccatggagttgggactgagctggattttccttttggctattttaaaaggtgattcatggagaaatagagagattgagtgtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacacagtgaggggaacaccattttcttgggctcctgggaaacacaacagctttggtttaactcacagctcaggcacactcacgggtcctttcagaggctctcaacttccctcctacagtccctcagctcctcctggggtcctaacttggccatctctatcctctctgctgagcctggccatacacaatccatcccatctggatatgtgtatagcagtgggttaactcagcaggcatgaatagttcaaaccctccacgttcctaaaaaggtaaataactaaaaaataaaaacaaaagtaaacctttgttcatttatggctgtctgttacctcctgggatgagatctccgagtccatgaaatcttacacctgataaaagtgtctgcagatgtctgcagccttgggacatgctgtacgagtttaatcacagtgatttatagtgaacgcctgcttttgttttgctggggagggctgtggtctgagtattgtggtcagttacccaggtgttccatagtctatgattcattccccaaacacagccctggacaagaaaactcaggggcactcccctgggtgttgacacttcacacatgtcatcttacctcatagctggagcattacacatgtgcagaaggctccacagtgggaggacccctgagagcttgtgcctggattctcctgagcttcactctttgtgccttttttttccatgtattttcaattgtatcattttgctgtaataaactgttcctgtgaatacgagttttcatgagtcctgtgtttttactgagttttgagcctgagggtggcagatgcaacttctcaatgcagttgtatcagaagaaggatttcctagagagatcctaagtgacacatggctgaagtattgttcagaaaacataagtattcaggtgtggaatggcaaaatctgatacttgggtggcaacagaattacccggtctgagacagcagctgaactgaagtagatgtctggagataaatgcaatttagaaacgataactcatactcccaaagagctggctcaatcgatacataaggaaaaataaaatgataaaaaataacctaaatatgcaattactatttgtgagaacatccgggagagtgattgcagggaaagtggcctgcgccgacctcagattttggccaatgtcatttctggctgatgggctccagggcactacctaagggagcaattatgctgcaatgacagacagaagcttcgcaagctctctccacccagaaggtggttcaggtggtgaagtgcggggactggtgagccacaaaacactgaaatgagggaggaaagtgagaaagtgaaaggcttttgagctttttctttagcttaataatttttgttaattattaacaaaataattggacaatgactaatgtaaaagtggaccgtgttttgagtcccttagaacggaggagaatgcagcggtcaatgttgtgcccagagattactatagaacaatagtaggtggttgaacatgctccaaacacaaagcctcttgttgctgatgggacagctgccctcgtctactgcacaacagcttctccaaagtgtgtttaccctgagcattgagattgcctttctcttgtaagtgaaaaaatcggaaaactccaaataaaggaggagttgtaacgctctatgtgtaagaaattctaatgtggatttatgataactgggatatgcatccacttatctttttatctgtaaaaattcatgggtgaaagtgcaattttgttacatggatatattgttcagtgatgaagtctgggctttgaggagagtcatcatctggatggtgtatattgtacccagcaagtaatttctcatcccacacaccactcccaccatccaaaccttccaagtttccaatatttattatgccacactctatattcatgtgtgcacattatttagttcttacttatatatgacatgtggtattcaactttattcttctgagttatttaacttaagatagcagcctacagtttcatccatgatactgtaaaatacataatttcattttttattattgagtagtaattaaatgtgtgtatatatattcacaaatatatataatgtatttgtgagggtgtgtatgtgtgtatatatgtgcatatatacatatacaacatgttttctttatccaatcattcattaaaaacacttagtttggtaccgcatatgtgctattgtgaataaggcaacagcaaacataaatgcagcatctatcgaatataaaattcatttttctttgagtcgataccaagtagtggatttgccgaattaaatattagttccatttaataagagaacttaccaacatctgtttcttgtttagtttagtttttatttttgactttttaataatagttattctgactggtttaatatggcttctcgttttgacttcaaattgcatttctgtgatgattaatgacattgattgttttttcatatcctggttgatgatttttatggcctcttttgaaaaataaatgtctgatatttgctcactttttaatgtggctatttgtgctttttgtgttgctttagtttcttgtagattccaaatattagctctttgtcagatgtagtgtttaaaaatatttttcgtcattctgtaggttttctgttaactttgttgattatttattttgctgatcagatgttttgcttcttatttgtattaagtccaaataacctattttggtttagttgtgtttacttttaaggtcatagtcatgaattctttgcctagcacaatgttcagaaaaacacttcctaggatttcatttatgactttcagactctcaggcctcccagtcaagtcttttatccatattggtgtaatgtttgtatgtagtgagacatatgggtccagttttattcttctgcaaatagctgttcagtttttcctgcacaatttattgaacaaggtgacattttcccagggtatgctttttgtctggttggtcacagtcagttggctgcaggcacatgactgtatttctggaatgtctattctgttccaagtatctatggttctctggttgattgttacttgtgtataaaaatcctactggcttttgtatgcttttttatcctttattctaaaacttcactgaattaattcatcaattctaggagtacttctaaagaatattagtttttaagtacaaaatcatattgtcagcaaacacacacaaaaaactgacttcttcttttccaatttgggtgcctttatttctttctggtgtcttatttctctggctaggatttcaagttctatattgattaagagtggtgaaagtgggcatccttgacgtgttctgagtcttaggaggaatactttcaacatattgctactcagtataatgttgtatgtgagtttgtcatatatgatttttattaatttgaggtatgttttccttctattctaattttgttgagggttttttatcataaagaaatcctaaatgttatcaaatttttttttctggacctattgacatgattatatgttttttgtttatgtggtggatcacagttattgagacatgaacgttgaactatccttgcatccctgaaatgaaacttagcagattgtagcatattatctttttgatatgtagttggacttgattttcttgtgtcttgttgaggatttttccatctatagtcatcagtgatattgatctgtagtattcatttttgggtccttgcatggatgtggtatcaggctattagtggctttgtagaatgagttagggagaaaaaccctctcctcgtttttttggaaaaagtttcagtagaattactagcagatctttttgtatattggacagaattcaccttttaaaataatatgctttacggctttgatgttgagatttttttaaattactgcttcgatgtcactaatttttgttggtcctttcaggatttttatttcttcctatttcaatcttgggagattatatatttccagacatttatctattcaccctaaattttctagtttatgagcctggagatgttcatagtagactatgttgatcattatatttctatggcatcagttgtaatcttttcttttttgtttctcattctgcttatttaaattgtctgtctactttacttgcctaatctagctagtggtctgtaagttttgtttatcatctcaaaaacccaatgttttattgtattggttctttgtatttcttggttcttaactttatctagttctgctctggtctttgttatttgttttcttctgctgtgtgtttggtttgatgttgtttttctagttatttgatacgtaatgttaggttgttaatttgtgatctttctttttgatgtggtcatttaacattataatcttatcccttagcacagcttttgctgtaaaccagaggttttggtatgctgtttctctatttttattcatttcacaacatgttacaatctttttaaattttatcattgacccaaagttcattcagttgcaggttgttaaattttcattgtgtgtgtagtcttgaatattcttctagggtttgatttctggctttatattactgtggtctgagaagatatttcatttttaaaaagttattgagtcttttatttctggcatagtatataatccatgtttgaaaatattccttgctaatgggaataatgtatattctgcagtcattaggttaaatgttctgttaatgtctgttaggttcatttggtctagagtccaatttaagtctagtgtttctttgttgattttctgtcttaatgttttgcctagtattatcatttgggcattgaaatccatcacaattgtattgttacctgtgttcttccttaggtct

SEQ ID NO: 469977 - DNA, 850 bp, Homo sapiens
agccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcaggggtcccttgggaccaccagggggcgacagggcattgagcactgggctgtctccagggcaggtgcaggtgctgctgagggctggcttcctgtcgcggtctggggctgcctcgtcgtcaaatttccccaggaacttctccagatttacaattctgtactgacatttcatgtctctaaatgcaatactttttttgtcctttttgtttctttgtttttttgcaacaggagtacatatcctcagctccacagaagccagggtgtcactttgggggcagaaataatcgtttcgtggtcaacaggatgagagtcctgaggaatcccagggaaacctggagagtgttttccaattagactcagggcagagacctccatgggaatttctgattagaac

SEQ ID NO: 469978 - DNA, 692 bp, Homo sapiens
gccgagcacaggtcccagctcagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagaccacaaagacacagcccagggcacctcctgtacaaaaacccaggctgcttctcattggtgctccctccccacctctgcagaacaggaaagtgcagctgagatacgttttcctgccagggcctgcatttcccatccccattagactcagagccctgtcttcctccttcttctttaataataaatggcatgactcctgttaatagttcatagaagcagaagctgagtcctgtttgtcaaacattcagcatgaaatgttcatgttacctgggccagatgcatcactggtatgtggcc

SEQ ID NO: 469979 - DNA, 699 bp, Homo sapiens
gaagttcatcatttccctgaaggtgaagaagattggccacttgtccaggtcccaagaagagagtccaggtttgtcctgataatatgactcatccaacttctgataactctactgttacacacattcatggagggtccagctcacatgggaaatactttctgagactcatggacctcctgcacaagaacatgaaacacctgtggttcttcctcctgctggtggcagctcccagatgggtcctgtcccaggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagacacagtgaggggaggcaagaaagaagggagaaatttctctgtttaccattaaggttttaacagtcactggcacctttttttcaacaaattcccacaaggcccattttaccttcttgacaaagtatttcaaggcttctcaccatctcttgattggcgtcatc

SEQ ID NO: 469980 - DNA, 1968 bp, Homo sapiens
tcacccaacaaccacatccctcctcagaagcccccagagcacaactcctcaccatggactggacctggaggatcctctttttggtggcagcagccacaggtgtccactcccaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagacacagtgctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagact

SEQ ID NO: 469981 - DNA, 1862 bp, Homo sapiens
agctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggataaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactaaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatattt

SEQ ID NO: 469982 - DNA, 1168 bp, Homo sapiens
agagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactggtggccagacaacgaatgtgctctaactggcaacacctaccagttctctgggcccatagcggcaataggtggttatggaagggccacggaagtcagaccggttgaactacgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgt

SEQ ID NO: 469983 - DNA, 623 bp, Homo sapiens
tccaggattcaaggcaattaattgaataaataaaataggaagctaagtaaaaactgtaggccctaggacagcggctgtactagtttacattcccaccagcagtgtagaagtgtcccctgatcactgcatccacaccaacatctaatgttttttgattttttgattatggccattcttgcagggaattatgttgtcatggatggctttttctacactgagtttatttcctatcatatggtcacattctattcaacggcgtatggaacattctccaagacagaccgtatgataggccacaaagcaagcctcaataaatttaagaaaattgaaattatatcaagcactctctcagaccacagtggaataaaactggaaatcaactccaaaaggaaccttcaaaaccatgcaaatacatggaaattaaataaactgctcttgaatgattattgggtcaaaaacgaaatcaagatggaaattaaaaaaatttttgaaccgaaagcaccagtcacatgaactaaaaggcatttgggttaattagtacatattttttatgaatgcttatttatctaagccaatctaaatagaatcccttaatagattttttgttgatgatgccagatttt

SEQ ID NO: 469984 - DNA, 1177 bp, Homo sapiens
gtaaattatttggaatcctttggcaatggtgatttgtctcttctttcccatgtagtttattcagtcactgatgtctgtcagcactgactcatggacacctgtgtcatattttgggtcatgactcaaccctactttattttgttgctcaagttgttctggctttggccattgggagctcttccagttggctcctgtgtccctttaaggattggagactgcagcccaaagcatggagatctggggcctttgggcagagatgggagggcttgtctgtgcccacacacagctgtggggctcagaggggacagttgtacttcactagggtcactggctcacacagcacaatgtggacataaaagtccaggatacaaggcaggcacacctgatggggagcaattggagcacggaggcaaggaggccaaggtcttcatccaccaagtgacaatgctgccttcgcctgcgacttggaacactgacaactcctcacaggagaagctggcggagccttgtgcagaccattccagtcccatgaggtcatcctcatacgtactaacaagctaaagagaccagacaagcccgatacctcccactcagtcttgaaaacgttgatgccttaaacctcccactagacattaaaggaagcttctgcctggggccctgcatgagaagggaggcgcaagatgagaccattgattgaagttctttcttttttcataatggaagcatttttaaggctaaaaatttccctctaagtactgctctaatggcatcccacaaattctaatatgttttcattttagttaaatataaatacttcctaaattatattttaatttattttttgaccattgattatttataaatgtgttatttaattaagtatttaaggtttttacagatttcctttagttattgatttctaatttcaatccactgtggtcagagaaaacacttttgtatagtttgaatgctttttaatgtactgagacttatggcccataatacagtgtatcttggtaaatgttctgtgtgcacttaagaagaatgtatattctgctcttgtgtggagtgtcttataaatgacaattgggtcaaattgattgacagtgttcaaatctatttttcattagtttttcctacttgttctatcaattattgaaagaagactgtaatgttc

SEQ ID NO: 469985 - DNA, 2672 bp, Homo sapiens
tgacctcccctctgacctcctgtcctggtcagttggaaggacaaggactggcagtgcttcccaggaaggaaagaggtggaaagcggcctgggatcccagtcggtcacagcagctgcctgagccagggctgctatacctggcccctgggagtctgagagtgcccaacctctgcttctgaactcaccttgctgtcctgggcagagccacagcactgggcaggcctgcaggctggtcccagaggtgacacagggctaagcaggaacctcctgtgcaaaagaattttatggcaaccagaggatgcaagggtggggccatctgagaaggaagtggaggtgagcctttcctccccaggtggcaggcaatggtgagtgatcagtccccaggtggagttacactgcagggaactccttccctggtcacctgggctctggccacctcttctagaaggcacttgcttccccttcgccctcctccatcatcgtaggtttcctgagcgctccccacaagccatgtggaactccgccgagagtgtgagaatcccttttcctcccgtgaagggcaccatgtgtgctgctgtgctgtggctacccaagcagatactacagattgggatttggaggtgggagcccacagccaccgaggagacccagctgcagctggaggtgccactggaacagagagagggagagaagggcctcacgtgtcctttcatcccacccttcaatcttgggtcagcaccgcccattggccaaatctactggaagacagaagggaagggagcctggatgttgggtcactctgccattgaggagtcctctctaaactatggccaagcatttgtacagactacacagaagccagcagctccacatgacaggggagtggtgaggaagagctttgtgctcaacggaaaccggggagatggatgagcaacccttggaggcattctcacacggatcaggggctgcccttgctgactcctccccagcctaatctccccttgcttcaggaggaggcttacagtgtatatcttaatatatcagatttatactgacttatttccagagaaatatagctttacccttatattcctccattctctccccattttttgatgccattttgaggcccaacaatacacctgtatattacatatattgttttatgtaattactttttaagtaaggcaagaaaataaagggaaagtatgcaattatgcagtcttttgtaattatctatataagtacctttactgacacttttgtttatttgtgtggatttgaattactatcttgtgttgcttgctttcagtctgaagaacttcctttagtatttcttgtaaggcagatttgctagcaataaattatctcagtttttatctgggaatgtctttatttcacctttatatttcaagatggttttgctggaaataagatttttggttgacagtgttttgtctttcaacactgactatttcattccgctgccatctggcttctattatttctaatgaatttagttgttaatcttattggtgtccctttgcatgaattgctttttttttttctcttgctgtgaggagtaaatggggaccttttttctcttgcccaaatacctatctaaggggactggggagtcatgctctacaaaccataaaaatctcatcagacaggtttttataaaatgtggcttgctttccacttgactttggtataatatcacatgacagatagcagactctaaaggacatattaataaaaatattttaccacaaaatatatttctttaatgtactttgcaatggctgccacagtgccaacagattaaaatggccctgcaaagccatcttttatggggacaatttgcagctatagagaatctccatgaatataaccaggtattttcccttccaggaggttttctcagatccaggagagattaagggagagcctgacacctttaaagtctgaaaagagtcactcatcagctatcatatctctgagagctgccacccatgaggcttcatctacataataagaacatggtctccaaaactccctaatcttaactcaggcattcttttctactgatttcaagtccttagacaatagcttaactctctcaaccaactggcaactgaagaatcccctaaacccacctatgacttgtaagcccccactttgagatgtcccgcctgttccagccaaaccaatgtgcacccttctcatattgatttattattttacctgcaattcctgtctccctgaaatgtgtaaaaccaaactataacccaaccacctcaggcacactttctcaggacctcttgagattgtgtaacctgggccatagtcaaacatattggcccagagtaaacctctttaaatatattttggcaacatttggatttttctgtcatcaactgctttcaaaattttctgtttgtgtttgtctctaacattttgattatgatgtgtttgggtgtgtttctctttgtttttatcccacttgccatattgagcttcctggatgtgaggctagtacttttcatcagattcggaaagtttttagccattatttctttgagtacttttcctgtctcctcctatttctcctctcctctggcactcccaatatgtgcaggtcagggtgcttagtggtgttccacatttcac

SEQ ID NO: 469986 - DNA, 662 bp, Homo sapiens
cctgacgtccttgctccaatacccatggagatcaccttttctagctctggcgagagctccaggtccacaccttggctggagcggaccggagcctcctctcaacccccagccaagtgggcacctttctctttccagacctgccaagccccccgcagccagtgctgcatcggccactcccactgccagcaacaagctgggcaggctctgagcaccgcccctgctgccccgggtcctgggtccacccctacagagcaagcccacccgtccagtccccaccgtaccaccagggacagccctccacagccctcagcagcacaatctgaagcttctggatttgctcttcctggctgtttgcctctctccccatggggaggctatcaggggaacccacccccaatatttcaacgtaggttctttctattttccctacgttttggctggctgagaaataaaaagaaagagtacaaagagaggaattttacagctgggcctctgggggtgacatcacatatcggtaggaccatgatgtcctcctgagctgcaaaggtttttattaaggactttcaaaggggagggggtgtacgaacagggagtagggtcttaattattaatattccttgctaggaaaagaattcagcgatatcttccctacttgcatgtcc

SEQ ID NO: 469987 - DNA, 2217 bp, Homo sapiens
gagaatcagggctatggctgccacagccacatctccagccaccagcagggggttcaagttctcgcaggaacagggacctcgacccctaggcccccgctggcagcctcgtcctcctctgccccgtccccaggacccttgggctccggggttgcatcaggactgctgggcaccatgggggctgtgggggctggcttcaggttgccgtggttgttgagaaggacggggtttgccttggccggggtcttcttggcaggcgccatggtgggggctgccagtggctgctgcttctctgccggggcttccttcttccagggctcggtcaagggggatttcccatcggctgccgggggtaccttggcctcggtggtggcctgggtcaccttggtgtcgggcttggggctgctggccgatttccctctggactccgtggtgggcagggtgtatgggacaggcaggtggctgcagcagaggggctcaggacagctcgtcacccctgggcattctatggacacgtcctccggcctcgcctgggttgcgtgctcctctgcaggacggcggcggctgcagacgcagagtagagctcggaaaggtgtcttccaccgtgactgtaagtttcctgaggcctccccaaccgtacaaaactgtgagtcaattaaacctcttctctttataaattacccagtcacggggtgatcagtttttgctccatgtattttgaatatatgttattatgtggatacaatttaggattattatgccctcttgatacattgaccctctgttatgaaattacctatcactgatattatttgccaggaaatttacttatattgtgattaatatagtcattccagctttcttttgatcagtattagcatggtgcattttttcctagccttttacacttaatctgtttatagttttacagttaaagtgggtttctggtagttagcatatagttgcttttgcctttttgtcccaataagacaatctttgcctttcaagtatagtatttagttttaatgtgattatcgatgtgatgggtttaaatcttccactttgttgttttctacttgctttttttccctcatctgcttttttttctttcctctttttccaacttcttttggattaactgagtatttattatgatttagttttatcttctttgtgggctcattggctatacatcatttttgtgtgtgggtgctttaggttttataggatacatctttagcttatgttctacctataagtaatattacaccacttcatgtgtagcataaaattcctataacagtaataatctagttcccttgtcccagggtctgtgttcttgaattatacattttctttctatacatgtgataagccccacaatgttgttatcacatttcctttagtcaattatttatgtgttaaagaacttgactatattttatgtgcattcatgattaaacccacaagtttaccgctcctagtgctcttcattcatttgaacaaatctagatttccatttgctattatttttcttctgcataaaggactttatttaacatttcttataagtcaggtctgacagcaatgaattctcttacctctcttatgtctcaaaaagtcttcatcttgctgtggtttttaagttttttttttctgggtatagaattctagagtgacaatttgcttttcccctttgtattttaaaggtgtttctccactatcttctggatttcattgtttctgataagaaattggtatcattcttacagttgttctgtgtatatgtctttttttctttgcttttaaggttttcccttgattactggttttgaataacttgattgtggtgtgccttgttggcgtttcttcatggtttacctctacctggggtttatttagcatcttgaaaaaatttcagccattacttttccaaatattttacatcccctacttctccttcaggactccaattatacatacattaatccatttgtggttctcctgcaggtcactttttctgtctgtgttttattgtggaaagtttctattgctatgtttttaagttcacagatcttttctgccagtgtcaaatatcctgttaatcccactcagtgcttttcccatcacaagaattgccattctcatcagctgaagttttgtatcaatctttttttacatcctccatgtttctccttaacctgctcatgccttcctcta

SEQ ID NO: 469988 - DNA, 2049 bp, Homo sapiens
gaatgagcgagtgggtgggtgagtgggtgaatgagtggtgctggggcggctggcctggaatcaggatcagaactcctgggttccctgtaatgtgctgagacagagctgcggccgggcctctgactctggggtgggtggggccctctggggcaccccctcgttaaaagttagtgctgaggcagagtcttaagtcggagcaggcagggctcccctgcaggcaggcaaatcacagcctcagcccagtgattaggcaccacctctgtggaagggtcccagagctgcctgtgatccctcaccctgcagtctgagtaattcctgaatgacaaccatccacactccctcacccgtgcggatactgccggaagagcccttgccaggcccctacagctgggtcttcccaaatccaccttccacggctagttccatcctgtcctgggaagaatctgtcagccaccaaaattgctggctgaaaggagcaggaatgaaaagattcaccttgaggacattcctctttgtcaggagcagaaaagattccatttgccagccgggagaggattccgggttcattgatagcagcgtgctgagcttcacggggaagggcttcagcaaatgccaaagcctcacccccagcgaggccctgattctcagttctgtgaaggctgacagggatgaggaagctgcagaagaaaagctggaagctggcagaggtcggttcgtgaggcttaatgtgtgtccccagaacatgaaagtgcagggtgaagcggcaagtgctgacggagaagctgcagcgagttatccagaagatccagcttggatcatcgacgaaggtggctacactaaacaacagattttcaacgtggaagacacagccttccattggaagaagatgccatctaggactttcatagctagagaggagaaggaagcaggaactgcacatgtggtggaaatagcaagagaactagaattagaagtggagcctgaggatgtgactgaattgctgcagtctcatgaagaaactcgaatggatgaagagttgctttttacggatgagaaaagaaagtgaacactgttgaaatgacaacaaaggatttagaatattccatcaaaacttagttgatggagcagtggcaaggattgggaaaattgactccactgctgaaagaagaactactgtggataaaatgctgtcaacagaatcgcacgctacagcaaaatctttcaggaaaggaaaagtctattgatgaggccagcttcactgttgtcctaagaaattgccacagccaccccagccttcagcacccaccacctccatcagacagcagccatcaacatggaggcaagaccctcaccagcaaaagatgattcactgaaggcacagatggtcgttagcattgtttggcaatgaagtgtattttaattaagacccttcctcaggcctcaccccactctggcccaacctcaagctggggcctgccccagggaccaccctccacatcactggagcgtgcaaggaccatgcccagactgagcccctaccccaggatgggctacaaggccctctggagacatggggtggccagaagggacccctggccctccctgagcccaggtcaaggctgtgccctgtgggggcagctccagagctgtgccggctcctcccacagacagcagggagaggagcctgtgctcctcccacaggagccggctcctcccacagacagcagggagagtttagtgtgcaaactggaaggccagggcccttctggggaccggatgctcacctgagcccctccttggaggaggaagctcctcgaggaggtcgtgtccctgattcatcctggcccagagtagagctcagcaactgtaaattggttcctggggagggccggggatgtccgggggggcttcatctcctatcttccccgcaggtcctggtcacttacttgtctgtggctgcaggacgagtgccctgaccacagcccctgggcacaggagaggtcgtgggccccatacgtgccctcttccccactaggccaaagaggcccc

SEQ ID NO: 469989 - DNA, 856 bp, Homo sapiens
gaggagagaaagggccagggcaaggcactgctgagccgggcgggctgctgctccgtgctcactggggaatgttgttcagacctgcggccagggtgtcctcgctggacgtgcactgcccgtcctgtttcagctgctgtcccctcagcagccaaaggggccctggcagtgagatcaagctccaaagggccagctccttctctcagagtctccgagagctacatggagccccagtggcccccaccttcccctcactcagcatgtgcagacgccaccttgctggatacctgtgggcctgatggacagacactgtgtaatgtcatccccaaggctctcgcacgagcacacagtcgtgtgtggaccagaacgctctttgtcgactgtggagcattgagcaaaacggaaggatctgttgaatgggaacggcactttgactgggaagatgaagatgctctgcaggtggatggtggtgacggctgcacgaatgcgactgtgctgaacgccgctgactacgcccgagagtggaaaatcaagaacaaagggaccactgtcggtgtgaatattagaaagagtgatgtgccttccacctgtgacgtagacgtcgatgctggaaagcaggaggatgcctgtctgcacagcctttgatggggagagaggtccctggggccacctcaaggtcatctgtggctgtcacctccatacctgccgttcggggatttggggcacacaaatgcagggacccccttccccgaggccgtggtgaagccaggaaggccagggcctgtgggccaagcttcagtatcctaaagccttcagacacacaccagggctgcactgggctgttttccggttttaagaa

SEQ ID NO: 469990 - DNA, 2925 bp, Homo sapiens
gggacagagaccacaggggacagagggtcatacctgtcagagggaagccgctaggggtgagaagggcggtggggagaggcacagtgcagaggagggcatgccttttacttaccagggcaaagggaaatctgacctccacgagggtggataaagctctgccaagctcgccaactgaagccaagaaaaaacgctaaggaaggaagcacctcgaaacacagcggctggagaggcagcgggagcctcctgggccggtgctccacgggggtgggcggctgcacccctcctcacagcctcgccgatctgggtccggggtcctcctctccctcggactgtcctccacctgacacccctcttctctgccagccaatgcctgggctttctgttccttgagccgtgaggttcggatgagagaactcctcatctgcagagaggagatagcaggacctccaccctggagtgcggggagcaagcaagaagcacggaggggctcagcaaactcagcacctgtgaatgagagagccgccctctacggcccctctaaggcggttcaggacgcgctggtctattcccagggaaagttccaggtttctcctgtgcacgcccctccctccatcctggctcggtccccagcatcagcagcggcacccggagcagcatggcgggctccatccattacctcctgcccaggaggggagcagatggagctggggcgagactgctgtgcccggcacacaccgccacagaccctgggccactgcccctccatgcagccccccacagccattgccaggggccctaactgggaggctctgtgggggtccctgctctggttgacggtcacgcactctgggaccacaggagcccccacacccgctgctggtcgcctgaacctcgagcctcacagcccaccactgcccctccacatgcaggaccccctcgtcacatgtcagcatgtcctggagaagctgccactcgtggtggtctggcgtcagagccagctgatttgctggcaggcgggcaggcggcggatgggcctggagagcccaggagaccctgggaccacttcacaggacaagagcatgggtggggccccccagcaccaccacctctcacctggggtggataaacacgccgcggcctttgttccgggctttcgaggagacatttgtcatggagatttatcctcacttaggccggagctcgtgtgcttgggctccgtgtttatctccgagggcgcccactcaccctgaggcttcctatgggaagagcttcctggcgtggggtgcagaagccccccgggacaagctcgagggtccaggatgtggtgcaacgagctgctacacctgtcaccctgctgcccgcccagcctgaggcagagctggacctggcaagcgttggctgaaagacataagagggggcagctgaccgaggtccccatggggatccactctggggtggctgactgaggtccccacagggatccgctctggccagcaggactgggggttccctgtcccaccattgaaggaggtggaagtgggcccaggtgggctgaagaccagcccaagcaccccctgctgtctcggggctgggcacccattaccccctggccaattcttgtcccgacctctcaggggctctctcgggaggtggggctctggggaacaacagcagctcaaggacacaaagggcatgggaatgatcagcacgcagtggaggtggcaagggcagggcccctccaccatggccacggccattgtgacccaaatgggggctgtctgcagggcagcaggcctgggcaggccagctttgtttcatgctgaccagcagcacctgggccagctcagagcagccttagagatgcccctagctgcttccccttcccacaccagtgtcacccggccccttcttctcccagccctgcccctaaaggagtaaggcccacaagaggggtgacagtgagaggaggaagtgggagtctgggagccccagtcgcagatctgtgtgaacttcttccttcaggagggggcctgggcccctgagccagctgtgcccagagatggggtcagtgagtacttgtggaatgagtgagtgagcaggggcgagggaacaagggaatgaataaagaaaaggaagacattctgcaatgtttcatttttaaaaataatttttcctttttttttttgcattttggggagtatctttaaggccattgctcttcaggggctccccttgccatcttctcccttcttgagttctctgttcttgtccgtcattatctgctttcctcggacagggtagggggcaatgtgtcatcactgaatccttgaatacctcccatgaactcttcctggtctgcaaaggctatcttagctggcctccctcagtagtgcagaggctgtttcactgcctcccaccttcatcatggctgcctggatccatgttctgtttaactaaaatcataatactgaaatgcagacagtttggtcatgatgtttggtcatgatcctttttacacattaccatattcagtctgctgaggttgtaagatgcttgtgtctgtgtttgtgagtgagattttccttcctcatactttcctatttggatttctgtattaagattatgctcacctgataaaataagttgggaagagctccctcttttctttgaaagggtttgtataaaaatggcatttttttatttaaatattaaatcaaagttctgaatgaaggctctttgggcctagagttttctctagggaagaaacactataaagtcaacttctgtaatagtcatagataagaatttttcaggtcttccatttcttgttgtggcaattttgataaatgcctctttctagaaattgttaacttcatcaaatgtttcaaacttattgacatgaatcgattaatactattcacttat

SEQ ID NO: 469991 - DNA, 611 bp, Homo sapiens
ctgctcactggctgcctaacgaggtggggagttggggtgagtggcccaggcaaggcccattgactcaccaatgggctgcggctgcccctcctgctcctgtctgcagggcccaggagagggccatgctgacaagggatcctgtgagcagcctaggagcaggcgcacattccacacatacttctggagcatgtgctcagtgccagatgccacaacaggggctggagacacttggggagctccaggctcacatccctggggaggcaggcgccagccccatagtcctctgagtaactgtcctgcagggtggtgctcagccgtgcctgcccacacctccatcgactccaggtggcacatcagggcagggtcaccctcaccctccagttcccagaggcctcctctgtcaggctgcaccctctatgtcccatgtgcacagagccccgattctggctgcagaggcagctggcaccagatgtgcagacacaaggtgcctgggcaggtgcccagacagaagcctcagtctggggccatgagctgcaacatgtaaacagcttggaagtcactcctctccttacaataagaaaaaggcggaaaaagtgaaaatcagtgacttt

SEQ ID NO: 469992 - DNA, 812 bp, Homo sapiens
gagtccccttctctcaccacgttccccggggcaaggcccagcttcgacctcaaggtcccccgtgccagcacagacttgagggggggcctttgctgagaccctggatgaaaccctgcagccaaaggacaagcccggaacaggcctgcaggtgccacttccagaacgccttactgctccttgtccaaggagtggctgcaactccaccttttccctggaacaggccaccggggcatgtggacaaagaggagcttgcgaggcttggcgagcacggggcggagccaggggccgaccccacagtcctgcccctgccagcctggctctggggcagctggccctggaccgggctcctcctgcagggccggtgcttccatccccggcgtggggagcggctgtccgtgcctcctctccaggaagaaaggcactgcagcccgtcacaggggcagagtgacgtgagtggacgtgtgtgtgtctgtgcccagcacgacgccagcgtgtgctctggagatgaatgctaacaggcacaaaacaattgataaggtaaaatcagtttcttaataaacactgccttgtccaaggctccccaagacattgagcatatggggagccctttgcagagcacctgagtgaagcaagtcattccttctaaacctttcctgtggccaaagctgagaaatgcatttattttttgggtttttttggcaagagaaaaatacatcatgaattcatactaatatttcccatttaaatgtaagattacagtgtttgtgcagcttctttgattttttaatttctatctctctcctcttatgctg

SEQ ID NO: 469993 - DNA, 677 bp, Homo sapiens
gttggggaagaagcccagctgcctcgtgcctgcatcactggcagcaactcagtgccctgcggggcacaacctgggtgccactgcccagtggcgggccccgggccatggggaggtgggggctcttgctgctgttcggctctatggcctttgatagaacccggcgggtggtgggttttggagcagaagatgcccaagaaggaagagaaggaaaggcacacgagttagatctgtacttgtttctggaagcttcttatgtgagggactggctggaagatttgagctggaacatcagctccacccaggtgtcgagtctgctggtgtccggcctgatttgccaccatcagctctcccagggctccagcttactgactcggtgcagccctggaactttccagaagcgtgcctgcctgcagtttctcctttgtgcctatgggcagaaaatgcccatttcccaggcccaggacaaaagctccagaactggatgcttcgaggcagtggccacaggagaagaggacccatctgccgggtgggcaagctgaactgtcacagcccccacgcagtcccacgtcccctcttgctcaggccacagacatgcacaggagatgccaggtcctgtctgccttgaagagtccaaggaaaaactttctcgttgtaatttcgggccttggggagcctct

SEQ ID NO: 469994 - DNA, 1887 bp, Homo sapiens
gtgaggcgcagcggccggccggcagaggagaagtgtccccagcggggcgggcacggccccctgaggccgcagctgagcctcccactcccggcctgcggtcccgagtcccggccgcacctgccgaggcccaggccgcgaaggagggaaggccgagccgggcattagcccccgcgccgggcgccgcggggagggtcttatcagcgcgggcagctggcggcctgtccctgcgcgagcgccccggcccaattcaatggccattgtccgccggcaaggcttgcagcccccagccctgctgtgggcctgtttggctgctctgtcttggggagaccctgccgtggttggggaatgcggctgggccgagcaggaggtggagcccgagagtcctgcggggatgtgtggggtcagcgtgcagaccgagggtcctgcgggggtgtgtggggtcagcgtggagaccgagggtcctgcgggggtgtgtggggtcagcgtggagaccgagggtcctgcgggggtgtgtggggtcagcgtggagcccgagggtcctgcgggggtgtgtggggtcagcgtggagaccgagggtcctgcgggggtgtgtggggtcagcgtgcagaccgagggtcctgcgggggtgtgtggggtcagcgtggagcccgagagtcctgcggggatgtgtggggtcagcgtggagaccgagggtcctgcgggggtgtgtggggtcagcgtggagaccgagggtcctgcgggggtgtgtggggtcagcgtggagaccgagggtcctgcgggggtgtgtggggtcagcgtggagcccgagagtcctgcggggatgtgtggggtcagcgtggagaccgagggtcctgtgggggtgtgtggggtcagcgtggagaccgagggtcctgcgggggtgtgtggggtcagcgtggagaccgagggtcctgcgggggtgtgtggggtcagcgtggagaccgagggtcctgcgggggtgtgtggggtcagcgtggggtctgagggtcctgcggggggtgtgtggggccagagcctcgtcatttatgagctctggcctccaagcctgtggctgcatctgaagcccatggtggacacctcctgctgctgctgggcccgcccctgcactctccggaaggcactgcccagcttggaacacgccgcgggcaaagaggacctgggcccagcccctcaggcactttcggctctgcgggtctcagagggcctgtgtgccgtcggcgggggtcgactcacacgctccagctttcgtgtacatagccagtgacacttcacaaagttttccaatttgttttcatcgtagtaaaagatacacaatgtaaaatgtaccatggtaaccactttttaaaagttttttaaattgaaagagtaatacatgccatgtgcagaagcttggctgcacacacactcacacacacaccccccacacatacccccccacactcacacacacgcacacatacccccacacacacaccccctatacacacccccacatatacatatcccctcacatacatacatctttaactctttacaaaaagactcctttcacatttctcttccttccatactttcttcatcacgccctactttctataatctcttattttcattggtgaattattcaagttctttatttctttacaatatcttttttattaaaacttcttacatattttatatacatccctttctaacttcttatttaacatactaatgtctcttttcataaaaaactcttcattttttttctcccctccctatttctcttttttaccttgtcctctttctatattttttcggctttccttaatagctttatatatttgcaattcttctctatctcttacttttttaccttatttattc

SEQ ID NO: 469995 - DNA, 627 bp, Homo sapiens
ctgccctgcgaggccccacagcccggtggcctcccccgtggtggccttgtctggtgcctggtccatgccatgcgtggctgtgcagctgcagccctcctaggcctgggaccctcgcggctggcgctccagggcctatctctggctaccgagcccctcagggctgttgtggcctcgggggctcctggcctccatgatgagtgtgtccttgccagctgtcggggtcaggcccccttgggccaccccaaacctgtgatggacaaggaagcgacctggccattccatcagagcaaggatgccggatgctgcagccccagaggcctctcgacagccttttccagcccctccaaggctttcaagcagacgcttcctggtccccagatcgacagcaggataacaatattgctgcagaacaggaacctagggaagaattccagtacactcggatgcctctgcacacatttctcatggctttcgatcatggtgccaggttcccgtgtacttggtttgattgtggtctactcactgacctggaaaactcattcatgaggtgtacagatgtctaggacaaaggtgatttgcatttggttctaccaggaacctagggaactgcaagttaggtacacaccg

SEQ ID NO: 469996 - DNA, 496 bp, Homo sapiens
tacaaaagtcaaaatctcagttcatctctcctcaggcccgatagggtgctgatgcacgagtttgcaagggatgcagagtctgctgtgaaaaaagcccacagggcttcacacaggaggacaagtcagtatggccttctaaccttacttatcctgcctcagaaccacctgagaggctgctggatccgatcaccacctggacagtgccctgttaacagatctgcgttaaccaacaaatacagatctgtattaaccaaagagctgcttgaattgacaaaaatatatcctggtttgctgcttgatgtggctacttgggtccctgaaatgaaaggatgtggaagtattacagcaatgcagagatggactgaatccagccattttcctcttgcagaaattgccaacaagatctggtctggtctgtgtgccaataaaagagacaaagactgcagatggctatgggacagatttcctgggagagggtcctcccatagctgacaag

SEQ ID NO: 469997 - DNA, 1508 bp, Homo sapiens
ctgccagcacgctgtcacctctcattgggaaatggggttaaagctccttagaatcaatgtggatgcagctggaggccattatcctaagggaattaatgcagaaacagaaaaccaagtattgcgtgttcttacttataagtggaaactaaacattggtggtctggataggagatcaaaccagccacaatattcccttaagccaaagcctaatccagagaaaggtcctctcttcaattctgtgaaggctgatagtggtgaggaagctccagaagaaaagtttgaagctagcagaggggctaatgcagctggtgactttaagttgaagccagtgctcactgaccattcccaaaatcctaggacccttaagaactaccctaaatctactctgcctgtgctctataaatggaataacaaagcctggttcacagcacatctgtttacagcatggcctactgaatattttaagcccaatgttgagatctactgcttagtaaaaaaggttcttttcaaaatattactgctcattgacaatgtacctggtcacccaagagctctgatggagatgtacaaggaggttaatgttgttttcatgcttgctagcacaatatccatactgcagcacatggatcaacaagtaaaatgctatcaaacagcattgcatgctacagagaaatatttagttaaaggaagggtcactgatgcggcaaacttcactgttgacttgtttgaagaaattgccacaggcaccccaacgttcagcaaccaccaccctgatcagtcagcagccatcaacatcaagggaagaccctcccttcatcagcaaaaagagtatgacttatggaaggctgagatgtttgttaacattttttagaactaaagtatttttacattcaggatgtcatatagttggaatcatacagtaggtagcttttcagattggcttctttcacttagtaatatgcatttaagattcctccattttttttttttgtggctttgtagctcatttcttttcaatactaaataatattccattgcctggaaactgtatatcacagtttatttatcaattcacctcctaaagaacatcttggctactttaaaattttggcagttatgaataaacgcccaagtgtaggtttttgagtggacataagttttcagcgcctttggataaatatcaagaacagttattgctagattgtgtaataagagtgtttatgttttgtgaaaaactacccaactgttttccaaagaggctgtaccattttgcattctcaccagtaatgaatgagagttcctgttgcactacagcctcaccagcatttgatgttgtctgtgttctggattttggtcattctaataggtgtgtagtggtaatacctttttgttttaatttgaatattcctgatgacatatgacatggagcatctttttataggcttatttgccatcagtatatcgtctttggtgaggtgtctgttaaggtctttggctcatgttttaat

SEQ ID NO: 469998 - DNA, 723 bp, Homo sapiens
acaactcaaatgactgtagatttctcatcagaaactgtggagccacaaggaagtgacacagcattttttaaaattctgaaagaaaagacctgtcaacccagaattctatattcagtgaaagtgtccttcaggattgaagaggaaaagtttgaagctagcagaagttggtccatgaggtttaaggaaagaagccatctccagaacacaaaagtacaaggtaaagcagcaagtgctgatgtagaagctgcagcaagttatccagaagatccagctaagatcattaatgaaggtggctacaccaaacatcagattttcaatgtagacaaaacagccttctattggaagaaaatgtcatctaggactttcatagctagacagaagaaggaacatcacaaaccgtggcctgtcatgaaatggggcacgggcagagggataacattgggagaaatacctaatgtaaatgatgggttgatgggtgcagtgggccagcatggcacatgtatacccatgtaacaagcctgcacattgtgcacatgtaccctagaacttaaagtatatatataaaaaaaagaaataacccaatatacagggatctccattgcccatcccctcctctaagattttccgtatgaaatcatttctttccttctgcctaaagtaccatttaaaatttcctttagtggaacacttttacactgttggtggaactgtaaactagttcaa

SEQ ID NO: 469999 - DNA, 669 bp, Homo sapiens
tccaagatcaaggcagcagcaggtttggtgtctggtcgggggatgctctcccctccaagatggcaccttgttgctacaacctgcctcggtgccagttgatattcattaaaataagcccgagtttattttttaagaagcccaagcgtttggagacctgggtgacttggttccctcctgctttgaggaccagcttcaagggcttctctacatactcctcgtacaggtgcttgtctgacctggactttttgccatgttccactaggtcccagtgcccgaccccctcgccaggtcctggccctgcaacactgctttccgggccagagaagaaggctgcatattggaaacccttttaccacatcgatataagaaacatgggcttgctacactcggtccagaggactcagacaccattgagtgtcaccagtgttgacctaagcgaactgctctggaaccaggaaagttcaggatggtttcattttaaaaacaaaaccaaaagcaaaactttaagcctttcgggggtatcactggcatctgtgggggcacttgcttaccacccctcaggaactctgcggtagtgctttaagataatcttttcaggtggctatgtcatgtaagtctgagtttctcttaatctacagctaatattacctgagggaacacaggtctttc

SEQ ID NO: 470000 - DNA, 480 bp, Homo sapiens
tcctctggtagtccccagtaactggcagagtaggactgacctgatgtactcagcaaggtcaggtaaaacatccttaacccacagcagaaatccaactagttctagcagaaataagtcctgcttgcctaagtccaggtggtccaagaagaatagagccggagaagactgccttgcttccgtaagacaccatcacctggagataccaactgggggagagtggggacacgtctttgctgggttggagctccagcatggaccacaggggccccctatgtccagcagaaagaggccagcccagttctgttatgagctgtccagggggttacacactgtaaactcccttgggaagggtcaggaatgtgtcctggaagttcgtctgaaaatcaatgactttcatttatggccaggaacttgtttccagaactgggaagaaaatctatggcagatagctgctcccctctccccagagacttaggagaa

SEQ ID NO: 470001 - DNA, 649 bp, Homo sapiens
aggccagagcaggtgactcctttccttaaagcccacagtggctcccattcacatgctcagattcaaggacggcaacggagctgctgctgatgcagatgaaatagattgtccctctgcagtgttaattaagtgtatcagaaaattacttataaggaatggagtcacactgaaagataaaccatcgcccaaagtcatggaagagcagactgtgtccaaaggtaagaacagttatggcgccctgagttggatggcagcagacacaggaagaatactccccttgagttcaggcccatgcgtgtggacacatgccacaccccagtatagaaagccaccttctggggtatcaggagaagcatctcaggaaggtcctgtgcctaggaactcactacaaagccatcaaggaaatactggggggagccatgcacacagaggtgccacaccgttggaactcactgggaaactgcttttggagccccaggaggagctgtgcatggcgtgctgtgctgcacggaggcaatgttttagttccacaagcaggggcacaaagggtgtgtttgcagccgaaagacaatagatttaataactgacacaatctctaagcaactaatgacctccatctaattctatttacttcactgctatgtgggtg

SEQ ID NO: 470002 - DNA, 1286 bp, Homo sapiens
caattgtcccctctaaagatctgattgtttgaaagtgtgtggcacctccccctgccctcggtcctgctcctgccatgcaagatgcctgctcctcctttgccttccaccatgaatcaaagctccctgaggccttcctagaagcagatgctgccatgcttcctgtacagcttgtggaactgttccataaagacaggcaacaacaacaacaacaacaaaatgttgaattaggtgtggcagggactatgaagactggcaaacagatgtccttactggaagtggaagacaaactagaactctctctctctccatcactgaagacaccagagaggaaagagacggaagaggaccctcaccaagatccaaattggatggcacctctaacttggacttcttcacctccagaagtagaagaaataagtgtctgttgttacacccagtccacggtattttgttatagcagcctgaacagactaagacctagcacgttcttattttctgatgcaaaaagttacttcaggcccatcttctacttgctctcacttccaactctgagatcagcaatttctttaaggaattcttaatgtttttgaaattcatccatgttgtgtgtttcttttttttttttatcattaagtggtattctattaaacaaatatactaaaatgtgtgtacgtactgctgattgaattctgggttattttcagtttttctgttgtaaatgaagttgctgtgaacatatttttataagtcttttgtaggcatacatcttaattttccttggaaaagtaactaggaatagaattgtgtggttgtagaatagatgcatgtttaattttataagaaattgcaaaaagtttttcaaatttcattataccactttaccttttcattatcaatataggaggtcattccacatcctcactaacatttgttgtagccagtcttgatttatccattcttgaatgcatgccaaaattaggcaagcacaacctaccttatgcaaggaattgctaaacgtgaaaaatcattactttcatgggaaaatatggcagttcacagaaagtgaaatttctaaataaaaaatatatttctgaaatataattattgctaaaaaacattttataaaatgacccatgcatattattaaagtatattcggttaaaaataaaaatttgaggttatatacttaaaatccatgtaaatgatcaaataaattcaataggaaaaattatctatttcagcagaagccagagaatatcatctaaatattgacatttcaagaaacc

SEQ ID NO: 470003 - DNA, 548 bp, Homo sapiens
ttctgcatcagtctctctggcagctgcagaccggagctgatacaatgacacaagaggtgggctcccaaggccctggacagctcagcctctttggctttgcagggtgcagcccctgcagatgctttcatcggctggcattggtgcctgtggcttttccaggtgcacagtgcaagctatgggtggatctactattctggggtttggaggacagagaagagctcacaggttcactaggcagtgccccagtagggactctgtgtgggggctccaaccccacatttcccctctgcatggccctagtaaaagttcttcatgagggctctacccctgcaacagacttaggaaacttacaattatgtgacctttcagacagagaatccaaaatagctgttttgaggaaacgcaaagaaattcaaggtaatacagagaaagaattcagaattctatcagataaatttaacaaagagattgaaatagttaaaaagaatcaaacagaaattctggagttgaaaaatgtgggggaaggttccaagatggccaaataagaa

SEQ ID NO: 470004 - DNA, 753 bp, Homo sapiens
ggaagctgctgtagatactcagcctaattggattttccgtgtgtaaagatcaaacacatttctgtcaatggtggaaagttatggagagaagatgccaatgacctgtgcactcaagtgtcagggggagaaaaggctggacagcagggatgtgtgtgtgtgcacgtctgaagtcactgtggtcacatacagtgatggacagagggagagatgcttgacccatcaccaactacttggctgtggacccacagaagtggttgctacagacaggaaattgattgcctcttcatttcacaacacaccacatggatcctctacactggtggaccaggaaatcgcaactactttagacaccttgaaacagctcttggctctttgctggatcctagtatttgaccatggaccattaagtatcatggtgatttctgagattttggtgcacccgttctcccctgagtctccagagtccattatatcatttttatgcctttgtatcctcatagcttaaatcccacttttatagcaactgtccaaatgccttgcacatgagacacttaatatatatgtatttaaatgaataaataattaggactctaagacttgacatttctgcttagtacttctgttagtggtatatttcacagcagtagttcattgtgtatttttacctttattacttttaaaattacacaaggaacacatatttattcaagaaaaattagaaaaaagaaaagctaaaaattacactttactact

SEQ ID NO: 470005 - DNA, 1633 bp, Homo sapiens
ttctcccaagacggctttctgaaagataactacagacaacagaaatgtgtctactgtccctggactgcaggccacaggacatcagccaaggagtcccggtcctaggagccctcagccacaccctctgtgtctcatccctcatggagtcagagggtttgggaaaagggcacattacattgctctacacaggatttccaagcaaaggaaccagaaatcactataaacatgaagtcatcctcattggaatgagccaagtgtactgcagtgaaaaagtgaaccagtgctgccagcaacagaatatgcagccaaatgggcccaaacaggaagttactgctcctggcccaatcaagaagatgctgttgctgcctaacccagaccacatggcctccactgcccctaaaccaagaaaagggatgcccctgcctaaccttttctatgaggtagttttctgtacagggaagtggaccctgggagcagcttttgccaccagtaggatccaaggtagtaaatcatctggtggtcctgtgtatttgtctttgggaaatgaagatatgagatccaaaatgcaagaatgccaacttgggagaaattttccttgcagaaagaaatgtacagacagtgaacgaagcctcacagtcatagttcctgcaggaggagtgggcccaccagctgcaggggcaggctgcatgtctctgggggaagtcttacttaagtcgtgggaagatggcgctggagaaaaatcaaggcttggctacatgagtcagaggctactttctagaatccccatggtctgtttacaggtgcagggaatacagaagtccccaggggtccaggaagtgacactcaactgtctcaccttatcacctaaatttcatcacggaaagaaaagggacacaagtctgaggctcctggcggccatctttgccatcatgtgggcctgagctttcttcagagtaaagccaatataaacaagagccaaacgatagagacacgctgtggtgacattatttgagcatttgcatgatactgttgttactattaatttttgacatgccttacagtcctatgagttagctcagaattctgagttaacacaactatggaggagataacaaaatagaaaatttatccatttttactctataatgtttaatgaggaaaatgcccatcaattaattaccttcattcaaaaaacttaagaatcatttctgtgaattaaagattgttggaggcacagttgctattgaaatgggtaaaactgtgtccttggtaactaacagtttgcattttagtggggagacagtgaaaaatacctgtaaacaccataaggtgttggatttgccacgttagaaatatgcttagggtttcagttaggagataaaggagaaagtgatcagttctaccagtgcaaaagggtcaggacaaggattcagagaagaggggaggtttgcgaacctttcaaataataggcaagtggttaattggggatgggcattccatgctgaggggacaatgctggcaaaggcatagatgcaggaaacaatttcatttgctgagcggatgggcgtgtacagtttggggggatgggaatatggcaacaaatgaggctgagttgctaagcagggtacagact

SEQ ID NO: 470006 - DNA, 923 bp, Homo sapiens
aatagagctataacactcaccacatggcccaagattccattccttggaatccactcatctgccacagggactgggagagatccacgggccctaaactgaaaaaatgtgagcctgtggacagcattcatgaagtatggacaggaaacaggaggctgtggattgacccatgtgtgaactggaggaggaggaggaggttgagcttgagaacgatcaccactccaggaaatcacgcagatgaagggccctgtagccccctgaagaaaacactagcacaccgtttttccttccccaaccattccaaacactcattatgcccaagcctctttggacacttcgatcaaaattttctcctctatatcatccggaggaaatgcaccgtttgctcagggacacttagctcacctgcttcccacgttttctctcggtctccacttgtgtctggactgagtgttgctgaccaccacagcatcaaagagcctgtgagaccactggatgcagtctgggggtcagtgacctcagaggaaataccttcagtgtcccacgggctctgcaggtcagtgcactcagagtgagcttcctcacactttgctggggaaagtgtccagtagcttcaataatctcatgaccaaaagactgaagagaggggagaagacatccgagttcacattttcaggcaatagtagctgacatttcctgaatgatccttgtgtgtcaggcaccttagaaagagctaatattaacctaaatttaaactgttaaataacatcaaagatttactttacaagcacatttctaaatgtactgaaaaactatatttccataataattgattcaatggacagataaatttccttttccctgagtagttctatcatcaactaatagcccttattgcaggaaacgaaaaatctaaacacttttcc

SEQ ID NO: 470007 - DNA, 1040 bp, Homo sapiens
agcctttagcccaattgggagtggcaatgggcgccttgctggatcaggagcacagcagacaccctgccagatctggagggatggaagtcagcagcagatcccagaatagtacatccactggcagcttgcaccctgtgtctggaaaagccagacactcaacaacctatgagagaagctgtgggggtggcaccctgcaaagccacagaggtggagttgcccaacgccttgggagcccacctcttgaaccagtgtgtcctggattgactggggcagttactcagcagccagtgtggtgcaggcttcactgtgaactgctagaccttgaggtttccggcctgcaagcaaatatccccaccctctgtagagaatgtattctgatgcctggctcggatactgtcaaaaccagcagagatcaagatagctccccgatgatgtaccatagttacaaagattttgagggttatgtcatatgcacatgtgggacccacggaaatattgtgctgggtcttcaagggactgcttctcagggagacggaagtgaattccgagccccatgtcagaagagcatatgtggcccagctgcaggtttggagacagctgatagaggcctgaagatcgctgtgtgtctgctccacagagatgccttccctttcatcaccagggagatattgcacagctgcagccccatctgtcccactgtggtctctcaggatgcagtagtacacagcagcatctctcaaggtagcacggtgcaggatcaaggtactggactttctgtcttcagcgattgccagagaggccattctgttgttcacattgcttgtaagaccatgaatcacgtactctggaccctgggagggaagctgtcgataccaatgtatgtaatcagttccactgattgtggagtggttacaaggcaagtgaacaggctcttcttcgttactctccattgaatttggctgtgtggtcttagcatcacccataatacctatggggttgaaaaacagcagattagctctggatcatcagctcttggtgca

SEQ ID NO: 470008 - DNA, 691 bp, Homo sapiens
gagatttaggcatggtctctttttcactcttccaactgcaattatattcgccaagcccagatgaagctgatgattcaagttccgttagccatgttcattggtctaactacggggaaaaagtgattctctatcctttacagcaatggggcgcattagtccacatctctgtttttcttgctcactcacaggagataagattaaaaacaggaactataattgatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtcgcacactgggacagatggggctgcacctgtgcaatatctccctggtggcaagtgaggaggagggtagcattcacctagagcaaaatgtcgataggagtcaaaaagtaacaagaaaagaggaaaaggaagggaaggagagaaggaggaaaatagtatagataagatctactgtaaagggttatagtgtaaaatgtgca

SEQ ID NO: 470009 - DNA, 912 bp, Homo sapiens
gtaaagacgtagaggagttcagagctacaccatgaggttttgtgggggtatagcattccaggcagagtgggcaaaggccttgatatggaagcccgcttggagtaggcagaaactggccgtcagatggagtcacttcatgggatctccttcctcacataatggcaacatcagaatttggaagaagatgattccaatccaaatgtatgacttcaagaagttcaagactttagtggagaaagtaactgcagatgtgttaaaaatagtaggagaactagaattagaagtggagcctgaagatgtgactgaattgctacaatctcatgataaaactttaacaaatgataaattgctttttatggataagcacagaaattgctttcttaagatggaatctacttctggtgaagatgcttaccataatatatatgcggtttttagatgaaggcataattaattacctaaaagttttatgcacttagtatattatgtaaaataagaagaaatatttctagtatagattttttaatggaatatttttgatagcagtgaagaatcttgttgctatgctatgtgggacacaatcaccctaaatgtaatccacaactgctttgaaatagctgattttggaatcagtgacttcaatgatgtacaaagcaataaacatcactattctggctggaatgatctgcagagagattcattttcttataatactaaatgttgattttataagttctgatagcatgttaactatttctgctgatgctgaatatcatttcaaacaagaataaatattctttatgttaggtttgttttgagcattgaagaaaaatagtaagaaaagttgtccaagtccaaatgtcccacaagaaaatatactttggcagctgtcgaaggatttgacactactca

SEQ ID NO: 470010 - DNA, 602 bp, Homo sapiens
ggtcctgcagcattgccactgctcagccatgctcctgctgctcgtcccagcgttccaggtgatttttaccctgggtgacattgatgttgcaggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagtgacacagtgcctgagactgcaggagagctgaacacaaacctcctgagatgctgagactttctgtgactcaagaactcaacctgtggagctttcaagagggtcccttttttcttattgtcagttgttccttctcagtcttttttgctgttttttccccacatttaactaatctttaaacattggcaagcctcagaaatttatccttgaaaatcttttt

SEQ ID NO: 470011 - DNA, 1403 bp, Homo sapiens
gagacaaagttgtactgatttctatgtttgtacacagacaaggatgaagaatctatgttgggaagctgctattgatggtcctgcagcgttgcctctgctcagccatgctcctgctgctcgtcccagtgctcgaggtgatttttactctggcattggtgttgcaggaggaaccagagcccagtcggtgacccagcttgacagccacgtctctgtctctgaaggaaccccggtgctgctgaggtgcaactactcatcttcttattcaccatctctcttctgcgaaacttcctcacacctcttggtcttggtctcttcagacactttccttcctgttctctggagatcttgcagaaaagagcctgcagtgtttcccttgttcagccatgctcctggagcttatcccactgctggggatacattttgtcctgagatggaaagaactgttgaagaagcttttatacttcttgtttgcttgaagccttggagggtagcaagtagtctggagaaaaaggagaaggaggatgaatctttccagctgctacttggctcacgctataatgtattagagggtagaaagctggagttcataggtctacgaatccattgtgaggatgattctataagcagagaagcaaagccaaagtttaaacctaaatgtggatcagttacaacacatgtagaatttcagccttacaaggtctgttatatgaacgtaagagaatggactaggaaggactggggccctgagaaccaagatgaagacaagctggcagaccacattgctgagcaaagagaaactgaggaaaatccagccactttgacctctgcagtttgggtctgggaaagacttggtccaatcagtttgaccatgagaatggagagttccaacttgttggtgaatggagagaatgtggagcagcatccttcaaccctgagtgtccaggagggagacagcgctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtacacattgcttcccaggcacctgctacccgtacacaaacctgagactggagctgaagctgcaccccctttcctttgtcatagatcgtcaattatagcatttgtcatattgtttgtttgcaagttgaaactaacatattgacatttaaagcatataataaaaagataagcaactggacagactttgggaataggacaaatattgctatattaacatgtaggtcc

SEQ ID NO: 470012 - DNA, 605 bp, Homo sapiens
ggcagaatccttagagagagatgtgctaccagaaaggggtcccgatccagacccctaagagagggttcttggatcttgcacaagaaagaattcaggaaggaagttctggccttcctatccagccaatcaatggcaagcctgttcagccccttacacatactggcctaatccagctatgcagtgaacttcgtttcacatctgagacaggctctgagggggtaggaaatactgccctcttgtgttcagaaagttgttataataatggaacgtgctcccagcttcaggtcttttggagtttgctggaggtccactccagatcctgttttcctgggtattaccagcagaggctgcagaacaacaaatattgctgcctgatccttcctctggaagcttcgtcccagaggggtattagcctgtttgaggactctctcagcccctacagtgaggggtttcccagtcaggctacacggaggtcaggggcctgcttgaagaggccatctgtccattcttggagcacgaatgccatgctgagagaaccactgctctcttcagagctgtcagacagggacgtttaagtctgcagaagctgtctgctgccttttgtt

SEQ ID NO: 470013 - DNA, 629 bp, Homo sapiens
gaataggagagtgaagtaggtttatctgtaaatcataaggcacggatagctatgttttccatgttcctcattttttatgtcctgacactgattgggaatgttctcattgtcataactattatctatgaccaccggctccatactcccatgtatttcttcctcagcaacctgtcctttattgatgtctgccactccactgtcactgtccccaagatgctgagagacgtgtggtcagaggaaaagctcatctcttttgatgcctgtgtgacccagatgttcttcctgcacctctttgcctgcacagagatcttcctcctcaccgtcatggcctatgatcggtatgtggccatctgtaaacccctgcagtacatgatagtgatgaactggaaggtatgtgtgctgctggctgtggccctctggacaggagggaccatccactccatagccctcacctcccttaccatcaagctgccctactgtggtcctgatgagattgacaacttcttctgtgatgtacctcaggtgatcaagctggcctgcattgacacacccacgtccttgagatcctcattgtctccaacagtggattgatctccgtggtctgttttgtggtcctggtggtgtcctac

SEQ ID NO: 470014 - DNA, 747 bp, Homo sapiens
tgataacagaatgcttttgtctaatgatcagaatttgagaggaaacatcatttttaataatgatggggcttctgggggtgctgccctagtaacaatcatgtatcttgtcataggcactgcaggacaaagccttgagcagccctctgaagtgacagctgtggaaggagccattgtccagataaactgcacgtaccagacatctgggttttatgggctgtcctggtaccagcaacatgatggcggagcacccacatttctttcttacaatgctctggatggtttggaggagacaggtcgtttttcttcattccttagtcgctctgatagttatggttacctccttctacaggagctccagatgaaagactctgcctcttacttctgcgcttatcctgtggttccacgtatggaagatggaatttacttttggaggaagctttttatacaagggaaggatcccttggtgagtgctttagtttatgcagtaaaagatactgaacgtttgaatggagaatctaacactgaggcaaatgacctttaacatgtgagttatttgtaaaaatgaaaaaaatttcgagtgcttcattgaaatcaagaaggagataaagtctaaaaaactttcagcaaggagtgaatggtcaatggaaatgaactatacaaaatcaattatcttaaatttgaagacgttgctctgtgaatgtgaaaatgaaaactctctttgtctgtgcttctgttgctgttgctgac

SEQ ID NO: 470015 - DNA, 1115 bp, Homo sapiens
ctttcaatctttccccattcagtaggttgttgactgtgggtaagattctctgggatatggaaagaatcaacagcacactgttgactgcgtttatcctgacaggaattccgtatccactcaggctaaggacactcttttttgtgttcttttttctaatctacatcctgactcagctgggaaacctgcttattttaatcactgtctgggcagacccaaggctccatgcccgccccatgtacatctttcttggtgttctctcagtcattgatatgagcatctcctccatcattgtccctcgcctcatgatgaacttcactttaggtgtcaaacccatcccatttggtggctgtgttgctcaactctatttctatcacttcctgggcagcacccagtgcttcctctacaccctaatggcctatgacaggtacctggcaatatgtcagcccctgcgctaccctgtgctcatgactgctaagctgagcgccttgcttgtggctggagcctggatggcaggatccatccatggggctctccaggccatcctaaccttccgcctgccctactgtgggcccaatcaggtggattacttcttctgtgacatccctgcagtgttgagactggcctgtgctgacacaacagtcaacgagctggtgacgtttgtagacattggggtggtggttgccagttgcttctccctgatcctcctctcctacatacagatcattcaggccatcctgagaatccacacagctgatgggcggcgccgggctttttcaacttgtggagcccatgtaaccgtggtcaccgtgtactatgtgccctgtgccttcatctacctgaggcctgaaaccaacagccccctggatggggcagctgccctagtccccacggccatcactcctttcctcaacccccttatctacactctgcggaaccaagaggtgaagctggccctgaaaagaatgctcagaagcccaagaactccgagtgaggtttgaaagtgtctttctcccactagggaagctgccacaattagaatttattataatgtttaggcttcggtaacttttttcttttcttcttgttttttctcttttatatagccatactgtatg

SEQ ID NO: 470016 - DNA, 1230 bp, Homo sapiens
tagacctttaaggaggattgccccggcttgcctgcccgccatggccgtcaaggaagcagccttcgatgatggagtggaagacgatgagaaaggagaatttggaggttttggttcagttagtggaaacattgaaatagaaatcaagatcaaccatgaaggagaagtaaatagggcccgttacatgccgcagaactcttgtatcatcaaaacaaagactccttccagtgatgttcttgtctttgactatacaaaatatccttctaaaccagatccttctggagagtgcaacccagacttgcgtctctgtggacatcagaaggaaggctatgggctttcatggaacccaaatctcagtgggcatttacttagtgcttcagatgaccacactgtctgcctgtgggacatcagtgccattccaaaggagggaaaagtggatgcaaggaccatctttacggggcatacagcagtagtagaagatgttttctggaatctgcttcatgagtctctgtttaggttagttgctgatgatcagaaacttatgatttgggatactcgttcaaaaaatacttccaaaccaagccactcagttgatgcttacactgctgaagtgaactgcctctctttcaatccttatggtgagttcattcttgctacaggatcagctgacaagactgttgccttgtgggatctgagaaatctgaaacttaaggtacattcctttgagtcacataaggatgaaatattccaggttcagtggtcacctcacaatgagactattttggcttccagtggtactgatcatggactgaatgtctgggatttaagtaaaatcacagaggaacaatccccagaagatgcagaagacaggccaccagagttgtttattcatggtggtcacactgccaagatacctgatttctccttgaatcccagtgaaccttggatgatttgttctgtatcagaaaacaacatcatggaagtgtggcaaatggcagagaacatttctaacggtgaagaccctgaagggagtgtggatccagaaggacaagagtcccagacgtatctttacttcttgtgattttagactccccttttttcttctcaatgctgagagtgatttaacactggttttgagacacaaactttgttcagctatccctctatataatagaaatagtaatttttaaaaaattgctttttaagaaaattttatttcaatagtttttggag

SEQ ID NO: 470017 - DNA, 516 bp, Homo sapiens
agcagcagcagtgactaaaaccaccaccacctccatcttagttgttttcctttgttgatgaaaagagtcaaactctgtaacgtatttgaaaaggtttgttctgagccaaatgggagtgaccaatggcccatgacacagccctcaagagatcctgagaacatgtgcccaaggtggtcaggctacaacatggttttatatattttagggaaacataagccatcagtcagtacatgtaagatgtacactggttcagttcagaaaggcaggaaaactggaagcggtcagcttccaggaaacattccaggcaagtgtattaaaaataatgatttactgcttggatttgtagtgaacatgataataaataacagcacagattcacatggaaatcatgttagactaatctaatctcctgccttaggtagaattaggaaatgtggagaatattttgcatctttacttctgcaaagcacttgataaagtctctcaatgcaatgactaccttcctaactggttaaa

SEQ ID NO: 470018 - DNA, 1905 bp, Homo sapiens
gggagcctgggtcccagggggtcctaacttatgtggggctcctatggtgggtccgtgccatggtccgagggttccttaagcagctgctagcaaggtggcttgctgctacatgttttatagttctctttggttcagaccaggtctctgccggtgaacacccttgtttctaccatttgagacaaagatatgtccagtgccccttcaacttactagtcattggagaacagatgattgatgtcttagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggaacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccattatatgaagcaagcatttcttactttgtatctctctcctacagttagcaaacagaatttcacatagttcctacttgcctgtgaacccaacgtgtctttctcctatttcctttctcattcattccatgaacaaaatttaggtcttaagtccattgttgaggaccattgtattttaaagtcctccaaccttctccctatgtttctgccaagcgaacatgattattatcagataaaatcatttgtgctaatatcttctacttgatgtgtcatccttaggaaaggtaacaccttagcccggcaaacatgcattgaacttcttagaaaccttcttaaggaactgagtctagtggagatatctgtgagtgtatggttgatagaggaggtgttctttctcatcccgcgtgtgtatagcttacatacagatgacagcctactgtagttttgtattagaaatccttggcatgtacgaggtccccagttcactctccggcacctct

SEQ ID NO: 470019 - DNA, 1509 bp, Homo sapiens
ggcatcaccccatccctccttaccaccaccttccactttgcgtgatttggctgtgacatccgtgccagaaagatggcgtcagttaacggcagcagccagaactgtgtctcggttcaggagcggagccggccgggggtcctggccatgccctgcatcagtgaactcatttccaagagctgtgtgccgatggagttcgaggagtatttactgcttatgttccagcagactttctacctcctgcagaagatcaccaaggataacaatgcccacacagtgaagagcaggctagaagagctcgatgagagctttattgagaagtttactgactttctttggctctttgtacgaagatgccctggtgctcctccccacagaggtgttgaatcaaatccagttcagatacaaccaggccagctggaggagttggatgacgagactctggatgacgatcagcagatggagttgaacatcatggcagagaacgactgctggtggctgcactgctccctgagagacttgagctccctgctgcaggccatgggccacctggccgggtactttattggggatgtgtttgctgcatggttcaatgatgccctcacagttgtggagagtttggtcaaagtcactctgtatggatctcagataaagttgtacaacattgagccagtattgaaacctgacctcattgatgtacgtgctcagtccctggctgtgctgcaggcttacactcactggttagtgcagtattgcagtgaagctcaccagcagaacacacagcagttcgtgacactcatccctattaccatgaatgcaatcacacctctaatcagcaccaagttctcgaagcagcaaagcctaccgtctacaccttttatctaactctgtctctccttctgttcctatacccatttattagaaaatctaaatatgacacagagttagacccataaatctttccgctttataaaactgttatttcatcttcctttttacttgtagcccacatgcattcaaatacaactttacttttttggttatataagttccacatgctcactgtgaaaaaccaaaatattgttcagatttccagactaaaaagttgtgatacctttgaaacattttccttcaggcggtacacacagttgggcattggttgtgcaggcacacctcgttttgttgtgtttccctttatagcacttcgtagatactgtgttttttacaagttgaaggcttatggcaaccctgcattgagcaaatctgtcagcgccattttttcaacagcatttagtgcttccatgtgtcacattttggtaattattagaatatttcaaacttcttctatgactatatctgacagtaatttgtggttagtgatctttgatgttactattgtaattattttggggtgccacaaactgaagatggcaaacttgattgataaatgtgtgtgttctgactgctccactgattggcggcttccccaccttcctgtctttaggactccct

SEQ ID NO: 470020 - DNA, 816 bp, Homo sapiens
ccctcagaggctaacttgagacccacttagcataagacagggagtggacttaaactcaatggatgctaggtcccttggggtggcttgctgtacccccactaggtgttcagcagggggaagaagacacggaaatgtgggaaagtttggaacttcttagagacttgttgaatgactttacccaaaatgctgatagtgatatggataataaaatgcaggctgaggtggtctcagatggagataaggaacttgttgggaactggagcaaagattattcttgttatgttttagcaaagaaattaacagcattttgcctctgccctaaagatttgtggaactttgaacttgaaccccagaatggtagatccactgacagcttgcaccgtgcacctggaaaagctgcagaccctcaaggccagcccaggaaagcagcttggagagaggctgtatccttcaaagacacaggggtggagctgcctaagaccatgggaatccacctcttgcatcagtgtgacctggatgtgagacctgaagtcaaaggagatcattttgaagctttaaaatttgacagccctgctggatttcggacttgcatgggctctgtaactccttcgttttggcaaatttctcccatttggaatggctgtatttatccaatacctgtacccccattgtgtctaggaagtaacgagcttgcttttgattttacaggctcataggcagaagggactttccttgtcttagataagactttggactgtggacttttgggttaacgctgaaatgagttaagactttgggggactgttgggaaggcat

SEQ ID NO: 470021 - DNA, 2343 bp, Homo sapiens
tgtaaggacagagagagaaggatcatgtttttgttgttggacaggtgaaaaagacaatgagtcctgatgggaaccacagtagtgatccaacagagttcgtcctggcagggctcccaaatctcaacagcgcaagagtggaattattttctgtgtttcttcttgtctatctcctgaatctgacaggcaatgtgttgattgtgggggtggtaagggctgatactcgactacagacccctatgtacttctttctgggtaacctgtcctgcctagagatactgctcacttctgtcatcattccaaagatgctgagcaatttcctctcaaggcaacacactatttcctttgctgcatgtatcacccaattctatttctacttctttctcggggcctccgagttcttactgttggctgtcatgtctgcggatcgctacctggccatctgtcatcctctgcgctaccccttgctcatgagtggggctgtgtgctttcgtgtggccttggcctgctgggtggggggactcgtccctgtgcttggtcccacagtggctgtggccttgcttcctttctgtaagcagggtgctgtggtacagcacttcttctgcgacagtggcccactgctccgcctggcttgcaccaacaccaagaagctggaggagactgactttgtcctggcctccctcgtcattgtatcttccttgctgatcactgctgtgtcctacggcctcattgtgctggcagtcctgagcatcccctctgcttcaggccgtcagaaggccttctctacctgtacctcccacttgatagtggtgaccctcttctatggaagtgccatttttctctatgtgcggccatcgcagagtggttctgtggacactaactgggcagtgacagtaataacgacatttgtgacaccactgttgaatccattcatctatgccttacgtaatgagcaagtcaaggaagctttgaaggacatgtttaggaagtaattgccacatattatggcaataaagcatgttaaaccatccattttcaacatgtgtttcattgtgaaaaataactttgggctcaatttaattcaataaaatttgttgaatactgtgttctaggaagtaagttgattctggatatttgaatcctgtgttggatgcatagttcgtgaatattttctctcactctgtgggttgtcttttactctgctgattatttcttttgctatgcagaagctttttagtttaattaggtctcatttatttttgtttttgctgcatttgcttttgggttcttggtaatgaattatttgcctaagtcaatgtttagaagagtttttctgatgctatcttctagaatttttatgatttcaggtctttgatccatcttgagttgatttttgtataagatgagagatgagaatccaatatcattcctttacatatggcttgccaattatcccagcaccatttgttgaatagggcgtcctttccccacttatgtttttgtatgctttgtcaaagattagttgactgtaagtagttggttttttttctgggttctctattctgttacattggtctacatgttttgttttgttttactggtaccacgctgttttggtaactgtagccttgcagtatagtttgaagacaggtaatgtgatgcctccagatttgttctttacacttaactttgcttgggggctatgcaggctctttttttggattcatgtgaattttaggatttttttttctagttctgtgaagaatgacgatggtatttttatgggaattgtattgaatctgtagattgcttttggcagtatggtcattttcacaatgttgattctatccatccatgagcatgggatgtgttttcatttgtttttgtcatctatgatttctttcagcagtgttttgtaattttccttgtagagatctttcacctccttggttaagtatattgctaattattttattttttatttttgaagctgttgtaaacaggattgagttcctcatttgattctcagcttggtcgttgttgctgtatagcagtgctactgactgtgtacgttgtattgtatcctgaaactttcctgaattcaattgatgacatccaggagctttttggatgagtctttagggttttctaggtattcgatcatatcatcagcgaacagtgacagtttgacttcctcttttccaatttggatgccctttatttttttctcttgtctgattgctctggctagaacttccagtactatgttgaatagaaatggtgaaagtgggcatggcatccttgccttgttccaggaggaatgcttttaacttttccctgttcagt

SEQ ID NO: 470022 - DNA, 862 bp, Homo sapiens
tgctgtggccttgggaaaaaaagctccagatattttcctgtctggacctgcgggacccacaggagagaaatttgctaaaatcaatcagatgatgaccttaagtgcttcagatcttaacaggacctgcaattggataaactggggatatgagtcccatatcatgatgaagcaacacactatttcctttgctgcatgtatcacccaattctatttctacttctttctcggggcctccgagttcttactgttggctgtcatgtctgcggatcgctacctggccatctgtcatcctctgcgctaccccttgctcatgagtggggctgtgtgctttcgtgtggccttggcctgctgggtggggggactcgtccctgtgcttggtcccacagtggctgtggccttgcttcctttctgtaagcagggtgctgtggtacagcacttcttctgcgacagtggcccactgctccgcctggcttgcaccaacaccaagaagctggaggagactgactttgtcctggcctccctcgtcattgtatcttccttgctgatcactgctgtgtcctacggcctcattgtgctggcagtcctgagcatcccctctgcttcaggccgtcagaaggccttctctacctgtacctcccacttgatagtggtgaccctcttctatggaagtgccatttttctctatgtgcggccatcgcagagtggttctgtggacactaactgggcagtgacacttggtcgttgttgctgtatagcagtgctactgactgtgtacgttgtattgtatcctgaaactttcctgaattcaattgatgacatccaggagctttttggatgagtctttagggttttctaggtattc

SEQ ID NO: 470023 - DNA, 894 bp, Homo sapiens
tttttctaaagcccggaagcccccgctttgagttaaagggcagggccacagctgcctgaattctgcttttcacacgtgtactgtccatgttctctccagatcaagatgttgcagaggctccgcgttctttgtctgcaggaaaaatgatgagaactctcatcaccacacacccactgcccctgcttctattgccgcagcagctgctgcagctggtgcagtttcaagaggtggatacagattttgatttcccagaagaagataaaaaagaagaatttgaagagtgtttggaaaaattttttagtacagggcccgccagaccacctaccaaagaaaaagtcaaaagacgtgtccttattgaacctggaatgccactaaatcatatagagtactgtaaccatgaaatcatgggaaaaaatgtttactacaaacaccgttgggtggcagaacattacttccttcttatgcaatatgacgagctccaaaaaatctgttacaacagatttgtgccatgtaagaatggaattaggaaatgtaacaggagcaaaggtcttgtagaaggagtgtattgtaatttaacagaagcatttgaaataccagcgtgtaaatacgaatcactttataggaagggctacgtccttatcacttgttcatggcaaaatgaaatgcaaaaacgtattcctcatactataaatgatctcgtggagccacctgaacacagaagtttcctcaagctgagctcctaatttatcaataggttgatgtaagtaagggcctagaacgaaggacggctagactccattttagtgtctaagggaggaacacaggaaatcaagcttctaggcacttgtgatggttgattttctgtgtcaacttgactgggttaagggatgctca

SEQ ID NO: 470024 - DNA, 613 bp, Homo sapiens
tgaagactgacgctgcctgatcacctcagaagccctgtagaccatcatggatgccgagcttcaagtaactctcacagtggaggatacctctgctccctccttggtgaccgatcatgcaccccttaccatctcattaaaacctaatcacccttaccccattcaatgccaatatcccatcccacagcatgctttaaaaggattaaagcctgttatcacttgcctgctatggcatggccttttaaagcctataaactctccttacaattcccccattttacctgtcctaaaaccagacaagcctcacgaattagttcaggatctatgccttatcaaccaaattgttttggctatccaccccatggtgccaaacccatatactctcctatcctcaacacctccctccacaatccattattctgttctggatctcaaacatgctttccttactatttctttgtaccctgcatcccagcctgtctttgctttcacctggactgaccctgacacccatcaagctcagccaattacctaggctgtactgctgcaaagcttcacagacagcccccattacttcagtcaagcccaaatttcttcctcatctgttacctatttc

SEQ ID NO: 470025 - DNA, 727 bp, Homo sapiens
gcatatttgttaaattattgaatccttgagaaagcccaagctcagcaaggttaaaaaaacgtttctgccaaatgttgcttttctggccagaaatctctgtggccagtggtgcctttgcccaagttcttgtccggcatccaggaagaatgaggtatgcagacaagtggagggcaggtcatcccattgagcgtacagctctcagcagagaagagaccctggagctccggtgtgtgatgttcccctccctgtgtccatgtgttctcattgttcaactcccacttatgagtgagaacatgcggcgtttggttttctgttcctgtgttagtttgctgagaatggtcaccatcattttcagctgccaggtggactttatagcaaccttggataaatatgggccagaggagaaggcaaacagtaaccaattgacagccttggaagagtgctaatgaactagttggtattaagctggaaacctagtcaaaaactggaagtttgggctgaaaatctttcccttatgttttccttatgcatgctgtgattttagggtgggccttcccaggagaagggatcatgattaggagtggctatgtggacaagtagggaacagaaggtgcttagctggacaaaagggcttgtgaagtcatgagaatgagcctctgtcatcattgtcatcatcatcaatcatcatcatcaccacttaatcatagtggctgccattcatcaagct

SEQ ID NO: 470026 - DNA, 574 bp, Homo sapiens
ctgttttgattatggtcattcttgccagagtaagctggcatagcattttttggggtacgattgaagccatcactaaggtaatgagcatctcaccttctccttctcttcactctgttacagagaacagaccctcccagtcttcagtgcactctaaatacttgctaattctggccaatggaaggcatctgtggaagaaaaaagcctcagatcatgtgctatctgtctttattcagtgtgacatattaggctacagtgaggatttcttggtggagagcataccccgatcaccccttcacgctatatcgaatatcatgctagggtttctccaccttgctggaagtgacctgatatccagaagtttgatggctgaggagtataccattgtgcttgcgtccttcatttcctgcatttcttcctccatggatggacaggttgtctgttaggacttttatatttgaagtcttctatttcagtctttggttcatcttgagttaattttccatatgatgacaagcagggctgcagtgttaattgtcctgcacatggctagtcatgtatcccagcgccattcatc

SEQ ID NO: 470027 - DNA, 922 bp, Homo sapiens
gattgcctgcccagttcccttgccctttcatcctttccaaaggaaccctgagttccttcagtaacacacctctacccaggaagcccagagggatgtgtactccatgcctggctgaacttgatagtgattcctatagcagcagcacagacagcacccccatggggagcatcaagtcactctcttctctttcctcagaacaaaatagcactacaaagtcagctttctgccagcccagggagaaatctggagggattccttggattgcaacccaatcttccaatggacagaaaagccttggtctctggacaactaatcctgaatcaagttctagagaagatgcaaccaagacagatgcagaatcagattgccagagtgttgcttcggtcactagcccaggggatgtttccccacccatagacctagtcaagaaagggccttatgggctttcaggactgaaaagagcttctgcttcttctctcagatccatctctgcagctgaaggaaacattagctacagtggatctattcaaagcttaacttctgtaggttccaaggagacacccaaagcttcaaacccagacctgcctccaaaaatgtgcaggaggttaagactagacaccacctcaagcaatggctatcagcgtcctggctcagtagtggcagcaaaagctcaactgtttgaaaatgttggttcacctaagccagtttcttctgggcaccaagccaaagccatgtactcctataaaggagagcacagcgtgagctttccttcccacaaagagcgatattttccagtgtggacccatcagtggaaccaggatggttaaaggcagcttatgaaggcaaaacgggactagttgcagaaaattatgttgtcttcctctactactatttagtggatggcagtatcttcatggtatcc

SEQ ID NO: 470028 - DNA, 3932 bp, Homo sapiens
cagtaacctgtcttttgtggacattgcctattcctcggccacagcacccaagatgattgcagactttgtttctgagaaaaagactatttcctactggggctgtataactcagatgtttaccttccacttttttggttgtgctgagatttttgttttgactgtcatggcttttgatcgctatgctgctatctgccaacccctccgttacactgtcatcatgagtgctaatgcttgtactgtgctggcatcactgtcctggttgggggccctgggtcattcctttgttcagaccctcctgaccttccagctgcccttctgtaatgctcaggttatagaccattacttttgtgatgtccacccagtcctaaaacttgcctgtgctgatacaactctgataaatatgttggtagttgccaacagtggtctcatctccctgggttgtttcctcattcttttggcctcctacaaagtcattctgcttagtcttcaaaaacagtctgcagagagccgacgcaaagctctctctacctgtggatctcatctgactgtagtaactttcttctttgttccgtgtatctttatttatctccgtccatccactactttcccattggataaagctgtgtctgtgttctataccaccatcaccccaatgttgaacccactcatctatactctgaggaatgaggatgtaaagaatgccatgaggcagctatggagtagcaagatctccttgaaggaaaaacagagaggatagtttgtcagaattgcaaaatcagagaattagtggataccttcaatgatccctaatttattaataattaaaaaaatagttcctaaaaatgcagcttttataggttgtctaaacaggaaataatttgaggctattttagacaggctaaacttaaaactttccatacttggcaaggtttatcctctcttacttctagatcttttcctataaatattgcaaaatctagtcagggaaacagatttgcaaggagacaattataatacaatacaacaaatgcagacatagaaatatacacttcctacaatgaagggggtaatgtgtatatgtcataaggtttgagggaggtacatctcacacaggagtgcaaaaactcagtcatcacacttatgaaccacaaagggatcaaaagccacttttaagatgacagatgtatagtaggcataggagacaacagaaatggatgaaagcagaagatggaagccctccaggttcataaaacagaaaggaaagggtgaaaatttatattgtctaatatattgaagcatcttagttgtaaagattatctcatggtttttatttcttattctgttaatgtggtgtagcacatttgttgattgtgtatgttggataattcttacatcccaggaataaatcctactttgtcatgatgcaaaatctttttaatgtcctggtatatttggtttgccagtagtttgttgaggatttttggacctttgttcacaagggatattggcctataatctatttttcttgttggtgtccttatctgggtttggtatgaaggcaatgttggcattgtaaaatgagttttaaagtatcccctcctcttcaactttttggaaggattttagaaggataggtgttagttcttttcaaaatatttggtagaattcaactatgaagccatcaggtcctaggattttctttgataggagattttattattgattcaatctccttactcattactgttaagattttctatctcttcatgattcagtcttgcaggctgtatgtgtctaggaatttatccatttattctaggttatccaatcttttgacttgtaatggttcatagtattatcttataattctttatatttttgtagcatcagttgtaatgtctcctttttcattttggcttttatttatttaagtcttctattttttctcagtgtagatcaagtattgttgattttatttatatttccaaaaatcaatcttagtttcatgatcttttctactgtttctctagtctcactttcattgatttcttttctaatctttgttatttcctttttttctaactttgggcttagtttgttctttttttagttcattgagctgtaattttaggttgttaatttgagacctttcctctttttttgtaaacatttattactatacatttctcccttaaaactacttttgctgcatcccatacctttttgtatgtcatgtccattttcatttgtctcaagatatttttacatttaccttttgatttctttttttggcccattggttgttgtttaatttccatatgtacatgaattttccagttttcctgttattattgattttagttttacaccactatggtcagaaaatatatctgatatgatttcagtcttctgaaatttgttaagacttgtttgtggcttaacatacaatctgtccaggagaatattctgtgtaagcttgagaagaatgtgtgttctgctgttggattgaatattctgtgtatgtctattagattcatttagtctgaagtagttcaagacaatgttttcttaataatattctttctggatgatttatccattgttgaaaattggatattaaagttctctattaatattgcattgcagtctatctcttgctttagatttgttaatatttgctttatatatttaggtgctctgatgttgggtgtattcatatttataactgttctattatctcaatgaattgactttcttatcaatatctaatgaccttctttgtctcttgtgacagtatttaaagtctattttgtctgatacacatgtaactgctactgctcttttttgattttcattttcatggaatatttttgttttttacccctttacttttagtctgtgtgtgttattaaaggtgaagtgagtttcttgtaggcagcattaagttggattttatttttataaatcaattcagccactctttgtcttttgattaacaaaatttgcttatttatagttggtaagtaaagatttattattgtcaatttattaattgttttctggttgctttgtagatcctttatccctttattactcctttgttgttttcctttgtgatttgatcattttatttggtggtatgctttgattcttttctgtttatcttttgtgtatttactatagatttttaatttgtggttgccatgaggcttacataaatattcttattgtttaaccaattcatttaaagacgataacatcttaactttgattgctaaagaagctctgtacttttacttcccttctcttacattgtgcttttgatgttacagtttacattttttgtatgtcttaagaatttattatagctatagtcattttgcatacattcatcttataactttataatgatggtgtgattcacaccaccaccattatagtgtttgaatattctaaatttaaccatatatatactttaccagttagttttacatttttgtatgttttaatgttactaattagctgccttttatttaatcttaaaaatccccctttagcatttcttgtaaggcaagcaatagtgaagactcactcaactttttttgtttttctaaaaaagtctttatcttcttcatttctgaaggacagctttgctggcaaaatattgctggttggcagttttatttttcttccatcactttgaatatattatttcattctctcctgatcctcaaggttcctgctgagaaatccactgatagctttatttgggtccttttttatatgacatgattcttttctcttgctgcttacaagcttctctgtttttgatttttgccaggctgatgttaacgtatgtttgtggattctttttttggttgaattgactggagaactttaggcttcgtgcatgtggatgctcatttctttcc

SEQ ID NO: 470029 - DNA, 900 bp, Homo sapiens
tcaaagaatcctgtgtcacatccatgagggctcccctaaaatgctcatagacttctttgtggagaggaagataatttcctttggtggatgcattgcacagctcttcttcttacactttgttggggcttcggagatgttcttgctcacagtgatggcctatgaccgctatgctgctatctgccgacccctccactatgctaccatcatgaatcgacgtctctgctgtatcctggtggctctctcctggatggggggcttcattcattctataatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttcattgctctgttaatgtcctatgccttccttctggccttgctcaagaaacattcaggctcaggtgagaataccaacagggccatgtccacctgctattcccacattaccattgtggtgctaatgtttgggccatccatctacatttatgctcgcccatttgactcattttccctagataaagtggtgtctgtgtttcatactgtaatattccctttacttaatcccattatttacacattgagaaacaaggaagtaaaggcagccatgaggaaggtggtcaccaaatatattttgtgtgaagagaagtgaaagataaattatacattttatagtcctcctgaggatcattgtcctaaagcaggaagtatttgcagtaataatgctgcattcacttcctccgttcatttgtgttcttaaaattttactataatttttctctattaattcctctttatattgaaaaaata

SEQ ID NO: 470030 - DNA, 1074 bp, Homo sapiens
aagaaacgggtaatgccaattgccagggaaatggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttggctctgtggcttgggggttttgtccactccattatccaggtggtcctcatcctccgcttgcctttttgtggcccaaaccagctggacaacttcttctgtgatgtcccacaggtcatcaagctggcctgcaccgacacatttgtggtggagcttctgatggtcttcaacagtggcctgatgacactcctgtgctttctggggcttctggcctcctatgcagtcattctttgtcgcatacgagggtcttcttctgaggcaaaaaacaaggccatgtccacgtgcatcacccatatcattgttatattcttcatgtttggacctggcatcttcatctacacgcgccccttcagggctttcccagctgacaaggtggtttctctcttccacacagtgatttttcctttgttgaatcctgtcatttatacccttcgcaaccaggaagtgaaagcttccatgaaaaaggtctgagtaatattccattgtatacatgtactgcattaaaaaaaatctcttcatctgctgtcagacacgggttgattccatgtcttggttattgtgaatagtgcagcaataaatatgaggctacagatgtctctttcatatatc

SEQ ID NO: 470031 - DNA, 2504 bp, Homo sapiens
ggaaactgcttatcatctccgtatctctgacttcttattgtaagatagaattattattgtaattgctcggttgagtgcaaggtgatcagagccctcactacatcaggacaggacctgaggacctgagaggcttccttccatacggcatagtgtagggaaccaagttaaaatgcatcaagttaagattatattacaaatattttcagtatgaagactcatagcagaaagtgggaaatggaaacaaaccagaggacaccaaactgggaaaataaggaagaagtgaaagacttggacaactttttcaaagtccacttggcttttacagtggacctgccattctgtggtcccaatgaggtggatagcttcttttgtgaccttcccttggtgatagagctggcttgcatggatacatatgaaatggaaattatgaccctaacgaacagtggcctgatatcattgagctgtttcctggctttaattatttcctacaccatcattttgatcggtgtccgatgcaggtcctccagtgggtcatctaaggctctttctacattaactgcccacatcacagtggtcattcttttcttcgggccttgcatttatttctatatatggccttttagcagacttcctgtggacaaatttctttctgtgttctacactgtttgtactcccttgttgaaccccatcatctactctctgaggaatgaagatgttaaagcagccatgtggaagctgagaaaccgtcatgtgaactcctggaaaaactagggatcattacgaaggagcataatcctgaattagaatgaagaccctccagtgtatcatagtgtcatgccaaccatctttgccagacatatgggttattgagttacagaattggctttttgttttaagtgcaagggaattgcatcaagtcagtctctggttctatttaaatataatgttaactattttttcattgtttataattcaaaagtacaaattgtcttgaaaatatttagtaatattttaaaatattttataaagatttagagattccaatgtgcataaaatgttattcatgttactaagcttgtgattctcttcaattgaatacatcataaatttagacctgacaatcaaaatgtacagtcatactgaatttctgatatctttacccaatttattcataacattacaacatacattgacatagtagaaaaagtatcacattttacaacatggatttcaccttactgttatatatttttagcttttctttatcttatgtattattttagtaatttataatttggttattatatatttgtgtatttatagttttccctatttactattttattcctatttttttctgttttcctttagattatttgacataaatttttgctttttacaaaattttctaggtatttggtgccatcaacaacatatatatatatgtgtgtgtgtatatatatatataaaatatatataatatatataaaaaatatataatatatataaaaatatataatatatatttgtcagaagcctacttatttttaaagtagaataaattggctataatgaattccacattattcacagaaaatttcaaatatctttgaaactgtttgcaaatatggcagatgttgaatatttaagttcaaagaaaaagtaaagtatctaacgcatacaaatgtacagaatgacacaaatcatttgctactgaaaatccaaagtgaaatttgttctttcatatttgtttgaaaacagaagagagaaaagtaaaatttatgtacctctaatactagtgattaaaagcatctgttaagtattgtttcattttccagctaaaagttttcttatgtacttctccctgagatttgcattacgaaaagtccttgtaataggaagactaattgtattctataataacaatgagataaagaactacttaatggaaaatataaagcctgtgattgtcatcactctagattcctattttaattataagagttatgttagtggctatgtgtacagatattaactctgcatgctaaatcctagtggaagtaaaattttagatataggcacacagtcctgttaaatcatcatattatttagctggttttttatttttttgagcttcagattatttttggttaacttcatttgtacactgtcaaacataatgacctgttaaacttgactacctgttatattttttatatggtgccaaaacattttggacacacaataaacatgaaagcattgatgatatttttggtagtattattttctcctcactacagtggaagtgaaaaggtgttgaatgtatacttcaccaatgaggtcatttcactgctctaattctcatatgtaaaataaagttgttaaaaatagctattttgcaggaactatgtgacacaagaggatataatggaaataaaggcactttatgaagcatgaaacatacaaatagctttagtgttattacttttgaaaaggtaattctg

SEQ ID NO: 470032 - DNA, 534 bp, Homo sapiens
atttcagtagatggaacatacaatgggcttttataccgagacattccattgcccagggacgggcaggagacagatgccttcctcttgtctcaactgcaaagaggtgttccttcctcttatgctaatcctcctcagcacagacccttcatgggtgtcgggctgggggatggatctgttgttggtcaaaggctggcaagcctgtaccaatggctcagatgacagtggggcagctctttggctgccacagagaaaggctgaagccaaggctcctgcagaatccactgttggacagaggcaagcaaacccaccctggtggtccagagtgtatgtctgtgggagggtattcccaggctgtagcagagagaaggctatggtagtggttctgagaagtaattactgtgtcattttaacaatccaagtaagaaatggtgaaagcctgacctgaggctgtagaaagtgatgaggaggagggtatggttaaattatcagatggaattgtgaagatgagataacagaactgcatcactgatgaca

SEQ ID NO: 470033 - DNA, 2057 bp, Homo sapiens
cttctgacttaagttcttaagaccaggtttctgtaggcagagcaagagtgagaaattatggaaacacagaacctcacagtggtgacagaattcattcttcttggtctgacccagtctcaagatgctcaacttctggtctttgtgctagtcttaattttctaccttatcatcctccctggaaatttcctcatcattttcaccataaagtcagaccctgggctcacagcccccctctatttctttctgggcaacttggccttactggatgcatcctactccttcattgtggttcccaggatgttggtggacttcctctctgagaagaaggtaatctcctatagaagctgcatcactcagctctttttcttgcattttcttggagcgggagagatgttcctcctcgttgtgatggcctttgaccgctacatcgccatctgccggcctttacactattcaaccatcatgaaccctagagcctgctatgcattatcgttggttctgtggcttgggggctttatccattccattgtacaagtagcccttatcctgcacttgcctttctgtggcccaaaccagctcgataacttcttctgtgatgttccacaggtcatcaagctggcctgcaccaatacctttgtggtggagcttctgatggtctccaacagtggcctgctcagcctcctgtgcttcctgggccttctggcctcctatgcagtcatcctctgtcgtataagggagcactcctctgaaggaaagagcaaggctatttccacatgcaccacccatattatcattatatttctcatgtttggacctgctattttcatctacacttgccccttccaggctttcccagctgacaaggtagtttctcttttccatactgtcatctttcctttgatgaaccctgttatttatacgcttcgcaaccaggaggtgaaagcttccatgaggaagttgttaagtcaacatatgttttgctgaatagaagaaagagaaaagcaagaacggagaaagtccagttgaatttagctaaatcatttcctcattcatgcattgaatcagtcagtcatttagcaagtattataattattaagtacttcccattttcaggcactattccaggcatatgaatgagacaggtaagattccaggtctcctagatttatattcaaggggataaatacaggttattagatttattcaaggggataaatacagtttattaaatttgaaaaacaactatagtttcagaaagaaacagtgttctgtagcaagcagaaagtggtattatgctagagattagctggggaggtggtaattaccttacttttggttgttaagtgaggcctcaagtggtgtttagctgaaaccaatatgattcgaaagaaacaaccatgcaaatatctggggacagaaattctaggcaaaaaggctgactagtacaagaatccaaagatcttatgagcttgttatatttgatgaccataaaaaggaagagaacagctgtactatatttagtgaatgtgaaaatggcaaaaattgaagtcaaagaatttggtaggggcaaaattatgtagagcattttagtcaataagaagttcaatttattcagatttcaaaaggagattcttgaaagacaataagcaggagagtaactctttaatgtttcctatttgacttaagggaagatcctcaagattctgattacagaactatgagtagtaaaatatcattaagtggaaagtgcgtgctgctaagtattttttatttatgtcaacacttaaaaggtctagttactttttctaatttgatagagagagaaaattaaaactgttatattttatcagaaactgtgaaaagacaatttagctatatatttcaaagttttgcagagatttctgcttattcctaatgggtaatttttaaacattagataaaaacttgagttcacttacaaattatttcaccctgaatgcaatgatcaatagttatatgtaatacaagttattatttagataactaaaccactctgattatttgaataagcatatata

SEQ ID NO: 470034 - DNA, 998 bp, Homo sapiens
gattttaccatgttggccaggctaatcttgaactcctggcctcgggtgatctgcctgcctcggcctcccaaagtgctgggattacaggcgaatacaaaccgagcctgtgccttctcattgatacatctctttgccttatgtggactcaaaacctggagcctgacccagagaatcctaggatatataaaggtaactgttgaaactcccttttctcctttcctgaagtgctcaaaaggaacacttacagggctacataaaggacctcagtcacctccgggcacccagaccttccaattgtctcatccagcagagaaaggtcaacaggaagtggtcaataatcctagatccacagaaggacatttgggagatgttgacgataggaatcaagaaccagatgaaaccaagtacccagcaattgaccacaagattggtacagagacgtctggtcataatggttggatagcgtagaggccgacagatggcaagcatacttattttgatatttatcatattgttgtgtgttagaatggtgcattccttttattgctcagtagtattccatatgtatatactacaattgagttattgattcatcctctgagggacatttgggtggtttccaatctttggctactacaaataaaactgttatgtttgtgtacagaactctatgtcacttaaatacttttaaatttgttgacacctgttttatgacccagaatatggtctaacttgataaacttgaaaagaaggagtattccaatgtttatttgtgaaagtgttttataatgtcactaacttctaattggttcatagtgttcttcaggtcaactacaagtctgataaatttttgattaccacttctattaattaatgagggaggtatattgaagtgtttgattattttttttataatatgaggaagtttatcactacttgattctgtttataagaaagttaaacaaaggatgctaattagtaacattagcattaaagta

SEQ ID NO: 470035 - DNA, 632 bp, Homo sapiens
cggcctggcttttcctagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactgagatatctttgaaaaagaagccaaa

SEQ ID NO: 470036 - DNA, 967 bp, Homo sapiens
ttggactcgaaaggaatggtatcgaatggaatttattcgaatagaatggaatcgaatggaatgccatcgtatggaatagaatcgaaaggaaaagaatcgaatggaatggacaggaaagaaactgactggaatagaatggactcgaatgcattggattgcaatttatgtgatttgaatggaatggaaacgaacggaaagaatgcaatggaatggaacggaaaagaaaggaatggactcgtatggaatagaatcatttggaatggcatcgaatggaatggaatggaatggaatggagtgaaccaaaatgtaatggactccaatggaatggattctactacaatggacaagaaaggaatggtctcgaatggaatttattcaaatagaatggatgtgaatggaatgcaattgtatggaatggaatcgaatgaaatggactggaatggaatggacaggaatggaatggactccaatgtaatgaatggaatggagtgtaatggaatgctatcgaatggaatgcaatggaatgatatggacttgaagggaatggattggaatggaatggactcgactggaatggactggagtggaatggactcgaatggaatgctgtcaaatggagtgcaatcgattgcaatggaatcgaatggaatggaattgaacagaattgaaaggaaaagaatggaatggagtgtaatggaaaactatcgcatggaatggaatggaatggactcgacaggaatggactggagtggaatggactcgaatgcaatggaagtgaatggaatggactggaatggaatggactcgaatggaatggactggaacaagaatggtatcaaacggattggaatcgaatggaacggaatggaatggaatgcaatgaaatggaatggaaaggaatggactcgaatggaatggagtcgaatggaatggagacgaaaagaatggaatcaaaaagaatgaaatc

SEQ ID NO: 470037 - DNA, 814 bp, Homo sapiens
agcctgctcctctcagagttttgcactctggctcttccctctgcctgaaatggccttctcttgttacccgcgtggcctctatgaacaaggaggagaccttcctgctccttttgtgtctggaagaatccagcttatcctccaaggcttggaagagacaccacaggctcctcaccctgctctgtgcaccacccccgctttgtgtcctatggacctggatctcggcaagaggagaagtacttctagaagaaagcagaacactagaaggccttagtttcttctttgaaacatggtgctccatccctatctcaaaagcaagttctcagatgcctgtggtgggtgaagatgtggatgctgaggctgtctctggcctgctgtattcaacatctccaactacctttggagaagatgctggtctctcaggggtggctgtgaccagaagtcacacatggagtgattttgaaatggatccctggttttacagctccagagatgtgaaatgggtgaatgatggagctacactcatgtggctcttcaatggcacagtgaaaaaagcaagcaagatggagccagatagacctgggttcaatgccagcaatgatttaacctgtgacctgaggcagtaacttcccctctctgagcctcagtttcctcgaggattggaggggcccaatactactcaccacatggcattacttttaagacctaataggctaacaacaaggactttgcacatggtggccctgaacaaatatttgttttgacctggcttcctagcatcccaggaggggtgaccctctccaatccccacctccct

SEQ ID NO: 470038 - DNA, 503 bp, Homo sapiens
ggcctctgccgggcccagcctatgaagttgacgaatttgggtcaggtaggagaggctgcccaaggcccgggagcagcgacgtttgaacactcagcggcgttgcccaagccaattccccgcagcggcggcggctcccttcccccggagctctgcggggcccaccgccccagactcgcaactgtacgtcggagccgcagcttcgggcccggccactctcccgccctccagacgccagcagttgcgaggctgggacctcgaaccctgaacctggccccggggagcctcggtcctgaccgcggcgttcctgggacatttcttccagggctctttgccacgttctggaaactctattcatctgcatctttcatgcacagtctccatcaacaaggtgctagtctgtacttggccacacaatcctcattactgcactgaatcccagtattttcaagaaagtttacttttacatcaatcagaccccgatttaaaagcctctaatctttccc

SEQ ID NO: 470039 - DNA, 658 bp, Homo sapiens
agtgttctgtagtttgtttaggacggtgattatatatctgtgagaagcccagaagggctgcactgtggatggctagccagaggcattttgagtatgagctaaaagcaaataggcctagagcttctgatgaatatcttgtcaggtactactttgaaagcctgcatacggcttgcactaacaaacacaagcctctcagtgctcagcgagtgagtcatctcactatcaaagagactcgcccagacaagggaataagtgtggacacagacattggattggaggttattgggacatgtgaaaaggatggggcttcccaatgggagtatacggggagttatggtaggaagcccagtcctaaagcagacgccagtgctgcctccctgagccactgcccagcctcctggaaagcccagggcactgctgccagctggccctctctgagcctggctctgagagcaggccgactgtgcacgggttcagaggcatccatcacctggagaaggcacagaaggcctgctgcggtagggctggatttgagtccaggtaggtggagaggagaattacacattaggaaaccatgtgagctaaggcaggaacacacgaaatctcttccaggacagggaggagccctgttgtgagagcctgagaagggaagaaaaag

SEQ ID NO: 470040 - DNA, 1047 bp, Homo sapiens
gctgtttgcactctctggtttgctctctctctccctgccacgctctcctctttcttaatgtacctggcgaagatgacacaaaaggggcttgttcaccagtcagcaccctcagctgcaggtctgttgcagtttgctggaggtccactccagaccctgtttgcctgggtattagcagcggaggctgcagaacagcagatattggtgaacagcaaatgttgctgcctgatcgttcctctggaagttttgtctcagaggagtacgcggccatcctcctcaatggtgggtgcccctcctccaacttcgctgccaccttgcagtttgatttcagactgctatgctagcaatgagcgaggctccatgggcataataccctcagaggcatgcacaggatataatctcctggtgtgccgtttgctaagaccgttggaaaagcacagtattagggttggagtgacccgattttccaggtgccatgtgtcacccctttctttgactaggaaagggaattccctgatcccttgtgcttcccagataattcaaggatactgtgaacacctttatgcacacaaactagaaaatctagaggaaatggatacatttcggaaaacatacaaccatcctagattaaatcaggaagaaatagaagccctgaacagaccaatagcaagtagtgagactgaatcactaataaagaaaaattgccaacaaaaaagtccaggaccagatgaattcacagctgaattctacctgacattcaaaaaattggtaccaatcctgctgaaagtattctcaaagattgagaaagaagaatttctctctaaatcattctgtgaagccagcatcaccataataccaaaatcaagaaaggacataaaagaaaataatagatccatatcactgattaacatagatgcaaagatcttcaagaaaatactagataattgaatctaatagtgcatcaaaaagatagtacaatatgatcaagtgggttttatcccagggatgcaaggatggtttaacatacataagtcaataattttgatacat

SEQ ID NO: 470041 - DNA, 3681 bp, Homo sapiens
acatggctgccaccggggaatgtggtggcacctggtagcttggagactccaggagctgctaggccacagagagggagtcacagccctggcctggggagcttctaatcctgccatgtggcaggtcctgagttcttgccctgtgtccaggaagaatgaggtatgcagacaagtggaggccagttgtcctgatgtctgctcagctgtggctgagcccagggcatttatgggcctcagaggggaggaagtgcacaccaattggtccacaggcagccatgggctggcctggaaaacacaccacaagtttccattctggtctgtgggactcgaagcccagcctgcagccttcaggccctccctgggcagaaggaacctgtgtgtctcctgctacattcatggtgcccgtgctgtaggtgccaatgggcacctgcaggccagcatcaagctgccctcagtgcccccttggcttccctcctatgctcaacagtgcccaaagtctggagggggcctaggcagcaggtggctggtgtgtcagcactgccctgagtgtgtgcacacctggctgggctgtgatagtgtccgggcttggccctgacttttctctgagatcagtgcaggcactggcaacagggagaagccaggcagcaggataaggtacttccaagcctgcaagggcagggggagacttctggagtccccaagagtgcagggatgcctgggtccacaactgtggtttgggttgctgcagctctgcctggtggggtggggattctgcctgctccatgaagcaggaggccctggtcagcagccatgacttgggtggctgcggctgcacctggggagctccctttccatcaactcagaaggggcagggttcccatttgtccctggctcctgccagctccacggagtgtgcagccctggccacgcctccctgttgcagccagagtgatggcagcagctgctccagatgggcctctgctgccatcattaactttatatcatagcatttaaattactggatatcagggaaaggagtaaacatccaatgactttgctttcttttctggggaagaagttagtgcattttcagttgtgtgcaagacaattgtatcctaagaagatgcattcagatgccaggttgacaagaagtaaacttgtgacggttcattttatgtgtcaactttgaggatgtttttggatgagattatttaaaacaatttactgttggtaaagaagactgccctccataacatgggtgggtctcattgaattagttgaaggcctgcatgaaaaaaaaaaaagactggtctccccagcaaggtaaaatttttcagcagtctgcctttaaatctcatctgccccattggctcttctaggtctcaagcctactggcccacactacagatttgaatttcccagcctccattccataatttatgtaaatcagttccccataggaaatctctttctctctctttctctctctctctccccctctcctctccccgtccctctccttcctctcccttttcctctccctctgtccatttctgttggttctgcttctctggataactcactaatgcagcctattaatgtggtgaatcacattcattaccttcaaatattgagtcattcttatttaggataaattccacttcattatgatggatttttaaaaaatattgctgtatccaatttgctaatattttattgaggacttttgggtctatagtcataggagtattggtctgtggttttcttttcttgtgcttgtcttagttcagttttggtatgacagtaacattggcctactaaagaagttaagaagtgttctctccttttctattttctggatgggtttgttaagtatcactgttatttttcatttgaatgtgtggccaaattcacaatgaaaccatctggcttggagtttgcctttttggttttgtttttaatggcgagttcaaattttaaaaaatatataagactatttacacagtttatttcttcttgatttaattttggtagtttgtggcttttaagaaattggctcatcatctaaattattaaatttatgagcatagagttgttcatagtatccctttattatccttctgatgtatttaaaaggtgtcagatactatgaacaacaatcaggaataccttctttttccccctgatgtcggcaatttgtttctttcatctttttttcttggtcagtctggctataggtttatcaattttattgacttttttaaagaatcaaatttggttttattgattttatctgttgtttttacctcttaaatgtcgttgattcctgctctcatctttattatttctgccctcctagctttaggtttattttactcttttttctagctaattgaagtggaagcttaaattattgatttgagacctttcttcttttataatatatatttcatataccataacttttcctctaaacactgctttagctccatcccacaaatttttatatgttatattttcattttatttacttcaaaagattttttaatttcccttgagacttctttgttggcctatggattatttagaaatacattatttaattttcaaatatttgaagattttccagacattattctaatattgatttctagtttaattcctttatggccataaaccatacttgaataatttaaaaaaaattaaatttaacttaaaaaaattagaatatgatcttattttgtaaatgttctatatgtacttgaaaagaatgtgtattctgcttttgttgggtgaagtatctacacatatcaattaggttgagctggttgatggtgttcttcatgtcttttatatacttgctgattttccatctatttgtttgattactgagagaaatgcttaaatccacaactgtaactgtatatttgtctatttctcctttcagttctatttggttttactttatgtattttgaagccctgttgttaggaacatacacatttaggattgttatgtcttctttaaacctgtaatttttttagtatttaaaaataatcttatagaatgaggtgacattcaattgaaaaaaaagcacaatggattaaccctttttaaagaaaaactttatttttaatgtgtactctgaatttcctcattttttaaagcaaagagcctctggaaatcatattacattataggctgctgtgactaagttttgattaaatgttttttttctttcctaaatatctccctttgttacattagttaagtgtaggtcctcattttggttggtgtaattccaaaaaatcaagggtagggttttttcccttcaggccccaaagccacagtcaaaagtagtcagttgtctctctctccctatgcccctccttctgcatgggtttctgtgtgtgtttacttgtaaaacataccaactcccatggaaaaacgatcaaatctcaaaactaaaatacagaagctccgcttttacctatagccttgctgccagttattttcagacaagggttaggatgtatgttttccagagttccccaaagtgagccagtgtacagtgttggccctgacaagcacgggtgggaatgagggaaaataaagaaattttcgcccttgcgtcaggctctggaaagcaaaattcagaaaaaaggctgagaaaagctttcttcc

SEQ ID NO: 470042 - DNA, 3514 bp, Homo sapiens
ccctcctccatcatcgtaacccttacctccctccccaccctggcactgtgagtactacacccccatgactgacctccccaccctggcactgtgagtactatacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactatacccccatgactgacctgcccaccctggcactgtgagtactatacccccatgactgacctgcccaccctggcactgtgagtactacacccccatgactgacctgcccaccctggcactgtgagtactatacccccatgactgacctgcccaccctggcactgtgagtactatacccccatgactgacctgcccaccctggcactgtgagtactatacccccatgactgacctgcccaccctggcactgtgagtactacacccccatgactgacctgcccaccctggcactgtgagtactacacccccatgactgacctgcccaccctggcactgtgagtactatacccccatgactgacctgcccaccctggcactgtgagtactatacccccatgactgacctgcccaccctggcactgtgagtactatacccccatgactgacctgcccaccctggcactgtgagtactatacccccatgactgacctgcccaccctggcactgtgagtactatacccccatgactgacctgcccaccctggcactgtgagtactacacccccatgactgacctgcccaccctggcactgtgagtactacacccccatgactgacctgcccaccctggcactgtgagtactacacccccatgactgacctgcccaccctggcactgtgagtactatacccccatgactgacctgcccaccctggcactgtgagtactacacccccatgactgacctgcccaccctggcactgtgagtactacacccccatgactgacctgcccaccctggcactgtgagtactatacccccatgactgacctgcccaccctggcactgtgagtactacacccccatgactgacctgcccaccctggcactgtgagtactatacccccatgactgacctgcccaccctggcactgtgagtactacacccccatgactgacctgcccaccctggcactgtgagtactacacccccatgactgacctgcccaccctggcactgtgagtactatacccccatgactgacctgcccaccctggcactgtgagtactatacccccatgactgacctgcccaccctggcactgtgagtactatacccccatgactgaccctaatcttgaatggacgcagccatttgccttctccacatagctgttgttgccagagaaaatctcccaaccaggacgactggttctgcctccatccattagaacatgactcaggggcactcagcattgctcagggtcccgaatcccttccttggagttgacttttctgctctctgaggccatctcatgctgtctcctcccctggtccacccacagggctgccctcacctcctggtcctggggatcccgtgaaacactagaagtgaagggacctcccttcacttcctgcatcccatggaagcacgtctgagtcctgggaactgtgacctgctctcctaccccagccctcatctcgtggcatcctgcgcctgcccctctggcccttcccctctctcaccatagccttcagcctgtacactggatcatccttggacatgcagattccagcaccttctacctgaaaaaaccacaccctccgccccatttcttcatctcattctctgccctccttcacgacagagggtctccaaaatggctgtctacacgctgcctccatttccccacctccacgatccatacctcttcaactctctccagcctgactattgtcccctagctccgtggaagctcccttattagggccaccaatgtttccttgttcacaaatccagtagacacttttttctccctatcggcgttggtcacagtcataaagaacacaaggaaggcagaccctgccacccccagcatccccatggcgagggcctgccgggaggggtctgtctcccggggctgctcccgtggttcccagggtggcagcaactagattccatttttgcaacacccctcaagtcctctcaagggtcatgtgaagttcttgagataatatcaatttaaattcacctgaatgtttaaacatggttctttaaagcaggaagacagagaggtggaagaagctgaatggccgtgcccgcgggagcatggctggtcagacgccgggtctgaggagtaccgagccctctttggcttccgtctgcctctccagctggcagaatcctatcgtgcctgggctggcggcaccggcaggcacctgggcagggccggccaaggtgagagccaggccaccaggtgagcccaggccacgataccagcaggtgattcagacacggataaacagaccaggcgaggctccctgcccgggctccacagctgaaccagtacaggaacgcaggtctgtctgacagcgaggcttctgctccttcaaccaggccatgaggcttgctggccagccgtgggggacaggcaggagccaggaaccccaaaatgatcacaccgtaaactctagcatccagagattcctagtacaatgcggtcgaccaaatactccactgagattcgtatgtgaggccggctgcgggaaacgctgcccagggagggaggtccatgacaacagggcaggtaggggtggaggtggaggtggcggcaatggtggagatggtagagcttgtggtgatggtgcttgtggaggaggcggtgatgaccacggggttccgtccatttctgtggctgttgactcccaagtccgtgtttccagcccagaaccctcccctgagcctcagttcctacatggtagttcttcaggacatcctgtgtctgttctgcgatcaaactcagcatgtccaaatgagctattttttaacttccatcctggtctcaaacctaccatcattctacattctctatcatgatgaatccatgcagacac

SEQ ID NO: 470043 - DNA, 7045 bp, Homo sapiens
gtggaggagtcggcagagcaggcacagcggtgcgacgagatgctgcttctcagagctgctgtccaacctgcactcgcttgggaaccagaagacactcgtggaggcgtcggcagagcaggcagaccaaggagttcatcttctcagagctgctgtccaacctgtactcccgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactagcgtgggaacgagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcagagctgctgtccaacctgtactcgcgtgggaaagagaagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgcactcgcgtgggaacgagaagacactcgtggaggcgtcagcagagaaggcagaccaaggagttcatcttctcagagctgctgtccaaccttcactcgcgcgggaacgagaagacactcgtggaggcgtcggcagagcaggcagaccaaggagttcatcttctcagagctgctgtccaacctgtactcgcgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaacctgtactcgcgtgggaacgagcagacactcgtggaggcgtcggcagagcaggcagaccaaggagttcatcttctcagagctgctgtccaacctgcactcgcgtgggaatgagaagacactcgtgaaggcgtcggcagagaaggcagaccaaggagttcatcttctcagagctgctgtccaacctgcactcgcgtgggaacgagaagacactcgtggaggcgtcggcagagcaggcagaccaaggagttcatcttctcagagctgctgtccaaactgcactcgcgtgggaacgagaggacactcatggaggagtcggcagagcaggcacagaggtgtgacgagactcgcgtgggaagaagaagacactcctggaggagtcggcagagcaggccgaccaaggagttcatcttctcggagctgctgtccaacctgtactcggcgtcggaacctgcagacactcgtggaggcgtcggcagagcaggcagaccaaggagttcatcttctcagagctgctgtccaacctgtactcgcgtgggaacgagaagacactcgtggaggcgtcggcagagcaggccgaccaaggagttcatcttctgagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagaccaaggagttcatcttctcggagctgctgtccaacctgtactcgcgtcggaacctgcagacacttgtggaggagtcggcagagcaagcacagcggtgcgacgagatgctgcttctcagagctgctgtccaacctgcactagcgtgggaacgagaagacactcgtggaggcagctgctgtccaacctgcactcgcgtgggaacgagaagacactcgtggaggcgtcggcagagcaggcagaccaaggagttcatcttctcagagctgctgtccaacctgtactcgcgtgggaacgagaagacactcagctgctgtccaacctgcactcgcgtgggaacgagaagacactcgtggaggcgtcggcagagcaggcagaccaaggagttcatcttctcagagctgctgtccaaactgcactcgcgtgggaacgagaagacactcatggaggagtcggcagagcaggcacagcggtgtgacgagactcgcgtgggaagaagaagacactcctggaggagtcggcagagcaggccgaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcacgtgggaacgagaagacactcgtggaggcagctgctgtccaacctgcactcgcgtgggaacgagaagacactcgtggaggcgtcggcagagcaggcagaccaaggagttcatcttctcagagctgctgtccaaactgcactcgcgtgggaacgagaagacagtcatggaggagtcggcagagcaggcacagcggtgtgacgagactcgcgtgggaagaagaagacactcctggaggagtcggcagagcaggccgaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcttgggaacaagaagacactcgtggaggcgtcggcagagcaggcagaccaaggagttcatcttctcagagctgctgtccaacctgtactcgcgtgggaacgagaagacactcgtggaggcatcggcagagcaggcagaccaaggagttcatcttctcagagctgctgtccaacctgcactcgcgtgggaacgagaagacactcatggaggagtcggccgagcaggcacagcggcgtgacgagactcgcgtgggaagaagaagacactcctggaggagtcggcagagcaggcagatcaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactggcgtgggaacgagaagacactcgtggaggcagctgctgtccaacctgcactcgcgtgggaacgagaagacactcgtggaggcgtcggcagagcaggcagaccaaggagttcatcttctcagagctgctgtccaaactgcacttgcgtgggaacgagaagacactcatggaggagtcggcagagcaggcacagcggtgtgacgagactcgcgtgggaagaagaagacactcctggaggagtcggcagagcaggcagaccaaggagttcatcttctcggacctgctgtccaacctgtactcgcgtcggaacctgcagacacttgtggaggagtcggcagagcagtcacagcggtgcgacgagatgctgcttctcagagctgctgtccaacctgcactcgcgtgggaacaagaagacactcgtggaggcgtcggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagacactcatgcagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactcgcgtgggaacgagaagacactcagctgctgtccaacctgtactcccgtgggaacgagaagacactcgtggaggagtcggcagagcaggcacagcggtgtgacgagactcgcgtgggaagaagaagacactcctggaggagtcggcagagcaggcagaccaaggagttcatcttctcggagctgctgtccaacctgtactcgcgtcggaacttgcagacacttgtggaggagtcggcagagcaggcagaccaaggaagctgctgtccaacctgtactcgtgtgggaacgagaagacactcgtggaggcgtcggcagagcaggcagaccaaggagttcatcttctcagagctgctgtccaacctgcactcgcgtgggaacgagaagacactcatggagaccaaggagttcatcttctcggagctgctgtccaacctgtactcgcgtcggaacctgcagacacttgtggaggagtcggcagagcaggcacagcggtgcgacgagatgctgcttctcagagctgctgtccaacctgcactagcgtgggaacgagaagacactcgtggaggcgttggcagagcaggcagaccaaggagttcatcttctcagagctgctgtccaacctgtactcgcgtgggaacgagaagacactcgtggaggcgtcggcagagcaggcagaccaaggagttcatcttctcagagctgctgtccaacctgcactcgcgtgggaacgagaagaaactcatgagttggcagagccggcagaccaaggagttcatcttctcggagctgctgtccaacctgtactcgcgtcggaacctgcagatacttgtggaggagtcggcagagcaggcacagcggagtcggcagagcaggcacagcggcgtgacgagatgctgcttctcagagctgctgtccaacctgcactcgcgtgggaaccagaagacactcctggaggagtcggcagagcagggagaccaaggagttcatcttagagctgctgtccaacctgcactcgcgtgggaacgagaagacactcgtggaggcgtcggcagagcaggcagactaaggagttcatcttctcagaactgctatccaacctgtactcgcgtgggaacgagaagacactcctggaggcgtcggcagagcaggcagaccaaggagttcatcttctcagagctgctgtccaacctgcactcgcgtgggaacgagaagacactcgtggaggagtcggcagaggaggcacagcggcgtgacgagactcgcgtgggaagaagaagacactcctggaggagtcggcagagcaggcagaacaaggagttcatcttctcggagctgctgtccaacctgtactcgcgtgggaacgagaagacactcctggaggagtcagcagagcaggcagaccaaggagttcatcttctcagagctgctgtccaacctgcactcgccatcatcggcgacatcaacatgaacaccatcagcacagctacgggggcccgtggacgactcctagctgcagccctcacctttgtgacctgcaacccccaacaagctgaggctcccctcttagacttataagtctatagccagtggcatccagctgcctgtcctccctacctcccccagggtcccttcagagggtcctgggctttctgactgcccaaaaggggctccggcgatcactccagccatccatcccttttagcttcatcatcctggttcaagcagtgttccttctctatcaggactggtggctgttgcgttgggttcccaaaagcaagagatggccccgggccagtgggttcaaagacagggtgaccagagaagagggacactggagggggctgagcattgctctgaacggtgggtgcaccgccctgggtgccctgaaagaggccagcgtgtggggggtggggagggccgccagagcccccaggcactaactgtggagcattgctctgaacggtggctgcaccgccctgggtgccctgaaagatgccagcgtgtgtggggtggggagggccgctgcaacccccaggcactaactgtgaagctctgcctccctccttcttcctctcctttcctttccagccccactttcccaggagcctcgccatacccgcacctgtgccctccccacccctgccctcccacagctgctgtggcatgcctgtgctctgcacttgcctcatcagctctctgctcacttttctctctcctgcttctctctgcttgcttttctctctcctgcttctctctgctttctctccaactgccagctgattgggtccggcaagaccatcccatcctcagagccccagcccctccttcaacgtctaaacagatccctcctcttctcagtgacctccctttccaagcctgcctgagcggctgttctgtgacttga

SEQ ID NO: 470044 - DNA, 804 bp, Homo sapiens
agcgcttcctctgcaggctcatggagtatgttccgggctgtgagctcttcagctacctgcgcaaccgggggctcttctactctgcagagatcatctgtgccatcctgcactctaaggagatcatctacagggacttgaagccggagaacatcctgctggatagggacggacacatcaagctcacggactttgggttcgccaagaagctggtagacaggacttggaccctctgcggaatacccgagtacctggcccccgaagtcattcagagcgagggtcacggaagggctgtggactggtgggccctcagcatcctgatattcgagatgctctcgggatttcctccatttgtgtgtgtgtgtgtgtgtgtgtgtgtgtgtgtgtgtgtgtgtgacaacatgtttggcatttatcagaaaattcttgcagacaagatagatttccccagacatttggatttccatgtgaaagatctcattaagaaactgctcgtggttgacagaacaaggtggttaggaaatatgaagaacggggcgaatgatgtgaaacgccatcggtggttccgctctgtggactgggaagctgttcctcagagaaaactgaagcctcccatcgtgcccaagatagcccgcgaaggcgacacctccaacttcggaacttaccccgagaatgactgggacacagccgcgacccatcggccagcttgagaaataaagggacagagtacaaaagagagaaattttaaagctgagcgtccgggggagacatcacatgtcggttttactcatgagggaattagtgtgt

SEQ ID NO: 470045 - DNA, 743 bp, Homo sapiens
taggcttcacatttgagcggggtgaaaggcacccggtacccgctttgtaatgcacccctactgctcccgacaacacctctccactgtcatgcttaattgtctacatttcatttgtcagaggcacagaggcgagagagcagctcatggcaagggcccagaagctgcccactgttgtgtctggaatctagtgggaaagggcaaaaggaagtcctggagcagcaggttgcgagcaggccattgtgccaaggagtctggtcttgatcctataggtgacaattggatgaagatggaagcctcatgtcaggaaaccaattctgcagtggtctcctggcagaagatggttttaaaaatgcatgagcccattactgaaaaacagaacgtcttcgaagagaaaggcagaccgggaagccctgatgtgggcggtactgctgatgtttggtttgtgagagatacaggaatcaacttgttgaagctctctacttgtcagagcacctttaaataatccaagcccagagttgtttcatcttcaggcaagagaaagtgaaaatggcttcaaaggtacaatatctcaaataaacactataaaatgcatccacacttgcctttgaaattgtagtggttcaagcacacagagacaagcaacaatgtttatttcctgatactaatgagcttgtctgtctttgtctatgatgattgttcttagagacaaacaaataaaaatgcgaattatatctgactgttct

SEQ ID NO: 470046 - DNA, 567 bp, Homo sapiens
aaaaccagacaagccttacaagttagttcaggatctatgccttatcaaccacattgttttgcctatccaccccatggtgtcaaacccatatactctcctatcctcaatacctcactccataatccattattgtgttctggatctcaaacatgctttctttactattcctttgcacccttcatcccagcctcttttcactttcacttggactgaccctgacacccatcaggctcagcaaattacctgggctgtactgccccaaagcttcacagacagcccccattactttagtcaagcccaaatttcttccttacctgttacctatcttagcataattctcataaagacacacgtgctctccctgccgatagtgttcttagtattcagtgaaacctttatatcccttacagtcctcagtcttcaggaaagaattcaggcctgtccttggaatgctacaagtttttcaattcatacaaaactgtatccaggccatcaccaataattctaaatgacaaatgtttcttctaacaaccgcacaatatcaccccttaccacaaaatcttcctt

SEQ ID NO: 470047 - DNA, 562 bp, Homo sapiens
tcagagacagctcgaggagagggcatattccatagttcagagacagcataccgggtatggggctcttcagcccagctttggacattggtgtgcatcaactgtgggcattgggcctagagaaggctttggtgtcagagctgtggtgtagtcactctgagtgtccttgtctgctacagcagatcaaaatgcacaaaggcggcagtacagagcagaaatggctttgtacatttgaattagcgatgagaataactgtggagctgcagcatgttccagaggccagggtgtggacaagagatgagatgctggaactcatgaaagcccatgtgatgatgtggtgccctcctagttggattttagaggaagccacaggaagctctaggaaatcaagaatgaggggttctagtgcatttgtgagttgcctaacaaggaattccgcctctctactcttggctggtttgctcaccctggtggagcccaaggctcctttgcacgtggaagcacttcaagaaatggctgacctggctgtcaaggaagcactgtcctcttggtaatccagtggggg

SEQ ID NO: 470048 - DNA, 937 bp, Homo sapiens
atttgtcaactatcactgctaacaaagccaatggttggggcaaatcactccgtggtgtcagagtttgtgttcctgggactcaccaattcctgggagatccgacttctcctccttgtgttctcctccatgttttacatggccagtatgatgggaaactctctcattttgctcactgtgacttctgaccctcacttgcactcccccatgtattttctgttagccaacctctccttcattgacctgggtgtttcctctgtcacttctcccaaaatgatttatgacctgttcagaaagcacgaagtcatctcctttggaggctgcatcgctcaaatcttcttcatccacgtcattggcggtgtggagatggtgctgctcatagccatggcctttgacagatatgtggccatatgtaagcccctccagtacctgaccattatgagcccaagaatgtgcatgttcttcttagtggctgcctgggtgaccggccttatccactctgtagttcaattggtttttgtagtaaacttgcccttctgtggtcctaatgtatcggacagcttttactgtgaccttcctcggttcatcaaacttgcctgcacagacagctaccgactggagttcatggttacagccaacagtggattcatctctctgggctccttcttcatactgatcatttcctatgtggtcatcattctcactgttctgaaacactcttcagctggtttatccaaggctctgtccaccctttcagctcacgtcagtgtggtagttttgttctttggtcctttgatttttgtctatacgtggccatctccctccacacacctggataagtttctggccatctttgatgcagttctcactcctgttttaaatcctatcatctacacattcaggaattgagaaatgaaggtggcaatgagaaaagtatgcc

SEQ ID NO: 470049 - DNA, 566 bp, Homo sapiens
caaggtttgccaaagacacctgcagatctggatctccacctgaaaacgtccacccgaagacactcctgtgtgtccctgaggcgcaggcagggataacactgaaagggaagctgtgttggtcagctgctttccacttttgtcatggctccaattttgtcctcatcttgcaacagtttaggtgaactcaccagcacccacatgcccacctgcacatataagcacagcggagccagctccctctcctgtgactccacatccacagactctggctccaaaggggagtccccgtttgcacagccaatagtcctgtgggatggccaggtctggaaactctatcacaggcactctcatgggacaggaagactcagagaacatgacagctgccgccagttgcccggaaggcagcccatgatggtggatgagagagattctgtagcactccagaaggcaaagtataggccagatggccagcgttcagaacccacccagccccgtatacagtgtgagagcaggcagtgcggtgttctcacaccgttagccactggggcatcctcgttcgagtgatg

SEQ ID NO: 470050 - DNA, 459 bp, Homo sapiens
tgcagcaaacctgtcaagggatggagacatgtgcgtggtggtcctttcatcttccagatggacggcctatgaactctcagaggcgtctcctaagctgcgttgctccattacctttgtacaacataagaggttaaaaaacaattgtaaaaatggcttaaaaaagaagggctgtattttcagccattttttggtgttgacacattccaggccctcagttgggacctctggggaacgatgcagaaaggcaggggaaccagagtccagtggagcctctgcaagactgcagaagcagatgctggtgccacgcttgtacagccagcagaactgtgaaccaaataaacctcttttctttataaattacccagtctcagatattcctttacagcaatacaaacagactaatacatcaggcataccaagtaatagaaagaagcaagaaaacagacattagaaatggaa

SEQ ID NO: 470051 - DNA, 746 bp, Homo sapiens
ctagcacgttggattttgccagacttattatattggccatttccatggttcgtaagaaactattaaacaagaattaccttaatgagaacagcattgattacagcaaatatagcagtggcctttgcagggtggcctaccacacactgccatcttctcatctttgccctatggtcagtgagggtcagacccagagcacagccaagagaggggatcagagacaagtgtgctgagtgggcagcaggaagagattcagttcaccctctctaccagctctgcctccttcatttgggccgggctcctaacttctgcagccctggaaggccgtcgttctcacatcctccatctcctcttctttggttggccaagcatactatacactggctcctctactctctggcaacccataggctggatttcagagagcaaaaagcatggctttttgcaacaccagttggtctcacaagtaggcatgggaggcctggcattagtatttttttaaaaagaaggtttttagggcaaccccagtctgatcttttcccaagtagcactttggaataataaccagggcatctgcccaactgaaaggaacatagctaattattgtgaggctttaaaaacatcaagttaataaattaaatgaaaaagtgaaaaaaatatctagagaataaaccatctagaaaatactgtattcgaagcaatatttgaaaatgacctggctttgttcagtgtgattcaaagggatcatt

SEQ ID NO: 470052 - DNA, 997 bp, Homo sapiens
tcgggttacgtgcgcggcaggtccgcagagggtggggtagtctgtgcctgctcagcgctaagtcacatcagcaggatgtcttcaggacagtgctcagctagcagccagggtggcccctttctctgacttttctgtctcagcggctcttctagcacgcttgagagggcggcagagccccagcatttggcctttgctctgacttcatgccacggagagccaggtcttcttcctgaagcgtgcaaccccagactgacccttcaggagctcccagaccctatcacttgccaccggtttaccccaagccacatcttcccagacctggaataggagtttgtcccagataagtaatcaccatgttttctacaatcatagttgtgaggacccatgaggagcccctgccctcagaggggagccccacagtagctagggatgccggcactgagcagtcagtccctagcccgcatcctttggagagtttggattacagtggaaatctccttgggaacattggtactataagtccccgacagggacagctggccaagagcgagcccttccaaagagggcgacttcagcactgggaggaaggccgggaatggagtgggagctggcagggggtagggaaatggttcctcattatctccctggtccttttggtcctggccggctgccttccatggggactggggcatagtgggctgggcactggcatggggccaatcactgcgggagctggacacttccgggaggagctgcgaggagcctcagaggaagaaatgggagcaaactgatgtcaaaggtggggttgggagaaccaaagattttataagatgcaggacagggtgattgttttcctcttggctctagttttaagaggtttctttagatcagtgctttctgaagatgcattggatttgctatttccagccttttgagtgtgaaatatgtgtgagaagcctctttcatctaaatcatgaatttcagagtcccactaggc

SEQ ID NO: 470053 - DNA, 693 bp, Homo sapiens
tttattctaaacaacatttctgaaagcagcatatgggcacagcacactgtgctgaggtaccagtgtgggcgggctggagacaggggagtgacagacctggggcagaggcagacaagcctgaagaccacaggggcggtgaaatgtgggcagtctgctgctgtgaagtcttctgctggcagcccctaccatcctggttacctacctgggtcttccatcgtggctttgcgagcactgtgcctgctgtggtgggctggaccccacgggccaccttagatggtgccttctcaacagaggggctctcttccatgtctccgggccctccaggtctggtgtacaacaggtgctgaagatagaaaccaaccatacaccattagtgtagtggaagagagaaaagttacattgagggaagaaccattaaataaaaagaaaccaggacttgatcgtttgaaaaactctcagtccttccaggttgtaaacgacactaaaattgagagatttattgtcagaaaagcatgttctagagaaaaggctgacgagtggccctgcatccaacaggactgggtccttataccaaggggaagtgtggacacagagaccgatgtgcacagaggggtgatgattaaggccaccaggagtgcctcacctacaagccaggggcaaaagggagaggcccggggctaactctccctcaca

SEQ ID NO: 470054 - DNA, 682 bp, Homo sapiens
tccggggtcagctgtgcctcttttcttagtttctgtaaatagaattgtgccagaatacctaaatctgcatgaacagaccattgatagaaaaaatggacattaaaggtgctggtgttaagagctcagaaggaagtaaagaatatatattggaaattggaggagagatcttcttgcttctcactttttgggttcggatttccgttaaaagctgtaacactgggagagtctgcggcttcactcctaaatcaggaagaccacgaactcctcgagagaagcgaactctggacgtgacacttttaggagctatggatgcaaaaggacaatgcgttgacactccaagtcgacctggtggtggtcactgtgccctggcaggttttattactgaacgtggaatgagcccagcaaacctgaccacttggaaagccgccttaaggctggcatataaggaagctagatggaaacatgttagcagtggacaagacaccacagcagccgaggaatttgccagtgaaatcatctgggcctggtgatttcctttttaagagccttttaattacaaatttataggtttttcaaatttctatttcatgttgtttgatttttgggtaatttttgcgtttcaaagaactgactcacttccttaaagttgttgaatttatgaatgaaggttgttcatggcatt

SEQ ID NO: 470055 - DNA, 918 bp, Homo sapiens
tccatctctcgctgctctttctctcatgcttttggtttgggaagtcgggaagaagagtgagacggctcagtccaagctgctgcctgctttttgtggacacacaatgctggcatgttgtggggtcacttgtctgtgtcctgaggagccacggctgcaaggtgctccaggctcatttgtacatttcctgctccaggcctatggtcagccattttccaaggagccctggttccttttactggagaacgcgattagaaaccaaggtctgggcactagttatgctcattcctacttaggtgtcattgactctgagccttctcagctgacagaacaagggaatgctgtcaaccaaggtgagcttcttatgcaatgtctcatgtctgtgcccaagtcagaacgtactgccttcatcagaggacaatggggacctgctcgtgtaaatcccattgttggggatcaaggaggggttcctcagtgtcgagagcagctccagggaaaccacatcccacttaagtcagaggagagttggtgagggctgcagagcaagtgatgacaagcactttccacagtcagtccccgtccagagagatggctggctagaatcataatgctgattcaaggaggatatttagattttctcacttacttgatggaggactgaggtgaggactatgaatggtcagaatgtcacttattccatactaaagggcacattactctttttggatcagttaagcacccattgtagcttattctgtgaacatttaccctcctcgcttgattgaattctgcccttccatgcgctgggtcactactctgtggtctcactctggtaatgaagggggaatgcaacggaaactgccttttgggctctgtcatgcatctcatctcccttgggaaaatctgactttccttgattac

SEQ ID NO: 470056 - DNA, 1203 bp, Homo sapiens
ggagccagcagtggcacacaattctgctcctctttctcctcaagcctctcttctgcagggctgctgtggtttgctggaggtccactccagaccctattcacttgggtccttcccgcatctggagatgtcaccagtggaggctgcagaacagcaaaggtggctgcctgctccttcctctgggatctctgttccagagaggtgccggcctgatgccagtgggaatgctcctgtatatggtgtccggaaacccctggctcacccagtcaggaggcacgggatccgggactcgcttaaagaagcactctggctgtctcttggagagggggtgcactgtgctggagggaattccactcgtccggactggctgggttcctcagagccagcagggggaaaaactaagtctgctggtccttggagaccacggccacccctttccccaggagctcagtcccagggaggtcaaagttctgtccctaaacccctggttggagttgctgaaattcccgcatggaggccccgcccagtgaggagggatgggtcagggtcctgcctaaagaggcactctggccatgatctgccacagccgctgtgctggctgtggggaattcctcccgggtccataccatccagtctccctggtgctggcaggggaaaaacagctgactggagctgcagtgatggcagccgcccctccccaggtagctcagtgaccttaggcagcagcagatgcagaagcggtggtgatggccgcccctccccgggaagctcagtggtcttaggcagcagcagatgcagaaggagtgatggtggggccattgcaccaccgtgcttttcctcgctctctgtgggtcgcaccaactgcctagtcattcctggtgatagaatctggatacctcggttgccggtgcaggatttgcacactgtttttgttcttttccatgggaacctcgcatcgcagctgtttctagagccataagataaaaaaattatatattttttactttataaaacttaaagctacagtaggcaaaaaacaagataagtaaaattttaaagattaaacaacggagagaaatagtcgcaactcatctcagagagcgctccatccttagtgtgtaaagatcccctagaaatcaataagatgacaaaaatcccatgcggaattgatcaaagtatagacaattgaaggaaatataaatgacc

SEQ ID NO: 470057 - DNA, 555 bp, Homo sapiens
gaggtaaatgaggtaacaaataaagtttgtgagaggccattgttttgactatcctcctgcattaggccccctgcagaccagaccaaaccagaatggagtccactcatgctaagcgccacacaattaaactgaatttagaaatgggccagttttccaaaaaacaggagagtcccagcaacccatcaaaagactcccagtcaacaggagcaagcctgacaaggaatttcctctgctttaacccataccaggaaagccactttaaaatgaaaaatctgctttttcttccttgtttctgctttcttcgatcttttctgtctatgaagcccacccgctgtgctcagcttcgagaacccctttctgtttcatacaggagttgctgcctggtccatgaaaccactcataaaagccaattagatcttcaaagtcaatttgttgaaatgttatttgacaccaactacagtgactctagggaactttcccacatcctcatctatctggaacatgagaaagatgccagctttcactgatgttattcaacatagtactggaagtctt

SEQ ID NO: 470058 - DNA, 1704 bp, Homo sapiens
ttgtcaaagatcagttggctaatttagcatcggggtccattccaagatggccgaataggaacagctccaatctgcagctcccagcatgatcaacacagaagatgggtgatttctgcatttccaactgaggtatctggttcatctcattgggactggttggacagagggtgcagcccacagaaggtgatccaaagcagggaggtgcgttacctcacccgggaagcgcaaggggtcgggggatttccctttcctagccaagggaagccgtgacagactgtacctggaaaaatgggacactcctgcccaaatactgcgcttttcctatggtcttagcaactggcagactaggagattctctcctgtgcctgactccacaggtcccatgcccgaggagcctcgctcactgctagcacagcagtctgagattgacttgtgaggcagcagcctgacagggagaggggcatccaccatggctgaggcttgagtaggtaaacaaagtagccaggaagctcgaactgggtggagcccaccacagctcaacaaggcctactgcctctatagactccacctctgtgggcagggcagctgaacaaaaggcagcagaaacttctgcagacttaaacgtccctgtctgacagctctgaagacagcaatggttcccccagcacagcgtttgagctctgagaatggacagactgcctcttcaagtgggtccctgacccctgtgtggcctaactgggagacacctcccagtaggggctgacagacacctcatatgggtgggtgcccctctgagatgaagctcccagaggaaggatcaggcagcaatatttgctgttctgcaatatttgctcttctgcagcctccgctggtgatacccgagcaaacagtgtctggagttgacctccagcaaactccaacagacctgcagctgagtgacctgacggttagaaggaaaactaacaaacagaaaggaatagcatcaacatcaagaaaaaggacatccacaccaaaaccccatctgtaggtcaccaatatcaaagaccaaagataaacaaaaccacaaagatggggagaaaccagagcagaaaacctgaaaattctaaaaatcagagtgcctcttctccaaaggatcacagtcccttgccagcaacaggacaaagctggatagagaatgactgacaagttgtcagaagcagacttcagaaggtcagtaataacaaacttctccaagctaaaggagcatgttctaacccatcacaaggaagctaaaaaccttgaaaaaggggtagacgaatggctaactagaataaacagcgtagggaataacttaaatgacctgatggagctgaaaaccatggtacgagaagttcgtgatgcatgcacaagcttcaatagccaatttgatcaagtggaagaaaggatatcagtgattgaagatcaaattaatgaaataaagcgaaacgacaagtttagagaaaaaagagtaaaaggaaacaaagcctccaagaaatatgggaacaagcaaatgttgagagattttgtcaccaccaggcctgccttacaagagctcctgaaggaagcactaaacatggaaaggaacaaccggtaccagccactgcaaaaacatgccaaaccgtaaagaccatggatgctatgaagaaactgcaacaattaaagggcaaaataaccagctgacatcat

SEQ ID NO: 470059 - DNA, 480 bp, Homo sapiens
gctgtgaaaccaacatgcctgaaacatgttcctttcttgccattttgtgggtgaagagaaggagagaagagttgctgccttttggaaagcccagactggggagctcccagagccagggctgtggcttcctctttggggtctttggttcttggtgtctccaagcttccaggcaccaccacattccccagtgccagccagggaagctgcttacactgagcctgatccagctgcagtctcgtagaaagctggcacccacgccagcacctggatctgcctgctccatggcagcagccagcatgtctaactgcacagtggccggaccccatgctcgctcacacaccccttgccactccacacctgactcacagtctcccttggaggcttgggatccaggccggtacctgaagtgaattattattgcacatacctgggtattcttctgataggctagtgaggcttggctgataactaaaatggggg

SEQ ID NO: 470060 - DNA, 815 bp, Homo sapiens
acttgcatcttcagtaaggtgacatgctatgtcttcgagtagaggtggtgatcctgtttgcagacagctcagatgaacaggaaatgactgcccttcatatggcagaagacacaattgcctaccgcactaaaatgaaaaggttttatgcagggatcagaagggctcctctgctcagagctccaccccatctaagctggcttaatgttaagcttgttaaagagagggtctggagtgagcattcaaggccaaacagaaggaaggagttacccttcctgttcatggcctcggagccagcagagcagtgtgaaggaagctgggcactgctcagctcagtatcttgtgtgcacaagctctgccagtctgcaccctccagcaaatgtcttcactatccacggaccattgctatggaccagctcccatctgcagcctctgtcaaaatgaaagttcaaagtgaccaaaatacatcagaagctccccagaaagaaagaaattatatcctacacaaatacaatggagatttaaacgttctggagaatgagctgatggcttctgcctttattgtgtcatacagtaatggaccttgaccagcagaagatttgataagtataaaatattactgctcgatgctaatttggtccctttttaatgactgataatccttgtcgatttagtgtgattgtcacaatccagtactgtttcccaccccagctgtgactgtaacaggagccattaagtgtgtctgcataataaaattagtcagggaagctgtgtacgttctttccaggcttttgaatttccattatagtggtgaggct

SEQ ID NO: 470061 - DNA, 623 bp, Homo sapiens
ataacaaaagactgcaataagggctatggctatcagccagaaaccgtggacaaagaccggaagtagccattttaagagggtctggggaaacatccaagtaacagaagctgcaaagttgaagatgatcagtggagcatgtatggttatgtggagggacagagaaaggccagtgtggctgagtgtaaatggggaaggacagagaggagggcaaagagtggggcaggctgttacttggggcacagatatatgcgtttctgttgagtatatatctagaagtggaaataccgggtcgaagggtgtagcagacacgaactctaaccatatactcttggcctttacctcaacggtccggaagtggcttgctgaaaacacaggcatctctctgctgagagacttttatttagccattgttgaatatttggcccacacgagcccagaggaatactgttacaggtccaagttgtttcactcatagtttattttctttctattgatcttgaaaatgacatctaatacacaggtatgctttgtttaagcatttcttattttctcttctttcacagccctcttctttgtcttgaaatgttggaaaacagaacctaagtaattattacgtttaagtt

SEQ ID NO: 470062 - DNA, 540 bp, Homo sapiens
ggttttgaagtgggtgtaaattaatcccgaggagatagaaagtctgagtaaagaatccatacattctccctgaggactgatggagtttcactcttgttgcccaggctggagtgcaatggtgcgatctcggctcactgctcgctgcaacctccgcctcccgggttcaaacgattctcctgcctcagcctcccaagtagctgggattataggcatgagccaccatgcccggctaattttttgtattttagtgcagacagggtctgtcaccaaagcagtagaatgtgatagttcaattctcagcatctacagcagtgctgtccaacagatgtataacattagacacatagataattttgaaagttctcatagccacattttaaaaagtaaatatattattgaattaaggtcttactctttaacccacgatagagtgcagtggtgcaatcatggcttacggcagccttgaactctggggtcaagcaatcctcctgcctcacactctccagtagctggaactacaggtcagatttttatggaaat

SEQ ID NO: 470063 - DNA, 596 bp, Homo sapiens
ttctgtgtgttctggggtgccgatgagcagaagctggctgctctggagaaaattaggtctggagggcactcagtttccagtagggaagagaggaaagcttggttttccaaggggcgatggtattccacctagagggaaactggttttctctgtgccaaatagcagggcttcttatgtgaaggtcaaaaacacatttggcattttgaatttgtgtgtgtggatgcaaaatatgtgtgaggaaaagtgcataaataccccaacagctgccaccatcaggccaagaaataggagactgccagccccccggtgtatccttcccaaccacaaatccggcgtcccccagagacctattcaatgcttactattcaatgcctgctgcttactcttccggcattgttcaaggaatacagcaatgaacaaaacagaaaaaaattccagctcttaggtggcttataaatctggtgggagtacacaaacagtaaccaagataaataaataaaatataaatgtcagatggtagtaagtgctatggagaaacataaatcaggtgactagttcttgcatcaaagttacgcctgaagaccagttacctgatc

SEQ ID NO: 470064 - DNA, 1024 bp, Homo sapiens
ctgacagcagtctgctggttctcttggctaactcagccctggtaataccttactggtcatggaactgtggtgtggaagggacaggaactgccccagacctctcatgattttaaagttgttccctgaactcccaccctcaacagctgctggttgtgccgagctaaacatgttaccctatgggaagagtgtgtcttcctctgtaacagtgcctaccgctggaggtcatcgtcaagcccaagaacacaacacatatctcatttccaaactcaattcttccctgaatgacatggggggactttgtaaacaggttgagtttgaaaccttttctgctacttcccttcatgaggaactatctatagattaccgaagagtagagctcctagtgaacacttccttccctggagtaagtcctgggaagcacaaacgtttcagtgccgaaagacgtaaagacaggcacaaagaggaacatgggatgcttgaggatcatccaaatttcaacctacaccattatgacagtgactatcgtggactagctgcctgagttacaacactgttcacgattttgccattaacaagaaattctaaacctctatatctcagggggtcacgtctccttcggtgggaaacgagcaagattcatttcctttccccattaccaaatggggaaatttctgatggaaacaaaagacatctaagatatgttttttcaacttacattgggaattatattttttactttgttttttatgtgtacatagtaggcgtatgtatttatggggtatgtaagatattttgttacaggcatacaatgcataatcatatcagggtaagtggggtatccgtcacctcaagcatttatcatttattgtgttataaacattctaattatacttttggttactttaacatgtacgataagttattgttgactgtaatcaccctgttgtgctatcaaatgctagatcttattccttctatctaactatgtttttatatccattaaccatcctcaccttctcccttc

SEQ ID NO: 470065 - DNA, 918 bp, Homo sapiens
agggggtttaaaatccactgattcagagtgactcgcagagacaatgaatagtacagacaatggaaaaggggtgtcagaaaagaagaaggaggaggaggaggaggagaagaagcagcagcagaagcgggagaaggagaagcagaagcagaagaagcagaatcagaagaagcagaagaagaagaagaagaagaagaagcaggagcagcagcagaaaaagcagaaaaagaattcccactataaaacagcagatatctcatctctggggcttgcagtggccactgtgggggatggggatgtggttctcaggccaatggagttatgctcctatggggattgtggctgcctctgctgcatcacacaggttgccagggaagtgatggaaagccagcagcgacaggcctcaatcaaagcccacacagacagaaaggccagtctcactcccactgtgttctccaacagcactgagtttatatccaggcagctggtgagcaggcctgagatcttgacccaggcttcaagcctcctcattgagaaagcaagcacggctttcaggcttcgcccttccccaccactgcttctgcgcttgtatctgcacttcccattcagcccccaacttccagattctgccctggaaaattcacacatggtcaaaattattacaaatttcagctggaagtttccttctctctgtggtctttccccagttccactgacaaccctccccaagggtcccagtgagataaagtcagaaatggattccctgggcttccttaggggctgggagtgccaaaggcctgagagcccctggcaaaccactggtgtaagtccaagagtccaaaagctgaagaatttggagtctgatgttcaaggtcacggagcatccagcatggcagaaaaatgaaggccagaagactcaac

SEQ ID NO: 470066 - DNA, 987 bp, Homo sapiens
tggcttccagccaaagcactaatcatgatcgcctctgaagtggttccaatcgtctggatgaggcggctcctgctcttatgttgtttaattcccacgtgttgtgggaggggcctagagggaggtagtcgaatcatgcgggccagtctttccagtgctattctcatgatagtgaataagtctcacgagatccgatgggtttatcaggggtttccgcttttcctttgctctcattttctcttgccactgccatgtaagaagtgcctttcacctcccgccatggatctgagtcctcccaagccatgtggaactcttggttctgtgggtgtcctgattgatggtgtcctagctggactactggactttcctagatttgacttcagcaccaccttaaggccacactgtcctcgacacttttttaccttaggtttttgggaacaggtggtgtcggtcacataaacaaattcttttgtggtgatttctgagattttggtgcacccatcacctgagcagtatagtgtataagcattcttgaggaagttttaaagaaagataatttattaattccttgttagttatatttgaaaatgttttctccttatctttatcttatgtttttatctcctggtatttttttgctatgcaaaatttaaaatttagtatagtcaaatttatggatcactttttcttaataatttctgcttgttgaatcttgtttaagaaatgtttctataccccaaggccatgttggatgttaattatagtgtgaggtatatggaggctttttgtactatctttgtaatttttctgtaaatctaaaacttttaaaatgaaaaagtttatttaaaaattactgtgattagtatgttaaagaacagatattaaaattgaaaattttaccagaaaatgagaatttataaaacataattaagtggaaattataaaaataaaaatatagtaagtgaaattaaaagcttcatatatggattt

SEQ ID NO: 470067 - DNA, 836 bp, Homo sapiens
agaagccatctcacagcaggaaactcaacctggtagaggaagagggctgatgcacggtgttaggcactgatgctgaggaccactcgagtacctggtggaccgagtctgaagagagctggcttcttccttatgcaagaccccagcctcttccactggcccactctgtccactttcattattattgacagggagaccagacccttgaaaaccctcgtggatgtgactttggaaaacagcaacattaaggatcaaatcagaaatctgcagcagacgtatgaagcatccatggacaagctgagggaaaagcagaggcagttggaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggtttttctgcagcgtaaagaagcaaggtgagccggcagcatagcagggtggtctgggggagatgccgtcatacagagaatccacaggtagtggtcatgaacataggctttagaatcagacagtctggggatttgaatcttgtgtctctttgtagttgtttgcacttacttggtttttcctaactcagtctccacttctgtaaaatgctgataatggtacttcttattcttagggcttttgtgagcaataaatgagaaaaa

SEQ ID NO: 470068 - DNA, 752 bp, Homo sapiens
tgctgcgacgtgccacccacatcctcctcacccagctgcagggagtgatggaggatgccgatggcccacaggaattgccctcgactggagtaagctgcctccccaatcttaggtcccttcctcagggcaagcctgaatccagggactggttaacagtcctgccatcctcactccaggacagggagtctcctaagagtactccccaaaaaccctactgcacacaagtccccacctcagagtctgtgttccagggaacacaagcaaagacaggcatggagacacatagcacattctggaaagtcgaaatcatcagatccagctgcttccctccaatcgagatgaagataaatgcggaagccacagaagtcactctcagggcagctcaccctctttctgcacccgttcagagttaatgcggccataggctggggaaaattgcttctcctaatcccactcctgggttagttgggcccctcctttctctgaatagagggtcaccagttctgtagactccagaggactgctgactgggcagaagttctcagcttttgattcctcttttgaaaagagtccatctttttttaaaaatcatcttctctcagaaatattaatggaaaccagtgactgtgacttcattttttactttttcctctccactctagatccacttttccattgatttcagtcctacttgtcttcccattttccttctttcccactttctgggctccccactctcctctctcttgcag

SEQ ID NO: 470069 - DNA, 697 bp, Homo sapiens
caagacgcagcctagggcataagacaatatgaggggtgggctcctcccttatacatgtgaatcaaatgttacacgattccttggaatggatttcagctctctactgaatctcaatgatcttcattgccatccagattctgaattctatgtctgtcatttcagccatttcattctggttaagaactattgctggggagctagcgcagtcatttggagcttgggggcagcaggggcaggaaccttggcagtggcaatggtagagggcctttcactcgtctcttgggtctctgccccagagaaacgcagggccactgccaatcagaacaatcagcccaagagaaatgcagagctgcaacggattgaagtgatcaggcagggcctgggaagctgtgctgggggcccagagggaaggcaccagaatgaacaaagggaagacacagaagctaggctgaagcaggaggaagctgggagccctgcatggggctactatgcaccaggactcattcctggccctcagaaactctgagggaacagcgagatacacatatttttattttttcctattaaatttgaaatgtcacgcattcaaattttatcttgagatttcatcttatcacttcttacctataatgtcaagctttcatcagttgacacattattttattcagcctctttttatgtaacagactcaaggcaa

SEQ ID NO: 470070 - DNA, 715 bp, Homo sapiens
gcagaagcatcctaagaagggtgatttgggcatccttgtcatggccctggggacagcatgacagaccacctgtgtacaggctctccttcaacgcccgtagaaaaccacagcagctgcagcaaggccgagtcaggaccctcagctgcaggtctgttggagtttgctggaggtccactccagaccctgtttgcctggatatcagcagcagaggctgcagaacagcgaatattgctgaacagcaaatgttgctgcctgatcgttcctctggaagctttgtctcagaggggtacctggccgtcctcgctgccaccttgcggatggatctcagactgctgtgctagcaatgagcgaggttccatgggcgtgggaccctctgagccaggcgctggatataatctcctggtgtgccatttgctaagactgttggaaaagctcagtattagggtgggagtgactcgattttccaggtgctatccatcaccaattcccttggctaggaaagggaattccttgaccccttgcacttcccgggcccctcttctgcaggtctgctggagtttgctggaggtccactccagaccctctttgcctgagtatcaccagcggagactgcagaacagtaaagattgctgcctgcaccttcctctggaagcttcatcccagaggggtacctgccaggatgccagctggagatctcctgtatgaggtgtctgtc

SEQ ID NO: 470071 - DNA, 1222 bp, Homo sapiens
tatccagcgagggagctgagactatctttcctgacagctggtaatgaggcctccccgcaatattggtggaaatcatatgaggagcctggacttccaactcactcagcagcaaggaaacatacttcccttcctggtggggaggtgtcagaggaggcctggcagagaatcaagactttcgccaacacccaccagtaatgagatcaccctcacgaaggtgtcagtgcagaccacatggagagctagaactctcactcccgtccagcagttacaaaaagtcccctaccttgggtgtcaacagaggccaggtggtggaactgtgagaagagggccaccgtcctacagaccccagaatgttagatccactgacagcttgaaccacgtgcctgcaaaagccacagacacccaacaccagcctgtgaaagccgccaggatgtctgtaccctgcaaagccacagagagattaaactccaggtctgagagccagataacagccctcctcaagataaccagtcaagtttggcactgcaggccctgagccattttggtccaccctgctttgaccccaccccttgtccacatcagctcctgtgaagccaccccagaagaaaaccactattcgttcacattggctgattgatgctccatacgtccaaaccttccagtcctcaagaaacaagtatggctgagttctgggtaaaagtggagaacatgaccctctcctcactctgtgccatgttttatataagaaataaattaaaagtatataaaaacacatgtgcatatgtttacatatatgtatatatacatatattaatgttatataaatacaatatatatctcatttttacgaaaagaaactaacaaaaataagggtaagtttggaagagatagaaatgagaatatttctgactatatttttatacggtttttacttttgaaacatgtaaatgttttacatattcaaaaaaataaaattaaaaaagaaaaatgcactcccttaaacaaaatacaagtagaaacaaatgatccaaattatatttcagtttgataaaatatccacccagaggaaatagttactttgaataacatataaatgcaatcagtaggtttattattgctagtagaaatactggaattgtaattttaaaactgttttaaatacattttaggtaaagaaaataagtgtgtattaatgttattagaaaccgagattttcaacatt

SEQ ID NO: 470072 - DNA, 2421 bp, Homo sapiens
aaaatcaaggtgccagcggatttggtgtctagcagctcggataacctactccttgctagaaaaccaggcatgggtccggcagaggataccgaggatctgccactgaataccattcctaatgctggtatggactcaagtgctgacatggacccagtctgcaggggagagactggaaagtcttatcaccttgggacactgctccccacattctggctgctccagctccagccatggctcaaagggtctcaggtacagcttaggccatacctccacagggtgcaagccataagccttggcagcttccatgtggtggaacattcaggaacaggagatgaggactcatgggagattataatagaggaactggtgaactccaggcctcaaggaatggggaaatttcttgaggggcacctattgttttggggtgtggtgtcacatgatgattttcagattattgcattctggaaactgactgaacccacccagaactgtgactcatggctcaactggtcctgtggcccctacccagaggtagactcagtgcatgaggagtgttttccatacccctgtgatttcatccccaatcaaccagcaggacccattccctagcccactgcccaccaaattattcataaaaaccctagcctctgagttcttggagataactgatttgagcgataactccagttcttcagtgtcgcaagccttgcatcaattagactttttctctgctgcaataccacagtctcagtgagctggtttttgtctgtgcagtgtgcaggaattacctgtcaggcaattatagtacctttttatgtggcctttgctactacttgttcccatttgaaaataatttcatacaacacttatttgaatacatttcttatcatttgattaggatttgatgctatataataaaaattatttttaaagtcttccaatttttcattttcctttctggagatcagagaatggacttgatcttacttttcttttgaaagtcttagaatatggctgtccagatcatgtatattcttgacttggctaaattccccttttctagttattgcaaaatccaagtttatgtgcttctcataaggttttaacattttcatctagccaactctttattccccattagagaagtagtttcgcagggtattttctgtagtttcagagagaaatacattttggagagaaagtttagaatttctcaggtgggatttgcccaaatgagatgtcctgattgttgatctcttagatcacatgtataaattgtacttataaggtttatatctgtatcaaagtttaataaatcatatatttttttagtctggcatattgcttgttaatcaaatatcttcttagtctgggatgttgtctgttgcacagttttgcaataattcactcctctcaccccctccattttttctaaagccaaatattctgtgccatcctttcattcttcaatttatatgtatttcttggctacagaagataagtagagtagtatttatagaagctatgtttgtgatgacaaaaattggaaacaatctaattgtccataagggagataatggataactaaattatggtatacccataaaatagtatactatcgggcagtgaataaagcttgtaaatattaagttgaccaaagaaatgaagttgcaggacaatacatatggcatcatatcataaatacggactttaacaacatgctaaataatatatttgtacacatcatttagctcccacttctatccattgatggacaattaggttgattccatatgtaaaccaaaaaatatctgagacagatctaaatcaatttagaagtttattttgccaaggttaagggtgcatttgggtgacaagtctttgcctttatccaaagatgcttttgagggcttcaatatttaaaaggaaaaagcaggctggaggggaaagagggaggatatagtcatattaccaaattaatacattgcaagagaaaatgagcaggtacgggaagagtcaatcatgttttcagctcttgctcagtaaattggcacttttcataaggatcgggggagggagggactaagtataaagggacatgagggaatacttttggtgaaggaaatgttctgtatcttgattgtggtgattgttatgactgttcgtcaaaattagtatacactttaagaaaggaagttatattctggtggatgtacccagaagggacaggagtgtttccaagcagagacattcaagttaaggcctaaaagggaaactaggctaacaccctagaaaatgttctgaaaataaaacaaaaccagtcattttaaacatttacagagtctttatgctaagaaagactaagattttccaacttatgaacttcgctcttacactaactgaagccccattcaacttgat

SEQ ID NO: 470073 - DNA, 714 bp, Homo sapiens
ttgtaagcagcattttcttttttcaatttccccatggctttgtttacactgtgaggggagaactgcctactcaagcctctgtaatggcggacacggggtgtcccccaccaagcttgagcgtcgcaggtcaacttcagactgctgtgctggcagcgagaatttcaagccagtggatcttagtttgctgggctccatgggggcgggaatcttccctagcctttgtcttgaagctggccgtaaagaaattctctggcctaacttgtctgcttccacatttatgcatggttgtcaatcatgcctatcaaacgaagtccatagctatagaaagcccaagaggacaagatcctaaaagcttccagatagctgaacacctgaggttcttggaggagcagcctggaaacaaagtgacctgcaatggcttgagaggttctttctggaaagaagctattaaaaggagcctgaggcagagacacatgtcctcatatcctagagtccattcctcttagtgttactgactttcagggcatgcgtgttgctcactttcacagtcaatgtgaaagggaacacacagacaagccttgatcttcacggaacttaggaaatgcgaagcccttttcacacgcacagctgtgttcccagtgtgtcaatactggattagctatcagcccctactgaacgttatctaaccacaggatgtaaagtaaatttcatttt

SEQ ID NO: 470074 - DNA, 1028 bp, Homo sapiens
aggaaaaccagagacctttgggacaaagagcgaaaactagttcacactcaagatctatctcccgccaaaaatcaccttctggggatgcctgagtcctatacagattcagtccaatgttcacatcccatatccatatttacaatccctatacagaggatagcgctgagttctgtgcttcacagtcgctgtattctccctaccctggtgcccagagatgttctctgcgccaagcagctgcttctaggagtgggcatccctggtcatactccactgaacacattcctgtaccaaacactctgggcactgcagaggctggagtcctacacctccctgcaagctcaagtgtccatgggtgtcatgggatctattgctgccatgattccagaggtccatagcaagaataagtcattccttgactgtgaaattcaccccttgccagtagtcattggggaccacgaaggaatcctgtcaggacactcagctacaagtctgttggagtttgctggaggtcagcttcagtccatgtttgcctgggtgtcatcagcggaggctgcagaacagcaaatattgcagaatggcaaatgttgctccctgatccttcctctggaaggttcatctcagaggggcacctggctgtatgaggtgtcagatggcccctactgggaggtgtctcctaccacactggcagtggattggattgtgggtccattgtggatagatgtggacccatccacagtgcagtcttggaggtggggcctgatgggaggtgattggattattggggcatagccctcatgaattggcttcgtgacatctccttagtgccttgatagtaagcttcctgagtcctcattagaaggtgagcagatgccggtgccatgctttctgtacagcctgcagaactgtgaaccaataaaaccacttttctttataaattacccacccttgaatactgcattgtgtgattcaagagcagtctaacatacttataatgttgccaggatccttagggtgtcacttttgcagcc

SEQ ID NO: 470075 - DNA, 545 bp, Homo sapiens
gcaacaaatgataacaggaatgatggtgacgataaagaagcaatgtagatatctatctcttcaacatactgatttcaattcctttggctatacacccagaagtgggattgctggatcatataatagctccattttcagttttctgagacacttccatactgttttccaaagtgcctgtactaatttacagtaccaccaacagcatgtatgggtccacttttatccacattttcaccggtactttttatattatatctttttgattatagccaatctaatagttaattcggctgtgaatccatctggtcctggactctttttggttggtaagctgttgattattgccacaatttcagatcctgttattggtctattcagagattcatcttattcctggtttagtcttgggagagtggttgggaaggattatgaatcagaactctggcttccctgaaaaaaaaaaaccagcatctaggaagctgatgattagctacacagttttctcttatatgcattcatacctggcaagcaactggaggtgagga

SEQ ID NO: 470076 - DNA, 802 bp, Homo sapiens
gatgataagagatttaggttatttccagtttgaggagttagaatggctataatttttaaaagacaaaaaatatcagatgctggcaaggacagtaagaaacaggatattcctcgtgaagatcagggaccaaccaccaagaatttggatttttggccccaacttattacactgatggttactattattgatgaggataaaactgcctacacacctgtcctgaatcagggatgcaacagtgaacaagatagccctggtccccaccctcatcaagattgcagaggaggactacaagaatgcaaacagttgcaatgtggagtggtgaggacttatgatgacggagtgtctggagaagcacctacagcagacatggggctaggggacaaggcaggcttactatgggaacttcctctaagaaaatgtaactttgataaagacctaaaggatagagtaacaaaaagataaatattaaggtgatagatattctaattaccctaatttgattatatgaatatatcaagttagcacatgtaccctgaaaacatgtacatctattatgtatcaataaaataaacaatttttaaagatatgatttctatatatttatatttaaatacatttctaacaaccacaaaaatgttactcatttgaccatttaataagctaatatttaaatagctactctgtgtcaggcactgtgctaagtacttgggacaataaagacatagaatctctgccctaatagagtccatagagtcagggagataggtatttaacaattattcttgcttatttaagtaagagc

SEQ ID NO: 470077 - DNA, 576 bp, Homo sapiens
atagtgttggaccacacggggttcagaagaagatagaaaaatgttaggaagtttggaacttcctagagacttgcagaattgttttgaggaaaatgctgatagtgacatggacaatgaattccaggctgaggtggcctcatatggcgatgaagaacttgttgagaactggagtaaaggtgactcttgctatgcaaagagactgacggcattttgcccctgcctgagaaatcttagcaaagtgttcaagaggaagcaaagcataaaagttttaaaaattttgcagcttgatgatgagatagaaaaggacaacccattttctggacagaaattcaagccagctgcagaaatttgcataagtaacgaggagctgaatattaatcaccaagacaatgggaaaatgtcttcagggcatgtcagagaccttcacggctactcaaaccatcataggccaggagacctaggaggaaaaaaatggtttcatgggcccggtgcagggacttgcagctctgtgcagtctcagggcttggtgccctgtgtcccaatcatggcttaagggccaatgtacagctcaggcca

SEQ ID NO: 470078 - DNA, 3871 bp, Homo sapiens
cccagcagcactgtcctggaattctatctgtgggagaaccattcagacaagagcaggaatattctggaatgctatgtgagggacagtcattcagacacagctggggtgctctggaatcctacgtgtgggacaaacattcagaaccttgtagcattgttctggaatccaaagtgagggacaaacattcagaccacagcaggagtgttcttttatcctacgtgagggacagagattaataccctcttagcagtgttctgtaatcctatatgaggtacaaactttcagacaacaacagcagtattctggaatcctacgtgagggacaaacattcagaccacaggaggagtgttctggaatcctatgtgaggggcattcagaccacagcagtagttttctggaatcctatgtgggggactaacattcggaccatcgtagcagtgttctataatcttatgtgagggacaaacattcagaccctcgtagcagtgtactggaatcgttcgtgagagacaaacactcataacccaacagcagtgttctgggatcctaagtaagggacaaatattcagaccatagcaagagtgttctggaatcctacgtgatggagaataattcagaacctcgtaggagtgttctcgtatcctatgtaatgggcaaagtttcagaccctcgtacccgtgttctggaatcctaagtaatggacaaacatttagacccacgtagcagtgttctggaatcgtcggtgagggaccaactctcagaacccatcagcagtgttctggaatcctatctgaaggagaaacattcagactacagcaggagtgttctggaatcctatgtgagctacaatcattcagacattcgtagcaatgttgtggaatcctatgtgagggagaaacattcagaccacagcaggagttttctggaatcctatgagagggacaatcattcagtccacagctggggtgttctggaatcctacgtgttggacaaacattcagatcacagccggagtgttctggaatactatgtgagggacattcagaccacagcaggagtcttctggaatcctatgtgagggacaactatcagaccacagcagcagtgttctggaatcctttctgagggacaaactttcagaccctcttagcagtgttctggaatcctataagaaggacaaatctttagacctacgtagcagtgttctggaatcgtacgtgagggacaaacactcagaaaccagcagcaattttatggaatccgctctgaggtagaaacattcagaccagagcagaagtgttctggaatcatatgtgagtgcaaacactcagaattcagcagcagtgttctggaatcctatgtgagagtcaatcattcagacaaaatctggtatgatttggaatcctacgtgtgggacaaacattcagaccctcctagcattgttctggaatcctcagtgagggacaaactttcagacgacagcaggagtgttctggaatcctatgtgaaggaccaagatacagaccatcgtagcagtgttctggaatcctatctgagggagaaacattcagaccacagccggattgttctgtaatcctatgtgaggtaaaatcatttagacccacgtagcatttctctggaatcctaagtgaagaagacacattcagaccacaggaggagtgttctggaatcctatgtgagggacaaactttcagaacacagcagcactgctctggaatcccatgtgaggaacaaacattcagaacctcgtagcagtgttctggaatattatgtgagggacaaacattcagactctcgtagcagagttctggaatctatgtgaaggagaaacattcagaaaagagaaggagtgttctggaatcctatctgagggagaaacattcagaaccttgtagcagtgttctggaatcctatgtgagggtgaaacagaacccagtagcagtgttctggaatctcatttgggggacaatcattcagaccacagatggcgtgttctataatcccatgtgtagcacaagcattcagaccctcgtagcactgttttggagtccaaagtgaggtacatatattcagacaacagcaggagagttctggaatcctatgtgagggacaaaaatttagaccacagcagcagtgttttgaaatcttatgtgagggaccaaaattgagacacatgaagccgtgttctggaatcttatgtgaaggacagatattcagaaccccgtagcagtggtctggaatcctttgtgagggagaaacactcagaacccagatgcagtgttctggaatcctatatgagggacagtcattcagaccacagctagtgtgttctggaatcctgagtgtgggagaaacattcagaccctcgtaacactgttcagaatcttatgtgagggaaaagctttcagaccacagcagcagtgttctggaatcctctgtgagggacaaacattcagaccacagcagcagagttctggaatcctaagacagggacaaatattcagaccacagcaggagagttctgaaatcctatgtgacagacaaacattcatacccaagtagcagtgttggaatcgttcgtgagggacaaacactaagaaaccaacagcagtgttctataatcataagtgagggacaaacattcagacgacagcaggagtgttctggaatcctacgtgatggaaaatagttcagaacctcgtagcagtgttctcgaatcctatgtaatggacaaactttcagaccctcgtagcagtgttctggaatcctaagtaatggacaaacgtagacccacgtagcagtgttctggaatcgtacttgaggaacaaacactcagaacccagcagcagtgttctggaatcctatctgagggagaaacattcagaacagagcaggagtgttctggaatcctatgtgaggaagaatcattcagacattcgtagcagtgttctggaatcctatgtgagggagaaacattcagaccagagcaggagtgttctggaatcctatgtaaggaacaatcattcagaacactgctgggtttttctggaatcctacatgtgggacaaacattcagacaacagcaggagtgttctgggatcctatgtgagggacaaacattcagaccacaacagcaatgttctggaatcctgggtgaggaacaaacattcagaatcctgtagcagtgttctggaatcttatgtgagggacaaacattcagaccacagcaggagggttctggaatcttatgtgaaggacaaacatttagacacacgttgtagtgttgtggaatcatatgtgagggacacccactcagaacccaaaagcagtgttgtggaatcttatgtggtggacaaatatttagactcacgtagcagtgttctggaatcgtacatgaggggcaaactctcagaacacagcagcagtgttctcaaatcctatctgagggagaaacattcagaccagagcacgagtgttctggagtgctacgtgtggtacaatcatttagactctcgtagcagtgttctggaatcctatgtgagggagaaaattccagaccccagcaacattgttctggaatcctatgtgagagagaaacattcagaccacagcaggaatattctggaatcctatgtgagggacaaacatttagacacataccacagcagtaatgttctggaatattacgtgacggacaaatattcagaccacagctggatttttctggaatcctatgtgattccattagacccacgtagaagtgttctggaatcatacgtgagggacaaacactcagaacccaagagcagtgtgcttcaattctaaatgatggacaaatattcagaagacc

SEQ ID NO: 470079 - DNA, 2855 bp, Homo sapiens
gaatgtcagggacagtcattcagaccacagctggggtgtcctggaatcctacgcgtgggacaaacattcagacacttgtagcattgttctggaatcctatgtgagggacaaacattcagaacacagcaggagtgttgttgagtcctacgtgtgggacaaacatgcagactctcgtagcatggttctcgaatcctatgtgagggacaaatatttagacccacctagcagtgttcttgaatcgtaccagcgtctggaatcatatgtgaaggacaaacattcagacccacgtggctgtgttctggaatcgtacaagaaggacaaagactcagaacacaacagcaacgacagtaggagtcctctgaaatccaatgtgaggaacaaacatttataccacagcagaagtgtgctggaatgttatgtgcgggacaaatattcagaaactcaaagcagtgttctcgaatcctatgtgagggagaatcatttcgacccatgtatctgtgttctggaatcctacatgagggaaaaacactcagaacccaacaggaggagtgttctggaatcctatgtgaagtacaaatattcagatgacagcaggagtgttctgaaatcctatgcgaggaacaaacatttagaccacagcagttgtgtttgggaatactatatgagggacaaaccctcacacaatagcacgagtgttctggaatcctatgtgaggttcagtcattcatactctcgtagcagtgttctggaatcttatgtgagggagaaacacgcagaaccctgcagcaatgttctggaatcgtatgtcagggacagtcattcacaccacagctaaggtgttctggaatccaacatgtgggacaaacattcagaccctcgtagcattgttctagaatcctatgtgagggagaaacattcagaaaacagcagaagtgttctggagtcctatgtgcgggacaaactttcagaccctcgtagcagggttctggaatcctatgtgagggccaaatattagacccacatggcagtgttctggattcgtacgtgagggacatatactcagaaccaacagcagtgtcctggaatcctaagtgggggacaaacattcagaccacagcaggattgttctgaaatcctatgtgaggaacaaacattgagaccacagcaggagtgttctggaatcctatatgagggacaaactttcagaagacagcaggattgttctgaaatcctatgtgaggagcaaacatttagactacaaaaggagtgttccagaatcctatgtgagggacaaatatttagaccctcgtagcagtgttccggaatcctatgtgagggacaaatatttagaccctcgtagcagtattctggaatcctatgtgatggacaaacatttagacccacgtagcagtgttctggaatcataagtgagggacaaaccttcagaccacagcatgagtgttgtggaatcctatgtgagggacaaatattcagacgacagcagaagtgtcctgaagtcctatacgaggaacaaacctttgtaccacagccggagggttctggaatcctaagtgaaggacaaacattcggaggacagcaggcatgttctgaaatcctatgtgaggagcaaacatttagaacacaacaggactgttctggaattctatgtgcaggacaaacattcagaccctgataacagtgatatggattcctatgtgaggcataaacttttagacccacgtggaagttttctggaacgtgaggggcaaacactcagaacccaacagcagtgttctggaatcctatgtgagggactaatattcagtccacagcgggaatgttctaaaatcctatgtgacgaacacacattcagaccacagcaggagtgttctggaatcctatgtgagagacaaacattcagatcctggtagcagtgaaatggatccctatgtgaagtacaaacttttagaccgacgtgagagtgttctgtaatcttacgtgagggacaaacactcagaatccaaaagcagtgttctggaatcctatgtgagggacaatcattcagaccacagctggggtgttctagaatcctacttgtgggacaaacattcagaccctggcaacattgttctggaatcctatgtgagggacaaacatttagaaaacagcaggagtgttctggagtcctatgcgtgggacaaacattcagactcttgtagcggtgttctggaatcctatgtgagggacaaacattgagaccctcttacaagtgttctggaatcctatgtgaggtacaattattcagaacctcgtagcagtgttctggaatccaatgtgagggagaaacactcagaacccaccagcagtgttctggaatcctatgtgaggaacaatcattcagaccaatgctggggtgttctgaaatcctaagtgtgggacaaacattcagaccctcgtagcattgttctggaatcctatgtgagggacaaacattcagatgacagcaggagtgttctgaaatagtatgtgaggaacaaacatttagaccacagcaggagtgttcaggaatcctacatgagggacaaacactcagacaatagcaggagtgttctggaatcctatgtgaggtttagaaattcataccctcatagcagtgttctggaatcttatctgagggagaaacactcagaacccagcagcagtgttctggaaacgtatgtcagggacagtcattcagaccacagctggggtgttctggaatcctacgtgtgggacaaatattcagaccctcgtagcaatgttctggcatcctatgtgagggaaaaaccttcagacccacgtaacagtgttctgga

SEQ ID NO: 470080 - DNA, 6820 bp, Homo sapiens
cagcgggagtgttctggaatcctacgtaacggaaaaaggttcagaccctcatcgcagtgttatggagttatatgtgagggagaaacactcagaacccagcagcagtgttctggaatcctatgtgatggacacacatggagaacccagcagcagtgttctggattcctatgtgaaggacaaacattcagtccccggcagcagtgctctggtttcctatgtgagggacaatcattcagacactcaccctagcagcagtgttctggaagcccctgtgagggacaaacattcggacccttgtagcagtgttctggaatcctatgtgagggagaaacactcagaacccatcaccattgttctgaaatcctatgtgagggagaatcattcagaccccagtagcagtgttctggaatcctatcattgttctggaatctatgtgaggaaaatacattcagaacagagaacgagagatctggagtcctatgtgctggacaaacaatcagatcctcgtagcagtgtcatggaatcctatcagtgttctggaatcctaagtgagggcaaacattccgaccccagtagcagtgttcttgaatcctatttgagggacaaacactcacaccacagcaggatggttctggaatcccttgtgaggcatgaacacccagaccacagcagaagtgttctggaatcctgtgagagagtcaactattcagaccacagcagtagagttctggaatcctacatgtgggacaaacattcagacaacagcaggagagttctggaatcctatgtgaggaaaaagcattcagtccacagcaggagtgctctggaatcctatgtgagggacaatcattcagacaacagctggggtgttctggaatcctacgtctgggacaaactttcagagccttgtagcattcgtgtggaatcctatcagtgttatggaatcatacctgagggacaaacactcagaactcaacagcagtattctggaatcctaagtgagttgcaaacattcagactacagcaggagtgttctggaatcctatgtgagggagaaacattcagaacacagcagcagtgttctggaatcctacatcacagaaggattgttctggaatcccatattaggcacaaacaccaagaccacagcaggagtgttctggaatcctatgtgagggtcaaccattcagaccacagcaggagtgttctggaatcctatgtgagggtcaaccattcagaccacagcagtagtgttctgcaatgttctatgagggacaaacattcagaccacagcaggtgtgctctggaatcctatgtgaggaacaaacattcagaccacagcagcagtgttctggattcccatgtgagggagaaacactcagaacctagcagcagtgttctggaatcctatgtgagggacagtaattcagaccacagcttgggtgttctgcaatcctatgtgagggacaaacattcagaccctcttagcatttttctggaatcctatgtgaggaaaatacattcagaatacagcaggagtgttctggagtcctatgtgtgggacatatattcagatcctcgtagcagtgttctggaatcctatgtgagttacgaatatttagacccacatatcagtgttctggaatcctattggagggacaaacactcagactacagaaggaatgttctggaatcctatgtgagggagagtaattcggaccctcgttgcaatgttatggaatcctatgtgaaggacaaacattcagaccccagtagcagtgttctggaatcctatttgagggacaaacactcagaccacagcaggaatgttttggaatcctatgtgagggtgaaccattgagaccacagcagtagtgttctcgtatcctatatgaaggacaatcatttagacccatgtagcagtgttctgcaatcctaacactaagattaacacaaacactaaatcccaacagcagtgttctgtaatcctaagtgaggaaaaaacattcagaccacagcaggagtgttctggaatcctatgtgagggtgattaattcagacactcgtatcagtgttctggaatcctatgtgagggacaaacattcagaccccagtagcagtgttctggaatcttatgtgaggaagaaacagtcagaatccggcagcagtgctctggaatcctttgtgagggacaatcattcagaccacagaggattggtctggaatcctacgtttggaacaaacattcagaccctcgtagcattgttttggaatcctatgtgaggaaaatacattcagaacacagcaggagtgttctggattcctatgtgcgggagacacattcaaacacttgtagcagtgttctggaatcctatgtgacagacaaacatttagacccacatagaagtgttctggaatcgtacgtgaagcacaaacactcaaaacagagcagttgtgttctggaatcctatctgaggaacaaacattcagaccagagcaggagtgttctggaatcctatgtgaggtacaatcattcagacactcgtaacattgttctggaaacgtatatgaggagaatacattcagaacacagcaggagtgttctggagtcccatgagcggggcaaacattcataccctcgtagctaagttctggaatcctatgtgagggacaaacatttaaacccacatagcagtgttctggaatcatacgtcagggataaacactcagaacccaacagcagtgttctggaatacaaagtgagggaccaacatacagaccacagcaggagtgttctggaaaactatgtgagggagaaaaattcagacccttggagcagttttctggaatcctttgtgagggacaaacatttagagaacccagtagcagtgttctggaaccctatgtgagggagaaacaataagaacccagcagcagtgctctcgaaacctatgtgagggacaatcattcagaccacagctgtggtgttctggaatcctaccagtgggacaaccattcagacccttccattgttatggaatcctatgtgaggaaaatacattcataacacagcaggagagttcttgagtcctatgtgtgggacaaacattcagaccctcgtagcagtgttctgtaatcctatgtgagggacagacatttagacccacatagcagtattctggaatcgtttgtgagggacaaacactcagaacccaacagcagtgttctgtaatccgaagtgaagaacaaacattcagaccacagcaggagtgttctggtatcctatgtgagggaaaatacttcaaaccctggtagcaatgttctggaatcctatgtgagggacaaattttcagaccccagtagcagtgttctagaatactacttgaggaacaaacacttagaccacagcaggaatgttctgcaatcctatgtgagggagaaacatacagaccacagcaggattgctctggaatctcatgtgaggcacaaacagccagaccacagcaggattgttctggaatactatgtgtggtacaaccattcagaccacaggagtagtgttctggaatcctacatgagggacaaacattcagagagtacaggagtgttctggaatcatatgggaggaacaaacattcagaccacagcagcgcttttttggaatcctatgtgagggacaaacactcagaacccagcagcagtgttctggaatcttatctgagagacaaacattcagaccagagcaggggcgttctggaatcctatgtgaggtacaatcattcagaccctcgtagcagtgttctggaatccgatgtgagggagaaacactcagaatccagcagcagtgttctggaattctatgtaagggacattcattcagaccacaggtgggctattctgcagtccttcgtgtgtgacaaacattcagaccctggtagcattgctctggaatctcatgtgagaaaaattattcagaacacagcaggagtgttctggagacctatgtgcgggagagacattcagaccctcgtagcagtgttgtggaatcctatgtgaaggagaaacttttggatccacgtgacagtgttctagaatcgtacgtgaggaacactcagaacccaacagcagtgttctgtaatcctaagtgagggacaaacattcaggccacagccacagtgttctggaatcctatctgagggagaaacactcagaaccaagcagcagtgatctggaatcctatgtgagggacaaacattcagaccacagcaggagtgttctggaatcctatgttagggagaataattcagatccttttagcaatttcctgaaatccgacgtgagggacaaacattcagacaccagtagcagttttctggaatcctatgtgagggagaaacactcagaacccaacagcagttttccggaatcctatgtgagggacaatcattcagaacacagctgggacgttttggaatcctgcatatcggacaaacattcaaaccctcatagcattgttctggaatcctaagtgaggaaaatattttcagaaaacagcagatgttttctggagtcctgtgggtgggacaacattcagaccctcgtagcagtgttctggaatcctatgtgagagaaaaacatttagacccacgtagcagtgttctggactagtatgtaagtgagaaatacacagaacccaacaacagtgttctcgaatagtaagtgagggacaaacattcagacaacaggtggagtgttctggaatccgatgggatggggaataattaagacacccgtagcagtgttctggaatcctatgtgaggggcaaacattcagaccttcatagcagtgttctggaatcctgtgtgacggacaaacatttagaatcaagtagcagtgttctgtaatcaaaggtgagggacaaacactcagaacccaacagcagtgttctagaatcctcagtgagcgacaaacattcagaccacagcaggagagttctggaaccctatgtgagggacaaacattcagacactcatagcagtgttctggaatcctatgagagggacaaacatttagacccacgtaccagtgtgctggaatagtacgtgagggacaaacactcagaacacaacagcagtgttctggaatcctaagtgagggacattcagatgatggcaggagtgttctggaatcctatgtgagggagaataattcagaacctcgtagcagtgctctggaatcctatgtgagggacaaactttcagaccccagcagcagtgttctgaaatcctatgtgagagagaacctctcagaaaccagcagcagttttccagaatcttatatgaaggccaatcattcagacgatagctggggtgttctggaaacctaactgtgggacaaacattcagaccctcgtagcggtgttcgggaatcctatctgagggacaaacatttagagacacgtagcagtggtctggaatcgtaaatgagggacaaacactcagaacccaacagcagtattctggaaacctaagtgagagacacgcattcagacaacagcaagagtgttctggattcctatgtgagggagaaacactcagaacccagcgtcattgttctggatcctatgtgagagaccatcagaaagatcacagctggtgggttctggaatccaagtttgggacaaagattcagaccctcgtagcattgttctggagtcctgtgtgagggacaaacatttagacccacgtggcagggttctggaatcgtacatgagggacaaacactcagaacccaacagcagtgttctggaatcctcagtgagggataaacattcagacgacaacaggagtgttctggaatcctatatgatggagaataattcagacccttgtagcagtgttctggaatcctatgtgagggagaaactttcagaccacagtagcagtgttctggaatcctatttgtgggagaaacactcagaaaacagcaggaatgttttggaacctatgtgagggagaaacattcagaccacagcaggattctggtcaacaattcagaccaaggcagtaatgttctggattcctatatgagggacaatcgttcagaccatagcaggtgagttctggagtcctatgcgaggaacaaacattttgaacacagcagcagtgttctggaatcctatttgagggacaaacgtgcagaacctaagagcagtgatctggaatcctatctgtgggacaaatattcagaacggagcaggagggttctggaatactatgtgaggtacaatcattcagaacctcgtagcagagttctggagtcctatgtgaaggagaaacactcagaacccagcagcagtgttcgggaatccaatgtgagggacgatctttcagaccacagctgtggtgttctggattcctaagtgtgggacaaacattcagaccctcttagcattgttctggaattttatgtgaggtaaatacattcagaacacagaaggagatttctggagtccattgtgcgggacaaacattcagaacctcacagcagtattctgcaatcctatgtgagggataaacatttaaacccacggaacagtgttctggaatcttacataagggacaaacactcagaacccaacagcagtgtcctagaatcccaagtgagggacaaacattcagaccacagcaggaatcttctggaatcctatgtgagggagaataattcagacactcgtagcagtgttctggaatcctatgtgagggacaaacattcagaccacagcagtagtgttctggaatcctatgtgagggagaaaca

SEQ ID NO: 470081 - DNA, 3837 bp, Homo sapiens
cagaccacagctggggtgttctggatccctaggtgtgggacaaacattcagaccctcgtagtaatgttctggaatcctatcagtgctctggaatcctacgtgaggaacaaactttcagaccacagtagaagtattctggaatcctatttgtgggacaaacactcagaccacagcaggaatgttttggaatcctatgtgagggagaatcatgcagaccacagcaggattgttctggaatcccacgtaaggcacaaacacccagaccacaacaggagtgttctggaatcctatgtaagggtcaacctttcagaacacagcagcagtgttctggaatcctataggagggacaaacattcagaccacagcaagagagttctggaatcctatgtgaggaacaaacattcaggccacagcagcagtgttctggaattctatgtaagggacaatcattcagaacacagctggggtgttctggaatcctacgtgtgggacaaacattcagaccctcgtatcattgttccagaatcctatgtgaggaagaacattcagaacacagaaggagtgttctggagtcctatgtgcatgacaaacactcatactctcatggtagtgttctggaatcctatgtgagggacaaacatttagaagcacgtagcagtgttctggaatcgtacatgagggacaaacactcagaacccaacagcagtgttttggagtcctaagtgagggaaaaacattcagaccacagtaggagtgtcctggagtcctatgtgagggagaataattcagaccattgcagcagtgttctggaatcctttgtgagggacaaatattcagatgtcagtagcagggttctgcaatcctatgtgagggagaaacactcagaacccagcagcggtgtcctggaatgctaattgagggaaaaacacacagatcacagaaggaatattctggaatccattgtgagggagaataatacagaccctcgtagcagtgttctggaatcctatgtgagggagaaatgctcaacccagaagcagtgttctgcaatcctatgtgagggacaatcattcagactacagccggggtgttctggagtcctacgtgtgggacaaacatgcagacccgcgtagcatttttctggaatcctctttgaggaaaatacattcagaacacaacaggagtgttgtggagtcctatgtgcgggacaaacattcagtccctcgtagcagtgttctggaatgccatgtgagggagaaacactcataacccagtagtagtattgtggaatcctatatgagggacaatcattcataccacagttgaggcattctggaatcctatgtgtggggcaaacattcagacccggacccttgtagcactgttctgcaatcctatgtgaggaacaaacttttagacccagggagcagtgttctggaaccgcaagtgagagacaaacacttggaaccctacagcagtgtcctggaatcctaattgagggacaaacatacagaccacgaaggaatcttctggaatcctatgtgagggagaataattcagaccctcgtagcagtgttctgcaatcctatgtgagggaaaaactttcagaccacagtagcagtgttctggaataccatgtgagggagaaacactcacaacccagcagcagtgttctggaatcctatgtgagggacaatcattcagaccacagctgagttgttctggagtcctaggtttgggacaaagattcagactcacgtagcattgctgtggaatcctatgtgaggaaaatactttcagaacacactaggtgtgttccagagtcctatgtgcgagacaaacattcagtcccttgtagcagtgttctagaatcctatgtgagggacaaacatttacacccatgtatcagtgttctgtaaccgtacgtgaaggacaaacagtcagaacccaacagcagtgttctgcattcctaagtgagggacaaacattcagatcatagaaggagtgttctgtaatcctatgtgagggagaaacattcagaacccagaagaagtgtgctggaatcctctgtgagggacaatcatttataccattgtagcattgttctggaatcctatgtgaggaaaaacccttcagaacacagcagtagtgttctgcggacctacgtgcgggacaaacatacagaccctcatagcagtgttctggaatcttatgtgagggaaaaacatttagacacacgtagcagtgttttggaatcgtacgtgagggtcaaacacacagaacccgacagcagtgttctggaagcttaagtgagggacaaacattcagaccacaacaggagtgttctggaatcctatgtgagggagaataattaagatcctcatagcagagttctggaatcctatgtgagggagaaaaattcagatcccagtagcaatgttttggaatcctacgtaaaggagaaacactcagaacccagcagctgcgttctggaatcctatgtgagggacaatcattcacaccacatctgggatgttctgggtccctatgtgtgagacaaacattcagaccctcatagcaatgttatggaatactatgtgaggaagaacattcagaacacagcagcagtgttctggagtcctatgtgagggacagtcattcagaccccagttggggtgttttggatccctaggtgtgggacaaatattcagaacctcgtagcattgttctggaatcctatgtgaggaagaacattcagaacacagtaggagtgttctggagtcctatgtgcgggacaagcattcagaacctcgtagcagtgttctggaattctatgggagggaccaacatttagacccacgtagcaatgttctggaatcgtatggggggggaaacactcagtacccaagaacagggatctggaatcttcagtgagtgacaaacattctgaccagagcaggagtgttctggaaacatatttgaaggacaaacactcagaacccagcagctttgttctggaatcctatgtgtgggacaatcattcagaaaaccactgaggtgttctggaatcccacgtgtggaacaaacattcagacccttgtagcattgttctggaatcctatgtgaggaaaataccttcagaacaaagcaggagtgttctggagtcctatgtgtgggacaaacattcagagcctcgtagcagtgttctggaatctgatgtgagggaaaatcatttagacccacgtagcagtgttctggaatcgtacatgagggacaaacactcagactccaacagcagtgttctggaatcctaagagtgggacaaacattcagaccacagcaggagtgttctggaatcctatatgagggagaataaatcagacgctgttagcagtgttctgtaatccaatgtgagggacaaactttcagacaccagtagcagtattctggaatcctatttgtggtacaaacactcagaccacagcaggaatgttttggaatcctatgtgagggacaaacagtcagaccacagcaggattgttatgaaatcccatgtgaggcaaaaacacccagaccacagcaggaatgtactggaatcctatgtgagggtcaaccattcagaatacagcaggaatgttctggaatcctatgtgagtgtcaaccattcagaccacagcactagtgtaatggaatcctacgtgagggacaaactttcagaacctcgtaacagtgttctggaatcctatgtgagggacaaacactcagaaccccgcagcagtgttctggaatcctaagtgaggggcaaacattcagaccacagcaggagtgttttggaat

SEQ ID NO: 470082 - DNA, 1118 bp, Homo sapiens
cagccgcgcccgcgccgcccgcctccccgcgctgctgcccggctctcgggctctcgctttttttttttttttttctttccgcggcagtcttaggattcttgtcacatgatggcttcatcgggcccttctcctcctgatcctttcaagctctttctcctgcctggcatatcaaaggagatttgtgggtccagagtctgtttgctgattctttgttcacttgttccctcctccaacgatggcataaaccctctccttgtgccaggttgggcactggagctgctgtgcctgatttcggctgtcagaagctcacagtctgttgtgagttatgagctatgtggaggggtgatgggtagcaggcaagatgacaatgataataagcaggcaagggagaggggcaacgagggactgtggaccactcagggctatcaaggaatctgcagcccagaagctcctccattttcctccagactagcccaggtctcataccctttggtttcacctttctgtacttctttcatgttgcccaggataattcctcatcattacttgtcaaatggttgtgttctccctgggctacagattagatgaggttgggaattcccttttcactgcctctgtatctcaatagcagccccatgccaaacacttcccagggactgagtaaagatttccccaaagggtgagtgaatgttgaggaaaggcagaaagcaatcctccttaagtgggatatcagaatgctgagcttaacttgaaaccgtttctaaaccatagactcttatttaaaggaaaccaacatgaaaatgccaacaccaccttatttacaaggtactttgttcactagagctattaaagggctgtgttgatgggaagctgtgtataattgtaggtattatgccagagaccgctttctgtcaggctgccagaccaaaggggtagggaccgtactctagagaccctcacccaacaggatgattaaacgaatttgtaagggttaatagatgggcggtggctcattaaaaccaactctaaatgcattactttgaccacagactcgtaatatggaccatcttggagagcctggtgaaggatgaagtgcatctttgctaggtttgcgctac

SEQ ID NO: 470083 - DNA, 710 bp, Homo sapiens
ctggaatagtgtgggcctctaatccaatatgacacgtgtccttataagcagaggaccatgtaaggacacacacagaggataccatgtaaagatggaggcaggggctcgactgaggcatttacaaatcaaggaacaccgagaattgataggagagaggaaaggaacggattctcctccctcagaactctcaagaggaaccaacccacctaagactctaaatgtctgctttctgccatttgaggacccagcattcctccactctgaaagaggctcccttttggaagcagagaacagccttcaccagatgctggcacttaatcttggacttccaggcctccagaacgtgtatcctgtggctttggctgacatgtggtcttgggttctctgtctttctagctctctttgccttatcatgacctcactgataatggatacccagatgctgtcaatggaggctgtcttgaacattggacattatactttcccgattccctacaagttctcttaggcaaaataaattccaaggccaagtaactggctccattacctaagcaattggtcaaccctaaacaatttctatgtaatgtttcaatggaagttaaaggtacagagttctttggaaagaatgaaaatgttaatacttcagcactagtaattcagactcacaaaattcctatttcatggtcttccaatggtgcgatttattcaac

SEQ ID NO: 470084 - DNA, 943 bp, Homo sapiens
gaggactgccagcacgctgtcacttctcaggacagcatgcaggaaactccctaataaaaggaagtacacaggatgcgagcagctgagtaagccttgcaatatgcagctatggaaggagaagcatctgacatcgctggtaccactggcactgctggcccttgccaatgtacagagcctcaagactgctagctgatgggctctacgggaaatttgggaaattacaggtcaattacacacgaaatatgtgtgagaaggagaggctaaacaatcctgcgaagatttggtatgacagcaacagcagcagcatctacaatgaactttttggaaatctaggggatgacccctgggtattaatgagggtcagcttaggaaacccgggcagcaaaacttccccacgtcacagtgagcaaccagcagtagaaagttcaatggtccacagccacaccacctgtcttctggagtggtttgagtcacgttgttcagaactatgctctgtttatcaacagctgtttatcaatagctctaggggctatggacattctgggtttccatacttcagatacataagaaggaaatatttgtagagtttgggtgggggtgggaggactcactcgagtgtcatctcaccttactcttcattggaacatatgctgatctgaatttactttataaaattcttagttagaaaattcaatctgcaggacaagaagtagccatcgtgcatttgaaacattatatagtagccacaaaaaactcattaccaatggactagcatgtggttaaatcccagattatcacttgtttaccatgagtcttgtctctgacactcgtagattgagtaaagttgatcggccagaaatgttatcttttagaggctgggaaattgtgcataaagcccaagtcagtgcttctgtttctatccctgagtgcttttaaaaaattc

SEQ ID NO: 470085 - DNA, 1573 bp, Homo sapiens
acccccaacacattcacagaccaagtttcaaaatggagtgggatgcctctggaacgaagtatggcccagaatgtgccctggggcatttggctgatcctttctaaaaaccccaaagaatacagtgagcaatgctcatttcaagataggcacgccaatggctgcagaagtgatactgccatcatagtcacatcccagtccctccagacagctggtacctgcttctcctgcttcactttcaccttctccatgttttccaactctgctacccctgagatagcaagatcaacactttctccttctcagcctagtcaatgtgaaggtgatgaggatgaagacctttataatgatccacttctatttaataaatatggcaactctcctcaaatttctgccttcttttcattcttcagtgcctgcatgtggaagtttttctgttttctccagaatttattgtagaagataaaatctgaccaaaatagcccttagagatatctgaggacaatcaggatatgagcactgttgtttattggtgagcatgacaatggaatttgccatataaaagaatgaatctttcgaaagcacatgctttctagaagtgtcgtgatttggtttttttgtttgcttgtttacttatttgttttggatgatttatcagaaattatctttgtagcactaatatttaatttttactctttgcaatatcattttaagttctttaaatgttttattattgcacttttagcttagctttctagtcactgagagtcagtttattttttgattgattttgtttggacaattttattccacttttctttgatatccttcttcccctgctcccctctgtgtcagtatttttaagctaatcatcttattctaaacttgtttataattacttttgaactttacaaagatattacttaatttttatttttctaaatatcgaagtttaaaatacattctcctaatgaaaatgaggaatcaaacatatccttattctccccaccagcattctatgtgcttgtaatttttcctggaaatatgttcttagttttatttactgttgctcaatcattttattctttacaaacattttaagagcataatctttgatgttagaatctaatactataatcaaatttaactatctagaattgctatcaaaatttgttatatttatataaattcagtcctttttatagtgaattttatgttcaatatttgtatttatctcttctttgactggactatattcttcaggtaatattgcgaacattgcacaagttgtatattttcttagctattacatacttgaaatttacagtagaaaagtgggctatttagaaatatagtatatcaaaaccgttcctcttcataaatgtatagcattttccaaatgtgtttcgtcattcagtgctgcaaaaaatgtctgagtctaacctattttgtggttattagtggagctgtaaatcagagaatatttttcttaaccatgtgactgtaatttttcctttataaataacatgtaattttcttttcattgcatttggaaagaggatatgtcacttagatc

SEQ ID NO: 470086 - DNA, 906 bp, Homo sapiens
gcgctatcaacatggggaagctccagggtagaacaagaatgaaaatgagcagagtggagatgagcttcactgatgtcttcagtgcaaatgtgaaaactgaattggaaaacaaaattctgtctggcatccaaagggcagcttcttctgccttgggtttccggtatcaaagagcccctggcctgaatgggcaggacactgtaaaatggaccaatcagcacactgtaaaatggaccaatcagcaggacatgggcaggaaaaataagggaataagagctgcttaccccagccagcaacggcaaacagcgcagcagcatgaaaatggactaataacgggtggtatggcagattgggtggtaatacacagtattagtttcaatgggcaagtatctaactttccagaacttcctcctccacaatctgtgggtccttgaagtgtttttatttagggctttctccatgaccttattccaagccacatgatctttctttctttatgcactagttcaggatattggctcctcttatgttcattaaggcggccctaaccaagcacatttaattcctcaatgactaatttggttctgagaggttaagaactggtgaggctaaggcaacggtctatagtatctggtgatgagataagtgcagattaatttgtgagatagaacatttctacccttttccctttggctttaaggtttatttagaattcatgaagttgtgtctgtgctgaaaagctttgaaccgttaaagggaattatttaacaaaatttctaaaaatgcctgtgcaaattggtttgtcttgaaattctggtgctttgttatttttgccaccaagaaaaaggcttaaaaaaacgcttgagggagaatatgaatgtaataaatatttcatttttgtagcacatc

SEQ ID NO: 470087 - DNA, 6827 bp, Homo sapiens
tggaatcgaatggaatggtttgtcatggaatggactcaaatggaatggacagtaacaaaatggaatggaatagggattggaacggaatgcaatggaatggaatggaatggactggaatggaatagagtcgaatggaatggagtcgaatggaatgtaatcaaatggaatggaatcaaatggaatggaattgaattgaatattaaggagcagaatggaatggggtgttatcgaaggatatcgaatggaatggaatggagtggaatagacttgaatggaatggactggaatggaatggaatcgaatggaatggactggaatggatatggaatgatatcgaatggaatggactcgaatggaatggacttgagtggaatgaattcgaatggaatggaaacgaatggaatggaattgaatggaatacaatggaatggaatcggatggaacggaatggaaaggaatgtgaaatggattcgaatggaatggactggagtgaaatggattcgaatggaatggactggagtggaatggactcgaatggaaaggaaacgagtggaatggaatggaatggaatggaatggcttgaaatggataagaaatgaaaagaatgtaatggaatcggatggaatggaattgaatgtagtggagtcgagtagaacagaattgaatggaatggcatcaaatggaatggaaacgaaaggaatggaattgaatggactcaaatgttatggaatcaaagggaatggactcaaaacagactcgaatgtaatggattgctatgtaattgattcgaatggaatggaatcgaatggaatgcaatccaatggaatggaatgcaatgcaatggaatggaatcgaatggaatgcagtggaagggaatggagtggaatcaagtggaatggaatggaatggaatggaattgaaaggaatggaatagaaagtaatggaatggaatcgaatggaatggactggaatggaatggattcgaaaggaatcgaatggaacaatatggaatgcattgcaatgcaatggattcgaatggaatggaatcgaatggaatggattggcatggaatggacccaaatggaaaggacaataacaaaatggaatggaatagggattcgaacggaatgcaatggaatggaatggaatggacttgaatggaatagagtcgaatggaatggagtcgaatggaatgtaatcaaatggaatggaatgaaatggaatggaattgaattgaattgtaaggaacagaatggaatggggtgttatcgaaagatatcgaatggaatggaatggagtggaatggacttgaatggaatggactggaatggaatggactcgaatggaatggactggaaatggaatggaatcgtttggaagggaatggaatggaatggagtcgaatggaatagaattgaatgtaatggcatcgaatggaatggaatggactcaaatggaatggacttgaatggaatagagtggaatggattggcaccgaatggaatggaatggaaaggaatggaattgaaatggattcgaatggaatggactggagtgaaatggattcgaatggaatggactggagtggaatggactcgaatggaaaggaaacgagtggaatggaatggaatggaatggaatggcttgaaatggataagaaatgaaaagaatgtaatggaatcggatggaatggaattgaattatggaatggaatcgaatggaatggaatcgaatggattggaacgaaatcgaatggaacggaatagaatagactcgaatgtcatggattgctatgtaattgattggaatggaatggaatcgaatggaatgcaatccactggaatggaatgcaatgcaatggaatggaatcgaatggaatgcagtggaagggaatggagtggaatcaagtggaatggaatggaatggaatggaattgaaaggaatggaatagaaatggaatggaatgcagtggacacaaatggaatggactggaatggaatggacacgaatggaatggactggagtggaatgaacacgaatggaatggaagcgaatggaatggattggaatggaatggaatggaaaggaatagaatggaatggaatcaggattcgaacggaatgcaatggaatggaatggaatggacttgaatggaatagagtcgaatggaatggagtcgaatggaatgtaatcaaatggaatggaatcaaatggaatggaattgaattgaattgtaaggaacagaatggaatggggtgttatcgaaagatatcgaatggaatggaatggagtggaatggacttgaatggaatggactggaatggaatggactcgaatggaatggactggagtggaaatggaattgaatggactgtaaaggaatacaatggaatggagtgtaatggaaagatatcgaatggaatggaatggaatggaatggaatggaatacactggaatggaatgcactgaagcggaatggtctccagtggaatggaatggaatgcaatgaaatggaaaggaatagaatggaatggaatccgaacttatttcaatatgatggaatccaatggaatgtacaaaaatggaatggaatcaaagggaatggaattgattggaatagaccagaactgaatggactggaacagaactatggaatggaatcgaatggaatggaatcgaatggattggaacgaaatcgaatggaacggaatagaatagactcgaatgtaatggattgctatgtaattgattggaatggaatggaatcgaatggaatgcaatccaatggaatggaatgcaatgcaatggaatggaatcgaatggaatgcagtggaagggaatggagtggaatcaagtggaatggaatggaatggaatggaattgaaaggaatggaatggaatcgaatggaattcagtggaagggaatggagtggaatcaaaatggaatggagtggaatgcaataatatggaatggagtggaatggaatgcagtggacacaaatggaatggactggaatggaatggacacgaatggaatggactggagtggagtggacacgaatggaatggaagcgaaaggaatggaatggaatgaaatggaatggaaaggaatagaatggaatggaatctgttggagtagaatggaatggaatggagattatggaatggaatcgaatggagtgaaatggaatggaatgaacgtgaaaggaatagactggaacaaaatgaaatcgaacagtaggaatcatacagaacagaaagaaatggaacggaatggaatgcactcgaatggaaaggagtccaatggaagggaatcgaatggaatgaaatggaatggaatggaattgaatggaattgaaaggaatagaatggaatggatcaatggaatggactcgaatgacatggactctaatggaatagaaatgattggggtgacatcaaatggaatggatggcaatggaattgaatggaatggacccaaattggcatcgaatggaatggaatcgaacggaatggaccggaatggattggactggaataaaatggactcgaatgtaaagcattgcaatgcaatggattcgaatggaatggaatcgaatggaatggaatggaatggaatgcgccggaatgcactggactggaatagaactcgaatgcaatggattgcaatggattcgaacggaatgcaatggaatggaatggaatggaatggacttgaatggaatagagtcgaatggaatggagtcgaatggaatgtaatcaaatggaatgtaatcaaatggaatggaattgaattgaattgtaaggaacagaatggaatggggtgttatcgaaagatatcgaatggaatggaatggagtggaatggacttgaatggaatggactggaatggaatggactcgaatggaatggactggagtggaaatggaattgaatggactgtaaaggaatacaatggaatggagtgtaatggaaagatatcgaatggaatggaatggaatggaatggaatggaatggaatggaatggaatggaatggaatacactggaatggaatgcactgaagtggaatggtctccaaatggaatgcaatccaatggaatggaatgcaatgcaatggaatggaatcgaatggaatgcagtggaagggaatggagtggaatcaagtggaatggaatggaatggaatggaattgaaaggaatggaatggaatcgaatggaattcagtggaagggatggagtggaatcaagtggaatggaatggaatggaatggaattgaaaggaatggaatggaatcgaatggaatggactggaatggaatggattcgaatggaatcgaatggaaaaatatggaatgtggaatggaatcgagtggagtgaaatggaatggaatgaacgtgaaaggaatagactggaacaaaatgaaatcgaacagtaggaatcatacagaacagaaagaaattgaacggaatggaatgcactcgaatggaaaggagtccaatggaagggaatcgaatggaatgaaatggaatggaatggaagtgaatggaattgaaaggaatagaatggaatggatcaatggaaaggaatggaatggaacgcactggattcgagtgcaatggaatcaattggaatggaatcgaatggaatggattggcgtggaatggactcaaatggaatggactggaacaaaatggaatggaatagggattcgaacggaatgcaatggaatggaatggaatggacttgaatggaatagagtcgaatggaatggagtcgaatggaatgtaatcaaatggaatggaatcaaatggaatggaattgaattgaattgtaaggaacagaatggaatggggtgttatcgaaagatttcgaatggaatggaatggagtggaatggacttgaatggaatggactggaatggaatggactcgaatggaatggactggagtggaggaatggaatggaatggagtcgaatggaatagaattgaatataatggcatcgaatggaatggaatggactcaaatggaatggagttgaatggaatagagtggaatggaatggcaccgaatggaatggaatggaaaggaatggaatatatcgaatggaatggaatggaatggaatggaatggaatggaatggaatcgaatggaatggaatggaatggaatacactggaatggaatgcactgaagtggaatggtctccaggggaatggaatggaatgcaatgaaatggaaaggaatagaatggaatggaatccgatggaactgaaaggaaaggaatgcagacgaatggaaaagaatcaaattgaatggcatcgaacggaatgggatggaatggaaaagacccagttaatggaatggactgtaatgggaagatatcgaatgggatggaaagaaatggactctattggaatggactggaatggaatggactcgaatggaatggacttgagtggaatgaattcgaatggaatggaaacgaatggaatggaatggaatgcaatggaatggaatggaatggaatacaatggaatggaatcggatggaacggaatggaaagcaatgtacgcaatggagtgtaatggaataatatggaatggagtggaatggaatgcagtggacacaaatggaatggactggaatggaatggacacgaatggaatggactggagtggaatggacacgaatggaatggaagcgaatggaatggaatggaatgaaatggaatggaaaggaatagaatggaatggaatcaaatcaaatggaatggcatcgaatggaatggactcgaatggaatgtgctcgaatggaatggaatcgaatggattgatatcaaatggaatggaatggaaggaaatggaatggaatggaattgaaccaaatgtaatggacttgaatggaatggaatcttatagaatggactcaaaagcaatgaatggaatggggtgttatcgaaagatatcgaatggaatggaatggagtggaatggacttgaatggaatggactggaatggaatggactcgaatggaatggcctggagtggagtggactcgaatggaatggaaacgaatggaacgaatggaattgaatggactgtaaaggaatacaatggaatggagtgtaatggaaagatatcgaatggaatggaatggaatggaatggaatggaatggaatggaatggaatgcactgaattggaatggtctccaatggaatggaatggaatgcaatgaaatggaaaggaatagaatggaatggaatccgatggaactgaatggaaaggaatggagacgaatggaaaagaatcaaattgaatggcatcgaacggaatgggatggaatggaatacacccagataatggaatggagtgtaatgggaagatatcgaatggaatggaaagcaatggactctgttggaatggactggaatggaatggactcgaatggaatggacttgagtggaatgaattcgaatggaatggaaacgattggaatggaatggaaggcaattggaatggaatggaatggaattgacaggaatggaatggaatcgaatggaatggactggaatggaatagattcgaatggaatcgaatggaacaatatggaatggtacagaatggaattggaatggaatgcagtggacacaaatggaatggactggaatggaatggacacgaatggaatggactggagtggaatggacacgaatggaatggaagcgaatggaatggaatggaatgaaatggaatggaaaggaatagaatggaatggaatcagttggagtagaatggaatggaatggagattagtggaattc

SEQ ID NO: 470088 - DNA, 1225 bp, Homo sapiens
ctttttccaggggtgacccaggcctgcagggttccagtgtcacaggcaggccttgcatgagcctccacccgagcttctgctcctcctctcccacagggaacgtgatgttctcttcccggggggctgtgctagaggggaggaccccggctgccctgaccctcctgcccctggcttcccacagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagccaagggtccagccccttcagcgccagcacctctgtccccagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggtgcgaggccgggggaggcctggctagtatgtgccagttctcagggctctggcacactcaggcagggccccaccccgggattgccatacatcctcccatcctgtgcacacagctccatccgtggctgcccttgaactctctgcccttcctttgttggggtattgagtgttcttcccatggaaggcagtggggatgcctcagtgggggggtggggctgtggggaccctgggtgccagggggctgctaggccctcacctcctgccatgtgcctcccaggaggacaaggaagctgtgtttgaagtgtcagacactatgagtgccgtgctccaggtggccactggcgtcatctctacgctgcaggcaagacatcacccccctgcttctcctcccctaggtcccaggcactggggtgggcatgcggggagggtggccttgggaggaggtgaggtggggctggaggacctggggcagggaaggagaggtgtgctcgctcctgctcctggggaacagggaaaggacagaaactgctgccatgcagtggaagtaga

SEQ ID NO: 470089 - DNA, 682 bp, Homo sapiens
tgagtcgaagctccctgagacctcttcagaagcctagtagatgctggcgccaggcttcctacacagcctgcagagccatgaagatttatcctacctcctagagtctgatactaacatcaccactgctgataaaatccagatcttcactggaacactggaagagcggaaatacattgtatgtggatttccaaagaatggtgtcagaagtgtgacagtgtggaaggacagctttgtggaggagtatgtggaggctgccagagaggacatagcagccagtcattctcagctgagtgaggaccatggggagcaccagctcagggagtttctagtttccaatgagaagtattctaaagcatttccttctcatcactatagcacaaaggaaaatgtagaagcctctcaaagtttgcaaagggcactgtcactcatcaaggccaaagcaagaatgccttccatttactttagataagaaaagaataaaaagtattgtaattgctgcttgtaggcaggcattcctggcaccagtacatgatgtaactcacatgaaaccaactagggaccgttggaaatgtatgcattgtgcaatggtcatggatgctttgattctgaggattttgtttctttcagtatctttttgtatgaatgcagaagttaaagtactgaaaatagcagtgattttcac

SEQ ID NO: 470090 - DNA, 689 bp, Homo sapiens
agcagccagtcattctcagctgagtgaggaccatggggagcaccagctcagggctgaacggcctgtaccaatgccaccctgacatctcacctggcaattctgccttctcagggctctctgtctccacacctttccctacagagacaacacttgtgtctcaacaacacttgatcagtgtgttcataggtgctcctgctgatgtgagagaggatttgttccagttctattctagattaaaaagccctcatctgccagagacaaaagttctatgttccaaaggtaagaggaggccagtgttgcagaaggcccataaaggagttgcatattggaagttgaggcttggggcactctcagatttcctgagaagttgggaggaggtatattacggaaacaaggaaggcattattgaacagatgacagtgaattttatcagtcttctaatcatttttgactgtctgctgttcaccaagaactggggagggtaagagatgacaaaaagacagaatccttcccttcacataatttatatacaagtcaggagttaggacagcttgacaacttaaataaagacaatttttgattagtgtttttgtattgataataacctgcatatagagagaacatgggctcattctgattggaaggaattagaagattcatgaaaagggtcagttaaaaatttgtcacct

SEQ ID NO: 470091 - DNA, 2018 bp, Homo sapiens
gctctctcttcttcaaattctctccccaaatccgtcgcgctgcccttttcttttaatttgccagtcaggggttaatctgtatggtggtgaggatacttctaccccagggctgggcctggagggtcagtgtggagcatgctctaatcatattaagacttcagccccatctgggaccatggagaaaggggctttcagatggccaagtcatccctaaagggagcatggctgcagctgtgaggtcagcaggcttcattcccatagacctggctgccaagaagacagtgcgcccaagaggaatcaagacagtttatgactcacacagacagcaaagccatgagcagtgcggtgtcaggtccctgggcccctactccacaggtcgactgaaacagaaaggtcaggtgatggccggcttgagtgtttatctgtttttggatgatgtttttgtgctcttggtgtcctatttaagaaaccattgcctaacccaaggtcatgaagattgacttttatgttttcttctaagagttttgtagttttaactctttaatctcatagacggttaatactgaatttatagattgatattaattctatgaccatttcgtagaatttggcggttaatctaggacctgggctcttcttaatgggaagttttcttttgtttcaatttggtttttaattctaattaaatctctttacttgttataagtctattaaggttttctatttttatcttgaaccagttgtggtagttttctttttccaggaatttgtctatttcatataaattatataatttggtggcagacagttgtttatagcattctcttattctcctttttatttctgtaaggtcagtaatcttatagcttttagtggtttgagtcttctctctttttcatggacagtatagctaaagatttgtcacttttattcatcttttcaaagaaccaaacctgtgttcaaaagaacaaaaccgtagattttgttgactttattcttttatattctttatttcctttatttctactctaatcttttttatttccttccttttgtttgctttggttttagtttactcttgaggaatataagggtaaagctatatttacccttatatttctccattctctccccattttgtgatgtcattttgaggcccaacaatacacctgtatattacatatattgttttatgtaattactttttaagtaaggcaagaaaacaaagggaaagtgtgcaattatgcagtcttttgtaattacctatataagtacttttactgacacttttgtttatttgtgtggatttgaattactgtcttgtgttgcttgctttcagtctgaagaacttcctttagtacttcttgtaagtcagatttgctggcaataaattatctcagtttttatcttggaatgtctttatttcacctttatatttcaagatggttttgctggaaataagatttttggttgacagtgttttgtctttcaacactacttcattccattgccatctggcttctattatttctgatgaagttagttgttaatcttattggtgtccctttgcatgaattgtttttttgtttttttctcttgcccaaattcctatctaaggggactggggagtcatgctctacaaaccataaaaatctcatcagacaggtttttattaaatgtggcttgctttccacttgactttggtataatatcacatgacaagtagcagactctaaaggaaatattaataaaagtattttaccacaaaatatattttttaaacataccttgaaatggctgccatagtgccaacagattaaaatgaccctgcaaagccaccttttatggggaaaatttgcagctatagaaagtctccatgaatgtaaccaggtattttcccttccaggctttctcagctctaggagagattaactgagagcctgacacctttaaagtctgaaaagagtcattcaccaactattatagctctgagagctgccacccatgaggcttcatct

SEQ ID NO: 470092 - DNA, 568 bp, Homo sapiens
agatccttaatctctgttaatctgatgactataaagcaaaaggttactttaattttcattttcctgctttgtggcacctcttgttgtatagaagctattaatcataacatagtcagctttatcaaacttcagttttatgtggtttatgtttgtctgtcttgctggagaaacttttatgggccaggtgcagtggctcacgccttgacatttgaccaacgaacagttgttcctgttgatgtatggatccctgtgggcagaggatgcgaggtgaattctcacattgaagttaggggtaccattgacgggcagcggtcagacacagccgcgggtcagcagcgcttaaaaaggaggtgtctggaccatggtccggggggcggctctgagcgtcccctccgagcatccctcggtgtctcctttagccattctccttactctgctccactggtccctgaccagtcactgctgtgagagagaaaagctatccctttatgtcacttcgttgcagactttgtgactcgcaaaatattaactgactgatgtttagagacacttcatccttggcagaatc

SEQ ID NO: 470093 - DNA, 1926 bp, Homo sapiens
aggaaaaccagagacctttgtgagcccagacttgcactgatcccagcccaggagccagacatacgagacggccggggctgcggaagccctggagcagcttctatactttaaagcgcacaaatgccatgaaagcttgttagaaacggcctgcttaccaccctgaggtggcaggtctcaggcctggcagcggcccggaacaaaggccgcaggtcgacggcctggccacccagaacgctgagtccacgcccccgcccggccagaagcagctgatctcgcgagcccgccccctgctcggcgagaacagagcttactgtccctgaatcctcgctacgcctccgcatgacactaaggcagccagccagagctccagccacgcgcggcgcctggactgggccgagattcctatgaaatacataggaatccattaatctgtctactgggcagcgccggggcctgcggctgcacaggagccggagccgggagccgcgctccgccaagagttgggcagacgccccccctcccctggttgtcatgggccccctctcggggcctcagcgggcaccagccgcgggaacccccgggcctcctcgcgcccgagcctgagcgaccctcgggttctccggcgccccctccctcgccctatttttttcctgctctcgctaccgctaccgcttctgctctcggttatggcaaaagagccaccatcacccctccgggtcgaggcgccagccccccggaaatgcgggccccaccggcgatcgaggccatccctgagggcaccgggcagccggcgggcggcagactccgcctcctcaacggctaagtgcccctctcgtatcaggtggccggacacatgaacgggaaggacaaagtgggtatactgcaacactcagatggcacagctttgaaacagttacaaccacctccaaggggcccaagagagcatacggtttatgctgctgactgttctgatggtgttcttctagagctacgaaaatatttgccaaaatatggcatctgctatgatatacaaaaccagcattatggaagaagcttaacaaaaggaactacaaaggatggagtctccggattttttcataatgggtactgcttaagaaaagatgctgttgctgccagtattcagaagattgagaaaattctgcagtggtttgaaaaccagaagcagcttaacttttatgcaagttcattactattggtttatgaaagttcatctcagccaaccactacaaaattgaatgacagaactttggcagaaaagtttttgtccaaaggacaactgtcagacacagaggtactagagtacaataataactttcatgtattaagttccacagtgaatggaaaaatagaggcttaagtgggcaaaaacttgtccaagatgtatgctcgtcacaggaaaatgtatacaaaaaccatcacagtcagacttcaatgaaagttgaaaatctggagcaagacaatgagtggaaaagcatgtcacagaacatttaaatggaaatgtactttcccaactggaaaaagttttctaccatcttcccactggttgccaagagattgctgaagtaggagtgcgaatgatagattttgctcatgtgttccctagcagcacaatagatgagggatatatttatgggctaaagcatttaatttctgtacttcgaagtattttagacaattgaatcctctgttgcagtctttttaaggggtgggccaatcataatgaagaggagcagtcaatatctctgcacctttaatgctatgtaaaaaatttgtattaagttgtcattgttactcattgagagctcctgtcatctttaataacttgcaaggcaatttttacaacgattatattcatgcttatgtgtggttactgtagtctttgtcccatcttctccaaggccagcc

SEQ ID NO: 470094 - DNA, 865 bp, Homo sapiens
agactgcctctaagatcccaagatacccccccccctttttttttttttgagatgcggtctcactctgccacccaggttggagtgcagtgctgccatctcggctcactgcaagttccgcctcccaggatcccttccatgctgcttcgctggccagaaatctccacagccagaggcgcctataccgggcttcgccggggcctctggaccactgggctcgctctgcccacgcggccaagcaggcaacgcttggctgctgctactgggcctggatcccaagcctgccgccgctctgtgctcagcccgcagttggcccggacatgccgcaccagcttccaccttgagtgccggggtctgaacaaggaggacgcagcggcacctgaaaacggagatgctagcaactggcgagccccaaggggtgttacatcttttgctcagggagtctcgaggtctgagcccgcaggaagtgttacagctctctcacgttcttgccacccacagctcagcgaatggggtgtgtcacagctcctttggtcccactgcccacagttaactctgcaaaggtctttaccatggcgtgctggcatcccctctgccaacccccgccctcaaactctgaaaggaacatataggatattggacaatacacaatggaacaagtggagagacagaaacaaatggctgttgtgatgagaaagccaagagattcttgatgcaggctaagggtccaggaaaaaggcagccaacagtatatgccaacaagaaagccttgtctcctcagaaaactgtactttatttatgaggggggaaaatcaaaagcattgtagaaattgctctaatttcccataacacaaatgttataaaacca

SEQ ID NO: 470095 - DNA, 542 bp, Homo sapiens
acagtccccagagtgtgatgttccccttcctgtgtccatgtgttctcattgttcaattcccacctatgagtgagagtatccggtgtttggtgcatatgattcttttaaaagtttgtgaaggaaccaaaacaacaggcccctttgctgcaggtctcctcgagtttgctggaggtccgctccagaccctgtttgcctgggtatcaccagtggagactcagttggaaatgcagaaatcacccaccttctgggttgatctcgctttggagctgcacaccggagctggctccttgaagaagtggttgatttcaaaatgtgggcatggagaatgcaagatagtcctggagcatcttgcggtgccagaaagtgagacagtgctcaagagagaatggggccatcttaagaaggcacagaagccaacctgaaagacgttccaaaggccaaaactggaataatttaagcaacaaaataaatacaatactgaattacagcccatagaataaaatgaatatccatacgtttgaaatactgatataagcaagaga

SEQ ID NO: 470096 - DNA, 1171 bp, Homo sapiens
gcgtttcttgatgtgttctaaataaggggtcctcagaccccaggctgtgggccggtaccagcctgtggcctgttagaatccaggccgcacagcaggaggtgggtggtgggtgagtgagcatgatcgcctgagctccgccttctgtcagatcagcggccatgttagattctcataggagcacgaacccaattgcgaactgcgcaagcaagggatctaggttgcgcactccttatgagaatctacctaatacctgatgatctgaggtggagcagtttcatcccaaaaccataccccttccgcccagtctgtggaaaaattgtcttccatggaatcggtccctggtgccaaaaagaaagttctgctgccaaacttatattgaaagcatcattcttactgctttatttttctaaaaacttcatagaacaagactgctgccaaaagggcctctttgcactcaccatggccgtggctgtggtcatgcgacctttcaatggcatctctgaaagtagtttgaccctgagttgtcaaggattttggcgtctatcttctcttatcttcaaaggcattttcactaagaatttccaccccaaattttggaatccttgtaaacatctcatctatttccgccctttgctttgggattgcaggcagaaatgtgataaaggtttgaaagcaggaaaacaacaaagaaacatcaacaacaacaggggaaattatgaagcatttgcctatggtgctatctggtttgacctcagaggtcctccatatctggatatagaaatcttctgcatagatgaaaaaaaaaatggaaaaatgcagccctctgctctgctggccccaagtcctggcaagaacatgtcggtgtctctgggaactgctgaggctgaaggaaggatctgttaccagctcggctccctctcccactgaccccatgccggcggacaagtcccttgaacagattgtgccagtctgatgccagactttcaatttgactcctctccaatgaaaaaggatttaaagactgcttgtgggggtcacaggagttccaggggggctgttaggaagccagctctgcaaggttgatgcagggaacaagttggcacatgctgttttatgtcacggaagagtgacaaccaccaagaagcctttctatcgagccagttatcgaccc

SEQ ID NO: 470097 - DNA, 479 bp, Homo sapiens
tctacacatactctatcagtaacactcaccatgaaggtctgcagcttcactcccgaagtcagcaagactgtgaacccaccagaaggaagaaactcgggacacgttggaacatcagaaggaacaaactccagacacaccatctttaggaactgtaacactcactgcgaggatatttcaacgggctcccccgagcctcagagtaaacataacattcactgtgaagaaaaagcgctccccaccctgctctcacagatctacaaggccctacacaccccccaccatagtcctactctgccctgtcccactctgctccagccacactggcctcccgaccattcctggagcaccaggtgcccctccactgtcgggcctgtgccctggctgcctactcttcctgtaacatctttccccaggtacatgatggttaattgcttcatctttcaactcctggtttagatgtcatattttcaaagaaacct

SEQ ID NO: 470098 - DNA, 1971 bp, Homo sapiens
gcaccattgtcatacattacttccacaggcccagtaacaacgtatgcacattccagtggctctatatcgtcagcaaacacttggtatctttttcaggatgctgtttgcagtagtgggtcactgtcgccaaggcagtgtgagactgagagattttactctgcatttccaagtagcacctccagaattttgtctcactgagcaaacatcatatgtgaaaaatatgaaaaataggacatgcacgtgggaattcctctatattacaagtcttctggctgtccagtgcataatgttcttgaggttcctctatattgttatgcatatcgatcagaaaccaagacaaacaacacaaaacaaaccaggagatgagtcaacaccaaggaaacacaaagatgctactgagctactgagctgttttaaatgtgcaaatttttccctggagaaaagtgttatttttgaaaagggacccatgcttttggaagaagaagcattgccttgctgaggaagaagaaatcttctttctgccaccccaagttactaactttattgacataaaattataatactattctatttgtattatttcaattgtagactctccattttcttttctgatatgtagaagttgtgcattttctccctttttaagaaaattaaccttgttagggatttatacatttagttgatctttaacaagatgcaacttctggattttttcttctttgtatcttttacttcatcaatatctactctgattgttatcatttcttattatgctccttatatttatttatttattttatttagcttcttaagctacaaacttgaatttcattgattttaaaacgtttaatcttttcatatataggcacttaaatacataaattttcctattgctttggctgcatcccaccaattgtgatatattgtgatttcattattaatcagtttgaaatatataaaatttatctatgggctcatttttcaacgagttacttagaaatatgttatttaatttccaaatatttggagattttgtagtatcttagatctattgagttcccatctaattcttaccagacaccaactcagctggcaccttgattttagacttctagcctccagaatgttctctgtaaagtttcagtctcttaaaagttattgagaccttattatatccctgcatatggtccaccttggtaaatagcttgttggcactggaaaagagtgtgtgtttggcagttactgggaattatgttctgtacatagcaataacatgaagttggcatgtaatatttttctgattctctatcatccttactggttattttttgctgtaattgtttaacattgaatcttttttctaaaaatgagttaattatttataatttttatgcacaataaattattgctgataattatatgcaatgattattttatgcaatataacaattatatgcaataattatttctaataattatatgcaataagtttgctaataattatattactaattattattactattattactaataattactaataaatctaaaatgatgcaaatattatacataaattaagtaaaacgtttgcatcattttagatttatttggcagagaataaaagaaaggcaggaaaggaaagatagtcttttgggttagcactattccagtatgtaatcgtttattacatatttgtaattgcaataataattattgctaatatgtaataaacgattacatataagaatcatcatcattttagatttatttggcagcaaaggaaaagaaagataacctttcaggttagcattattctattctagtacgtaatcgtttatgtgctaacctgaaaggttatctttcctttcctttgctgccaaataaatctaaaataatgcaaatgttttacttcatttatgtttttcatgtaaaaggaataaactctggataaataacttgctgtgtgaa

SEQ ID NO: 470099 - DNA, 1299 bp, Homo sapiens
agaagagccacagaagggtttgatggagagccagagtgactagccacggtatgcatatggtacacaaaggaaccagcggtcctcgtggccacaaacatctcttctccctctcttccttaggagcattgcacagcattcaacagaatttattctggacagtatttcaccccactaaaagatcatactcttcaggatcccaggaatctaggtgtaaattctggccagtgagatttaagtgcaaatggatgcaacttgcggaaatgttccttgaaaggagaaagtatgacatttttcactactttattcacacttttgatcagaactcaaatgagatggctggacttcttgcagccactttggactatgaggaggaggttttttaccaaggcatcagtctgcattccacatggctacagagccacttccaagtcctggactcctctgctctgagcagacttacctgaggaataaacgttttcctatcctgtttaacctactgtttttcaggcctttgtaactcacagataaatctaatgtgaagtgatacatctgatatcctaataagccatcagtatttttaccctaatacaaagagtgtgaaggagtaaaataggttatgtattcatgaagaatgtgatcataatatctatacgtttaaatgaggggaaaaatacctgttaaacctttaaacaatgcatttcatttactttgtcagactcctctaagatgaaattgaacattttctcagaaaaataatactaaaacaatctcacttttggtgtaaaaaaaatcaatatccacttttttaaaactatctttactacaagactagttgtaaaaaaaaaaaaaaactttaattcagctcctattaaaagtattttagagcaaagctgctccagagaattctcaaagaaacaggaaaaacaatatcatttctctggatctacttgaaagagaattgggtgacttttacttgccctttcttctcaaaacaaatttttggactaagacaaagtacggaaaatttctatgaagtatttgatacttcagtgaatgagaaagcaagcaagctgtaaatgcagtgcaaagtgtacattcaggcttcagggatacaagaagtaataaaagttttgtgttgttgttttttgtttttaaaggcaagcactcacttggaacatttaaataaaactttaaagatagcgagtaagacattgccattttctaacaagaaacattcatcttcttgttagatgagggaactaaattgtgtccctcaaaattcaaatgtttctgaacctt

SEQ ID NO: 470100 - DNA, 1460 bp, Homo sapiens
ccctggcagcaatggccctattagcacaagaagcagataaactaacccttgggcaaaacctgactgtggtaaccttgatgaataccaaaggacatcattggctaacaaatgctagattaatcaagtaccaaagcttgctatgtgaaaatccctgcataaccattgaaatctgtaacaccctaaatcccgccaccctactcccagtatcagagagcctggttgagcataactgtgtagaggtgttggactcagtttactctagcagacctgacattcgggaccagccatgggaatcagcagactgggagttatatgtggacgggagcagcttcatcaacccacaaggagaaagatgtgcaggatatgctgtggtaactttggatgctatcattgaagccaaactgtttccacagggcacttcagcccagaaggctgagctcattgctttaactcgggctttagaattcagtgaaggtaagactgtaaacatctacacggacactcgatgtgcctttctaaccctccaagtgcatggagcattatataaggaaaagggcctgttaaactctgggggaaaggacataaaatatcaacaagaaattctacaattattagaggcagtgtggaaacctcagaaggacttctacatctcacacttctcagtccttgccaaagcagtagcacaacggtgtgttacttgccaacagcacaatgctaggcaaggcacctctgttctgcccggcatacgagcttatggagcagctccttttgaggatcttcaggtagatttcacagagatgccaaaatgtggaggtgattgcgtgtggatcaaggactggaacgtagctcctttacagccatggtgggaaagacctcagaccgtcatcctgaccaccctcatggctgtaaaggtagaaggaatcccagcctggatccaccacagccgtgtgaaacctgcagccgctgaaacctgggaggcaaaaccaagcctggacaacccctgcaaagtgactctgaggagacgacaagccctgctccagtcacacctctaagctgactggtccacgcatggccgaagcatgaggaggatcattgtgggactcattttccttaaaatttggacttgtatagtaaaaacttccactgattttccccacgtgaaggactgttctcagtgtatacatcaggttaccacggtagggcaacaagttaaaacgatctttctgttctatagttatagaatgcctaggaagtttaaaaggaacatgtttatataatgacactcagtacaagttttcctgagaatatatgaattgtttcggcaacacagaaaaattattctcattgtggcctcaaggttgcaggctcacttctttaataggaggacacagagaaatggtgcagatttaatcttcaaacacaatgggggttgtaatttttctcttccctgtgtgatttct

SEQ ID NO: 470101 - DNA, 916 bp, Homo sapiens
ggctagctttagactgatggattccacatcaaggcacagcggccccctgctctgctctgctttcagatcatgcatgtctgtgacatccgtggccttccaatgggtgaggtgtactgtgatggcagaaggacaaccagagattgtgttgatgtctcagtgtggcactgaagatctgatagcagcacgccctgtgaaggcgtctacctggacggataactggcttccctgtgttctttcctgcctaggcttttggttcctgctcattttccttggagaatttcaaatagaaatagtgtggtcggaagaaaccagaaattgtatgaatgttatgatatgtgtaaagataattgctgtcaatgaaccgccatactgtttccataaatggctgcagcaatctgcattcccaccaacagggtacaggcgttcccctttcttcacaccctcaccaacacttgctatctcttgtctttttgatacatgtaacagccattctaataagtataaagtgatatatcatgtggttttgatttgtgttgccctgatgatgatttagtgagatcattggattgtgtttgggtttcccctccctgtatcacagcaaagcagaagcaatgataaggctcatctcatttgaatcccttctctcggttatggcagtcttgtgctgcctgttgttcaatttttgaaaaccactgtttcgcatagttagttgggttttccagttgcttacattacagtaagcagtgtcgggcctcttaagtatttatttgtaaaattgctgaatgctgttgtgtgtagttgtagttcacacattatcattgtggtacagtagtccattgagtgcatttgcacaattgttggattttggctatgactaatgctagtatcagaacattttaggtaatgtgttttggtg

SEQ ID NO: 470102 - DNA, 576 bp, Homo sapiens
accaccactaaggcagaggctgcctgtgggtggagtcaactcagaggaaagtgtggccgagggatggacatagaaacccaaaggccatcaaagactcctcatcttccatttgcctctgaaagcaccaagcatccatgccttcccctctttgatattcatcccctcagtccgtatagatcagaaaatacaagttggtcacctataagtgaaacctactctaggacacatagtgaggtcctgtctcttaaaagaaacaaggaagaagaggaagaggaagaaaaagaagatgaagaagaagaagaagaagaagaagaagaagaagaagaagaagaagaagaagaaggagaaggagaaggagaaggagaaggagaaggagaaggagaaggagaaggaggaggaggagatggaggaggaggagggagaaagaaggaagaaagaggaagaggaggaggagggaggaagaaggaagaaagaggaagaggaggaggaaaaaggagtaaaaaggaaggaggaggagggaggaagagaaagaaagaaggaagaaggaaagagtaggagaaggagggaggagggaag

SEQ ID NO: 470103 - DNA, 3828 bp, Homo sapiens
tgcctgaaggcttttctccccctaaagatgtcgtggggcctggggaaccacttaaagttccttgccatgcttgcccaagaaacacaaagtgttggtgaagctgtcttagactctgatgaaaacgtaggaacatcaagagcatctgtaaaaattacagctttaatgaaacagatgaaacaggccatcaaagatgtcaggcacaaaagctgcagacctagtggggtcatcatacacttgttcatgtccttacctgttttcactgaacaggttagaaaaagaaactgctactgtctttctggatgtgtgattgctacttgggttggacttgacaacaactcggaaagatgtgtcaaaaagatagcgggaccacttatattaaagcttccaaaccaaaataccaaaagctgtgagcatactgagtatttaagtatgaataagagtgaaggtggggggtaggtttagctaaataaaagattgcttgatatcttggggttctttgaagagttttataggcttagagttcacagtttgaatgaatgacatttttttaacttttatatatggaagtttgttaacctgcatttcaattattgaataattaattatactaattacctttgtgaaaaaatttgcaccgtgagcaacctaagcttcagtcataaattaaagcttatagaattgatattgaagtaatttaaattatcctaggatgtcagtgatatttatttttcaccaaagaatgttcactttgcattaaaaaatatggagatactctggaatattagcttagtatatatcaaacaagatatgtaaatgttaaactatcaaaatgctttatgcaaagcggccagatatttacctgttatataatttttgctttgaggatttgtaaatattggcaatcaaagaaaataaaatgtgtatacattaaatgcattcttatgaggaaaacggatttctatttcaagaaattagttaagaaacaaggaagagtccattgcaaaacaaatgccgatttatcattggaaatactgcctttttaaaaagcagtttagtggaattgatatataccagaaattctatagattaaagaaagaaaattcgtcattctttaataagtgtttactaccagttttttaaattcttattctttatttacctgagaatacttaaataagtcttcaaaagcactaacaaaatcaattgaatctttcagatgtctatgaaatactttcagtaacaaaaataaatagaggcaaacaaagtacatatgggccagtattgacacaaaccaatgagaaacagaaaattcacttttattctgtttgcattttttcctcctagcaaaactctctgctacagtatttctttttaagaataaacaaaattaagatgccaaacttttccctggtttatttattaaccatgatattaactcagaattttaatacatcttttttaaagtatttaaatctttattaactacaactggtgtttggtctgtataagggatctgaagtgtagaaataagttcaatagataaaaatgagtaaattaaagttgtcactcaaaatgttggcttatttttaatccaatggatccagatatactcaaatcactttattagattttattatttattatggactatagaaactgaaataatagtattttattagaattttctaaaacagaaaacattttaaaataataaatgatttaaaataataaattataaaatcaaaaccaagcccataaatcattcataaatcattactttctctgcacttcctgatgctgcctttagaaatgactattacaatatattaaacatattagggcaaacaattcctaagatattgctttacttttctacaatattatgctacctcccactctcattgcccttgaaatatatatgtgatatatatatgtgttttatatatatatatgtgatatatatatgtgtgttttatatatatgagttaaattttattacgtggaattattaatatgaaaggcacatttttataagttagaatgtaaaaattatactatcattttaaaaaacctctaattctgacagcccatgtaaaaattgtgaaatctgcatgagatttgttttatttttattgtattacagtccacgatcaaatagaaatatattcagatgtgtctaaaattaaccttctataaatataaaaatattgacaagggaaaataaagctctactatattaaaataaataagcaatgttattgttaaactctacttaccataatttattttaatactttttaaatagatcttaaatatctaatcaatgactttgattcaattaatttcagtacaagtatttaaataagtcacaaaaacttaaacataaaaatattaagtacattattctgagttctatttcatttaggtataaaacttaaggaaaaatacttcttaaaaatgaatttaaacaaatattagtagaatatttaacatagtatttgatttaatgaaaaattacttgcaaaatggcaaaaataaagggcaaaaaaagaatttcaatttcttctggaaatttaaattactaaaataaaagactcattgtttatattgaaacattataatgtgtatattaattttaaatttaaaaactttaaaaataccatcatagtttttttataagtgaagtttctttagcattaagctatgaaaaataataactatgtcttctgtttaagcataaactgagatgaattctttcatgttttttaaaacctaaggtatagacataatttaatataatcaaatatatatatttagtgttgttagttttgaattatttggatgcaaattatatattcttacctgaaaagctcagtttttaaggaaacaactcaatatttaaataaaaatattttgcactaaaacttggaactattttgctttattttagtggcctgtgctaacttgctttttacaaagcttttgaaacaaatattagtagaatatttaacatagtatttgatttaatgaaaaattacttgcaaaatggcaaaaataaagggcaaaaaaagaatttcaatttcttctggaaatttaaattactaaaataaaagactcattgtttatattgaaacattataatgtgtatattaattttaaatttaaaaactttaaaaataccatcatagtttttttataagtgaagtttctttagcattaagctatgaaaaataataactatgtcttctgtttaagcataaactgagatgaattctttcatgttttctaaaacctaagatattattttgtcagataagttttctgtgccattctccatctcttctccctctgaaattttcttaatgtgaatatttgtttgcttaatggtatctctcataagtcttacaggcattctttgccctttatcattcttttttgtttttattcctctgactgggttatttcaacagacctatcttcaaggtcagaaattcttttttccatttaaattcatcttcttttgaagctctaaattttatttgtttaatttttttttattgaagtgttcagctccttctgtttgtttttttaatgatgtcattatctttgttgaacttctcattccgatcataaattgctttcctgatttcattgaattgtttgtctgtattctcttgtatctcactaagtttccttaagattattattctgaattcttttgcaggcaattcataaacgtgcctttctttggagacagttactggagaattattgtgtttccttaatggtattatgtttccttactttttcatatttcttgtgtctctg

SEQ ID NO: 470104 - DNA, 592 bp, Homo sapiens
tctgaactccatgtggcagacgtctgaggctacctttagctgttcattcatccacctgtgtacctaccaagcagctgggactataggcacctgtcatcacatccagctaattaagacaagagaccttgtctctacaaaagagactatgtttcctagtctggcttattttacattaagaacttgttccttttgtccattatggctaagagccaggactctttccctaaaaaaacaaaacaaaacaaaacaaaacacagcaacaagaacaataaaactacttattaaggccgaggacaggatggcttactgtctgggccattccaaacagacatcacaccatgtgtacaaaacaaaaagatcagcacaacttgtaacagtttcaccagctgactatggaaagggcagctatccgttcatttctgtccagagctcagttaaggtcagcagaaatcagctgaacctcagccaatctacaccatctacatgagtgtgaaataagttatggtgctatgagctactgaggcttggggttgtttgttacagaacacagttgcagcaacagctgactagtacattaaatgtgtgttgtaac

SEQ ID NO: 470105 - DNA, 656 bp, Homo sapiens
tggcgttaattctttgttttattgacagtcttcccaaccagaatgtattacatgcaacattattacttcaccagaaatcagactgtgatcacagtgcctatctgtgagcacaagctacagtctgcacacattttctggacattcgtaattgggcccagtggatgtatccatcgccaccaccttacctggcaatgcaatgtcaaaagtggagtgggttggggactgaatgggctctgccacactatgatccagaatgttccaactctgggttctgagggatttggttcccatgaagaactcagaaatcagcaattttgcttggaaagagtttattcaccttggatttggtggatatggaggttttgtatggtgattctgtgtttagataaatgcttaaatatgaagagcagagaaaatcactatgtcttcttgtgtatcacactttagagaggcaaagaccaggatgcaaaggataaaaagaatctggattagctctgggattttcagtaaagggaggttccggtaggatgcagtagccaggaacatgggttcttaagcgggaccacctagcactgcttcccgctgactgtattcaacatttttaagcctaaaattcccctacagaaaataatagcaattacctcattgggttgttt

SEQ ID NO: 470106 - DNA, 714 bp, Homo sapiens
cagccatgttgctcacacaaagcctgtttggtgttctcttcacacggacgcagtttgtgacatgactgcttgtttcttcaaagacagcaggagaacctctctctctcctttctgctgaaacggagtcctatgtatcataacacggtgataaggcctggacagctggcatcttggttggcattccctgctcagcaggtttggactgcaggacctctgcaaattttgtcatccagtgggccacagatgcccatcttcttcaacaaagtcaggctttcagcccagcaagttttgccagcaccttggcatgtagtttccttgctcttggtattcagtagagccgaagttccacattggtcattgagcttcatcagcagcacagtgggcaatttctactccctggctttatcctgccagcaatacagcaactcagctaacttccctaatatccaggagaccgtagctacaccctcaacatcaaggtctgtcatctcagctttggtcatgggtggacttgcttccaagattattccttctttgtgtactcagacttaaaaaatgatagaaataaatgtttgcatatggaaaataattttaataaatgtggatgtttattaacaatatatttatgtttcaatgcttggacaaattaacatctttataaatttggcattgagaaattttgcaattgccaaggaaatgacaccatagatccag

SEQ ID NO: 470107 - DNA, 1131 bp, Homo sapiens
gtcacggacatagtgttacaggacagtgcagctacaacaagaatataggaaagagtacatgaatgatatcataaaattcaagagggatagtatggtttctgtgataataatactattgaaacatttgaataagaaatttgaagttgaagaagtcaaataccatatgaagagagttgtcaaaaagaaattcatgagagaatacattctgctctgtgctggatccttccctaagcttatctcaggttttgtcaaccatggcaccattgacattttggaccagataattctctgttgtatggcctgttctgtgttttgtcaaatctttggcatcatccctggcttgaatctaccagatgccaatagcactttctcacttaagaccattgaaatatttcaagatgttgccaagtgtccctcagggttgaaggttgcccctaattcaaaccactgctttgaggcatgccatcacagagagggttgcctaagactgaatgtgtgcctcagactaatttacacacctaaatcaaattctacagtaactctgatcagtaggaaagctggtaccttaacttcctactatgtaaatttttgtctctgttaagcagtccaaactttgaaaggatgttgggtattgatcttttacaacctcaattatgaagaaagcacttatattggtttatctggttggaaaaaaaactataaatgcattataacttgattgatgggaagctaacaaagagataaaaatgttaaaagataatcttcacctccctccatattaataatttgtatgagggccacatttcactgcttaagaagactttatttcttcagatatggaatcggttggcaagttttgaaagagattggaatatagtcagagaaaggaatatattctctaagtctcactttgtctaaaaactatttctcacacagttgaaattaatggacaagagcgtaggttctaatgtcagatagccttgagtcatttattaactctgtaactgcacttaatataaatattttctctgatcttgttttcttaccttcaaggaggctaatattagtgccttttacacatttttaaaaaaaattttaagcattacattagataatatgtgccaagtactt

SEQ ID NO: 470108 - DNA, 874 bp, Homo sapiens
gctgaggcctggatgcttcctgtcggcctcagtgacactgagcctctgctggaacctgctccgggaagctctcaatgtgccctgattatctgtttcctatcagcttccactgataacgagaacctctcaaaggccggcccctgtttgcactgcccggtcgtcagccgtaggaagatgttcggtgacaggcaaggacccacccattgggcaaatgcggacgtgggccctgcaggattctggggctggtcacgcagcagggagctgctactgccagtgctactgcagctattactacctccactgctactgtggctgtcactaccaccactgccaccacagctgtcactccaccaccgctaccgcggctgtcactgccaccactgctactgcagctgtcactaccaccactgccaccacagctgtcactccaccactgctaccgcagctaccgcagctgtcactaccaccactgctactgcagctgtcactgccaccactgccaccacggctgtcactgccaccactgccaccgcggctgtcactaccaccactgctcctatggctagtactaccaccaccactgctactgaagctattactaccaccactgctactgctgttactgctgctattacactggcagtggcaatggtaacagtagtactaggaagaggagtactaggaatatgaatagtgataattaccactacttgaagtactcctcctcttcctattactactggtagtgctagtacggctagtaggggtagtaatcgtggcagtaccactactactcctagtactgctgggttgtaaatagaaaactccctagagaaaataaggtgggactgcaaagcttttatttcctgagcct

SEQ ID NO: 470109 - DNA, 1234 bp, Homo sapiens
accatctggccgcacgctaggaaaaaggtggactcgaggaagatgcaaagagggtactggggctgtatgggaacactgaccaaggtcctgagtctagaagactgccctgggaagttagagaaagaagccaccttcctgccctcctgcgtgtggtgtgaagagaggtgccttacaagcaagtgccttcatggtgaggataagctcacaggctcaaggaagaaacacaattgtaagaacaacaatggggaaaaggcaggatccaagtattttgaatcacagtcgcaagaaagagcttcaagactcagtgtggcacctggaaagctgagtcacgatgctgttggtgtgggctcacaccttgtgtgcacagtgcacatggccatgtcttgcctccagcggcagaaggcctcatactgtgtggggggcacacagcgggttgggggggttgctccacagagtaaagaaaaggctcttaccagatggagagcagatttcagatgaagatgacccaattagccttgattccagcatgtgcacagatgctatgactgaaataaagtaggaagtggcactggtgaaatgttgcataatgaaatacataggtttttattaaagaaaaatgttgagattttaaaaggcttttaaaaaaggcttttaaggctcgccccaatcgtgttattagtaatgttagcaaagaccccttttccaagtaaggtaacaggtaccaggggttaggacctgatatctttgggggggttgcatttttcagcccactataggtgtctatgtttatgtacatatgtgtgtatgggggcatatggatgtgtacatatgtgagtatgtacaggtatatgtgtgattggtatgtgtgtgtatgcatgtgtgagcgtatgtaaacatgtgagtgtaggtgtatatatgcatcttagaggaaaagctttcaacttttccctgttgagtatgatgttggctatggatttgtcgtatatagcctttattgtttgaggtacatttattttataactaatttgttgagagagtttttaatcatgaaagtatattatattaggttggtgcaaaagtaattgttgtttttgtcatttacttttaatattttgtcaaatactttttctgcatctaatagtataatcatataatttttgtccttcattgtgttaatatagaatatcatgtttattgatttacaaatattgaaccatccttgtgtcctaggggt

SEQ ID NO: 470110 - DNA, 935 bp, Homo sapiens
tacacgcactgtagattcaaattgtgtctactttaaaaatccagaaactactttcacaaccaatttgcgacccaaaagcaataaaccagggtcccaaagccaatatgaggaaggcagcaggggagggagaggatgctcccattgtttttgtgtgtgacaactcctctgactcccccagtttcccccaacctcccactccagtgtcgctgttccttgcccaggtcgacggctgtcaggtcacgtgctctcaggcccttcagtaccaagcctttccttgggccaaagcctgcatgtggtacaaaactgcaaatgctgttaattatgacaatgccctgggaccctggaaggacaaatcatcctgcccagatttcaaagaaatcccagagaggcattcttgctgttatatctccaggactccagccagcacaaatcaagaaaatggtttccaggtgcagacagtctccccctcttcccccctcactttaaaatctagtgattgttccaagctttaatctgaagatggacgatagggggaacagaaggatatagaatatcattttacattgtcaaaatataaaaatctttagattctattctataactacaatggaattttctgtatttttctaagatcaggtctaaatattttaaaacatgatgatttttgtttgtcataagattattatgtaagcattattcactgactggttacctgtttttattttggtgctgtatcattaaactcatgctttggagaatcccacaaatttattaaggcaataaaacacatacatgattttcttctcaccaacaatgctgctttgataataagtttaatatttctctttgattcaaaccaacaaatactcgttgagaaactgttatgctcatagtgttgtatttggtgctttgaggtatatataaataagatatgg

SEQ ID NO: 470111 - DNA, 833 bp, Homo sapiens
agaaaggggctcccacagtgcagcagtgggctgaagggctcctcaagtgccgccaaagtgggagcccaggcagaggaggcgctgagagcgagcgagggctgtgaggactgccagcatgctgtcaccactgccagcacgctgtcaccactgccagcacgctgtcacctctatcatcccagcaaggaatgtggcatggatgtagaaactgtagcaagttatccagcagatctaggtaagatcatggatgaaggtggctacgctaaacaacagattttcagtgtagacaaaatggccttctatttgaagaagataccatctagaaattttatacctagagagaagacagtgcccggcttcaaagcttcaaaagacaggctgatgctcttgttaggggctgatgcagctggtgactttaagttaaaatcaattcttatttaccattatgaaaactccagggcccttaaaaatgctaaacctatgctgcctgtgctctataaatggagaaataaagcctggatgatagcatgtatgtttaaagcatgttttactaaaaattttaagcccactattgagacctactactcaaaaaagaaagatttcctccaaaatattattgctcattaacaatgcgcccagtcactcaagagctctgaagatgtacagggagattaattttgttttcatgcctgctaatgcaacatccattctgcatcccatggatcaaggagtcatttcaattttcaggtcttattatttaagaatatataacatgtattttttaagactatggctgccatagatagtgatttatctgtttgatcgtaaatggaaaa

SEQ ID NO: 470112 - DNA, 531 bp, Homo sapiens
agcgcttacacgcatgcttcttgcagttggtatggtcagttgtttggattttaatcattctagtaggtgtgtagtgatatcttgtcgttttaacttcattgataacaaaagaccccctgcagaagataacagctcagggaagaagcaatcacatctaatgggacaatgtgagcccgaggaatatggagaccttggattgtgggcactgatgaagctggaaacaaattctcagcaaactaacacagaaacagaaaaccaaacactgcatgttctaactcgtaagtgggagttgaacaatgagaacacatggacacagggaggggaacatcacacactggggcctgtcgtggggaagcaggcagcacagccggaggtgagcagtgagagcattaccttctgggccccacctcctgtcagatcagcagcagcattagattctcacaggatccacaggatccccagccctactgcgagtgtgagctgcacatgcaaggaatctaggttgcgtgctccttaggagaatctaactaa

SEQ ID NO: 470113 - DNA, 769 bp, Homo sapiens
tgcaaggaggtaacctttctgctgctacatcctgacatttgcatggaggcaaatgcatcactggtaattgcacctgagtgtcaaagccacttgatgtgtgtgttccgaccaagatgcaaagaggaaactcaaagcttgagaagtctgcatacgagcctacactggggcagctttggggtgatgataccacaggaagtcaacactctggaccttgaaagaggagctctcgtcaaactcaaccatgatggcaccctgattgatcttggacatccagcatcaagaactgtgagaagtaaatttctgttgcttgtaagccacctagtctatggtactttgttagagcagcccaaactgagacacatgcttacagatttggggctatcgaacaccaaaactagatttaaagcaaggtctggggtgggtaccaagacagctttcctaagcagttcccagttgatacagctgctgctggtctggccaccactcctgggctcctctggtgtgtatgctgcagatgtcagtaaggtgtctgtggtcctgtctgctgctaaggatgaatcattcttgcaaataaaatgaatattaatacatttatatacatagtatactttatacaaatcctttgaatgttgttctaagaaataagtctggaagcaaaataagttcttaagttgacaattttgacacgtgattctgcatagtattgttaactgtgttggaatatcagaatgttatattattgtgatatgacccaataatgttagctggc

SEQ ID NO: 470114 - DNA, 772 bp, Homo sapiens
acccgagcagctgtttccgggctacaccccaagtagcaggatttgggccaagacaacacatgggaggaggaggcactcagtctgtggacacagagaggaaaacatctcaagggacaaagttcttgtccccatttggagagcaattctctccacatgaatctgccatggcacacacagcaggacttcagtcacttttgagagtctttttggacctcatcactttaagaggactccttggggctccagagcacttcctgtttaaggagaaaattggtgatacaactcttcaaatcaaagttagacattcgttgagtaagatatttagtaggatagtcaccatcttctctgccccacttctgaacgatcctggccatgtccactccagaaatgcctgggtgactgaccagacacatccttttgagagggagaggaagcacctcacttctaaaaggaaatgtacaaacgaacatggcccctttgtgtcccttcctcgaggtcagctatcagagttttccaaaataaaacattatgacatttgagaacacaaatattacagtaattatttctttactttgacccagtcttgacatgatttgctcccttggccttcagacaatattttggaaatgatgtgagcataacatgttttttcaatattgagtcataaaactatttcatgcattttaacatccttgcttgtggtttatgcaaactacagagatttgcatagttccaaacacataggcttgtgtaaagtctgtcttttactctc

SEQ ID NO: 470115 - DNA, 815 bp, Homo sapiens
cccagtgacatggagtgctccctgagactttgtcgatggaaccgtcatggaagacggatttattacgttgggattgctgaactttccacatggctgggaggcctcacaatcatggcagaaggcaaggaggatcaagtcatatcttacatggatggcaggaggtcaaaagagagcttgtgctgggcaacttcctctttaaaaccatcagatcttgggagacgcattcactatcatgagaataacacgggaaagacccgaccccataattcactcatctcccaccaggtccctcccacaacatgtgggaattatgggagctacaagatgagatttcagtggggacacagagtcaagccatatcattctgcccctggacgctttcaaatctcatatcttcacatttcaaaaccaatcatgccttgcaacagtaacttttctgcagcgccccactctgctggtaccaatttactgtattaatctgttttcacactgctgataaagacataccggagactgggaagaaaaagaggtttaattggacttacagttccacatggctggggagatctcacaatcatgacagaagcaatagtttatttaatcattagagaaacacaagtagaaattaatatatttagtaaagaaaatattcttttgtaattattttattgaaggtttgatagttggtgtctagtattgtaaagttttgtctcagaaaaggtttatggtcttttctcaaaatttatgagagatttaagttaaataagtactatattgaatattctacaacttcaaaaaattatttatgtaaaaac

SEQ ID NO: 470116 - DNA, 719 bp, Homo sapiens
ccgccatttttctttgataccaggcgggggcacccctaccgctaaaatccataatctcagtataatcatgaaaaggatattagacaaattccactggggaacatttacagaatatctgaccagcactctgttaagattatcaaaaacaagtctaaaaaactcttacagcccaggggagcttaaggagagacatcacaaccaaatgttatgtggtatcctggatgggatcctagaacagaaaaagggtatcagggttatagaacgaagctggagacatcacattatccaacttcaaactatactacaaggctacagtaagcaaacagcatgttactggcacaaaaacagacacatagaccaaaagaacagaaaagagaacccagaaataaaaccactcgcctacaaccacctgatcttcaacaaagtcaacaccttgcgtgctagggctgaagctgacttcattgtggtggataagttttttgatgtgctgctggatgcagtttgccagtattttattgaggatattcgcttcaattcaggccccttttctccaagtctgctgcagtttgctgaaatttcaccccagaccctgtttgcctgggtatcaccagtggaggctgcagaacagcaaagattgctgcctgctccttcctctggaagcttcatcccagaggggcactggcctgatgcccgcgggtctcctgtatgagctgtctgtc

SEQ ID NO: 470117 - DNA, 605 bp, Homo sapiens
ctgcttctttttctagaaacttctgaacatggtaaacgaagagtttgaactcatgatattaaagatcatatccagcgtattagtcagccagggctgtcataacaaaacaccacagactggtggcttccagaacagaaatttattttctcacagctctggaggtttgttttcccactggctgtctctacatcaggggtcaccagccctcaggccgtggactggtactagtctctggcgggttaggaattgggccgcacagcaggaggccccagcttcttgtgatcagcccatcagaacacaggggccatacccttgcctcagagactcttatctttttgcatggaagctgagtgaacagaggatcagaaccaacttggctgggtcctgggccctgcagcaccaggaattagatagatgcacggccatcaccttcacttaatttaggtctttactcaaattcattttctcagatttagcttatgtgtagtcatctattttcatatgttattgatcatttcagtctaacctttgaaattaaacttaacgctctaaacaggaatactttctgtttcctgcaggaattaatttgcatttttgtctctgta

SEQ ID NO: 470118 - DNA, 1207 bp, Homo sapiens
aactgggtcctcctccaacaagaaagacaaaaggatgtcttgtgacacaaccagataactggtgtctgtagttatgcttgctaagatttgggtgcatgatccagggagacagcatgaggaaaaagatttgacagcaattgctggcttcaaagatggaagggacccgtgggccaaagaatgcaatcagcttctagaagctgggaaaggcgtgaaaatggattctcccacagggccttcagaaagtcatgcagccatgcctacaccttcatttcagcccaatgaaagccatttcaaaatactgagtgttctaagcgggaatctcacagaggatgtgcctcatgtgaagaacaaggatggcaccatgtccaggaaggaggagatccgacatgagagcagcaaaaagaatcactgggcttatacatcttggatggagctagaggccattattctaagtgaagtaacacaggagtggaaaaccaaaaaccgttatgttctcacttataaatgggagctaagctatgagtacacaaataaaaaatttggggtacaaggtgtggtaggaagtggcactgctgatcagcaggtggagctcttttctctcattatatatttaccccaataccaccaacaacaaccatttcctccacccttgtatcgtgagttcattgggtaatgctcgctatgtctaatattcaactgagactccattcagcgccatcataaaactttatataaaaaggctttgataatattaaaactttttatcaagctgcatttgcgcagaatctataaagtctaataatgctcattttgtgcctctattcagttgaataaagttgatatttgttatatgaagatttgttgagagtaacaggtaaaatatgccgtgacatgtatataacagctgttaaaatacttagcttacatagtcatagcgcattatacacttaatttcaaattgtgtttgcataaatttacaactctgagcaaggcaggtctaggataattatacccatttagcagattagaatagtaaggccagagacattagatgaagttaactgaatacgaaaacattcttattgggacacgggattttcggctctttctaggcttcttccactataatatgttggttgttaccgatgctctgtgagtaactgttgtttccttccttaccttttttatcctgtgctgtactgaaaat

SEQ ID NO: 470119 - DNA, 584 bp, Homo sapiens
tggccatttcgtatgcactttgagtctttgtctgctcctgtgaaaaagcccattcacaggcgtgaccatttgtggagaccactgtggtctcattgtgtgcagtcatatgaagaagctattgcattttcctcttcctccattttaacccagcaccagaaggacatcaagagctttctcaatgcctttagggaaaaccctggactagctcatggtttgggtggagaagcccaaaaagctgatgataagcaggtaggaaaggcagccccctcccttcagtcatgcataacctacgctatcctgcctctggaaagtagatctatcccctccaattccatggagataatcccctccaattcagtggagtctacttttcattatggacatgtaccagcacttccaaacaatgtcagtaataaataactcctctccattggggtacactactccaaagccttcccctcatccagtgtgctacactgatgcttcagaacataacttttcaaacaaaattgcttattagtttgcagcggttaagtctttcaaagcacattttataaaaaaagcattttacagattcttgaatg

SEQ ID NO: 470120 - DNA, 1438 bp, Homo sapiens
catctatatagaggagggagaaccaatttagccttcaaatatccatccatgcctctctgtctgtatctatacagacacagtccctgcctaatgacacccccatttttcaattccttaatagccacaagccctatagaaggaaatccttggccttaccacgtactttcatttgcaggaataacttcaatggtgggtcttatatccagtgactggtgtcctcaaaagaagagaagacacagatacaaaggaaagaaggtcttatataaacagaagcagagattgaatttctgctaccacaaaccaaggaatgccgggggcttaccagacactgaaagacaagaagaatccgtcctaggaacttcagaggaacaaggccttgctgacgctttgatttctgttttctggcccccagaactctatatcattgctgttctaaaggcacaaagggagaataagcatttctcagaagacatcggcggcggtgaagctaccacatcatccatgcgtgctgaaggcttactttcaatttttccaatgcagaagaacattgtttttgaaaagaagatgatagaatgcattataatgcagctctttaatacatgggatttacgtgtgctgaaggtcaaatgatatgttctgaagctactgaaagccagtaagactgctagtagatcagttatttcagttccctcagtacagctttattgtgtttttgctttatttgtgtggtacagtgtgctttgttattatccttagggttctgattgctgttattttcatcttttcaatttgcaaaatacactaaaataaaaaacttaatgctgaaactaattttttatctaaacccacacactagccagatgtattctgtcacaccatgctagtatatgctgtttgatgttgtgtatcatagtattttttaaattgttcacatattgaatttaaatttatgcagtaaaagaaagtagagaaaatgctctcttagtttgcttttttgctgctatttatccatatcacttttttatttaaatggcaaatctccaattttgaggttttatgtgagtgcctgaaatccaagcagggtgagtggttttattttcattgtttgggaaacaaaaatgtacctctgataatttttgtctttgattactgcttcttcaaaggatttaaaccagaatgaaagcctttgaaatcttcagagatgaggagacatgagagttattctgtatgcactagataaacagatgtcttagcttttcaaaccaaacctgaaaaatataatctcaagcttcatcagaaacagaacactttttgcaggtgtattatgttttatattttactaatgtgaaatggaaaaaataatgtcattttattcctttttcttgtctaagaatttagttccaattaacatttcagaaaactttttgtttaatatctc

SEQ ID NO: 470121 - DNA, 506 bp, Homo sapiens
ctgcaacagctcgggatcctgttcgtgatgccaattgtcaggttctaacaggtctgaggggagtcgacatgagagcttctagtttcggggcctgtggatcctgggacttacagtaccctttcccctggttctcaggccttcagtcttgggctgcaagttacattagcagcccacctaagttctcaagctttggacttgggctggattataccactggcttttctggatttccagcttgtggacaacatatcatggaagttctgggcctcccactaaatgccaacatcaaaaagctagacagatctcaaatcaacaccctagaatcacaactaagagaactggagaaccaagagcaaacaaaccacaaagctagaagaaggcaagaaataaccaagatcagagtggaactgaaggaaatggaggcacagaaaaactcttcaaaaaaatcaatgaatccaggggatggttttgtgaacaaaataataaaatagaatgctagctagtct

SEQ ID NO: 470122 - DNA, 1345 bp, Homo sapiens
acctgtgagaagagttacttgggctgagtccagcaaagccataagatctcaggtacgtctttatcagcagcatgaaaacggactaatacagtaaatcgggcagggaacaagagaaatgtggatttggatccccgacccagagtccttactggggcaccatctactggagctgtgagaagagggtcaccgtcctccagatcccagaatgatagatccaccaacagcttgcaccatgcacctggaaaagtcacagacaacgccagccagtgaaagcagccaggagaggatccgtatcctgcaaagccacaggggcagagcttcccaagaccatgggaacccacctcttgcatcagcatgacccagatgtgagacatggcatcaaagatgatcattttggacctttaagatttggctgccctgctggatttctgacttgcatggggccagtagacactttgttttggctaattttccccatttggaatggctgtatttacccaatgcctgtacccccattatatctaggaaaattctacttcataatagaagtagtagcgcgtaaaacattatctatggcagtgctctctgggaaaaccagattgtatgacaatgggaaagctaaagacccaaaatatgttgatgaatgggctcagcagaatgcctgtggcctgggttcggtcacagaccctgcagaaagaattgctgatgctaggcactatgcattactctataagatcctgtcctttgctgtggaaacctggattcctctgctagcattctcagaaaaatgggttccagggagacctgttttttcaatgtgcatctgaattgatgtttcttattttttctaaagttatttttcttcattttaagattagattgagtcgtgttcttatttaataatagtaagatatgagagtcagtcaaaaacaaattgcagacacatatctcctatatcataatataaactttaaagaaagtttaaagaaagattgaagataaagggttagaaagagattaaagaaattgacgtggaagggaaggagaaaagaagaatatgtgatgatggagttattaacatcaggcttaaaatctcattttctccacttcctggctctacatccttaaagaagttagttacttctccatgctgttgcagaaagtcagggaccccaaatggagggaccagctagagcctcaggagaggaacataaattgtgaagatttcattttaatatggacatatttcagttcccaaaattaataattttataatctcttatgtctgtctttactgcaatctctgaacataaattgtgaagatttcattttactatggacattt

SEQ ID NO: 470123 - DNA, 799 bp, Homo sapiens
ctcactagcacagtggaagttaaggtggagaagaaggacatagataccatttcaaggggatcccctggtagtaacgcaaatgatgactatgtacaccattagccagcaaatagtcacattcactggtgcaagtaagctgactccttctgcctttgtacagtttttcaaaattatggccacttccagacagaaggatggaaaagagaaacaacataatgataatctccacattctttggaccactgaggttccattttctatttctctggataaagagagattggttcaaccatgtgtgtttaccatggccttggaagcccttcataatgatgacaagaactgtgatggagagaaaatcaccattatcttcaatgagcaagatgattcagaatatgagggaacacccaaggaaacaccactactacacttcactatgctttatgtattcttccgggctgggcctcaagtcttggtgaggaaatatatccgaacttcatcccctacactctgttgtccagtgcctttgcacagtgacagactgcataaccagaaagtgagtgaatttgataaaaatgtactcttttcttaaattaggtaaatagatacttaagacctaatttggttctaagttaaagtttccttacctgatttctcattttctgcttcctgctagtctcttagttttccatattgtcgtcctgtatagaatgatctattgagactgtcatgggtattaaagttaaggtatgataaacttcttcttcagtgtctccaaatgcttagaaagatattatgtatg

SEQ ID NO: 470124 - DNA, 678 bp, Homo sapiens
agtctccaggcatggaggaactgaaacaagtcatccctatacacccccctgaattcttggacaaaattaaaaggtcgttccttcagagcaccaaggagatgcacctaagtaaacgagagaaacgctctggatcactgcaaatgttcaaggtcagggaggagactagtgaggaaaagggaagtaggagtatgtggtgtctgggaaaacaattgcggacaatgtttaatgaggaaggagcaatcaactgtgtcaaacacaatttaattgatgaccccggagattcacaaatgaaaagtggccgctatcctcaagtcatctccattttggtgaggaaagaatgtaaaaagattctctccctcatgtttaacaaggaagagcagagttgggcaaaattatctaagaggctccctccctcacctgccacaaggctttggtcaagtacctttgccatgagcccagacatttttcaattgcagcaactctccgtgtcccactccagaacctcctatgctgttccattcacgttttaacctactatatcatctgtaatctcttaaagtgattcaacttactatcataatttaaattatgattgtttatatgtgcctcatttccttagattgtaaactacacgaagatagcagtttctgttgagtttatttgttggtgtaccccagc

SEQ ID NO: 470125 - DNA, 759 bp, Homo sapiens
gctgggtcatatggtagttactagttttttgagaaatctccattctgatagcagctgtacttatttacatccccaccaagagtgtataggggttcctttttgtcttcatccttgccagcatctgttattttcttttctttttataatagccattctaactgaggccaagcacagagtttgtgccattgctggaggcaaggccacatctcacagccccacacaggtaactctcaggctctggaaagcacgtgctttggatctctttttgccaggggctgtctttttggtgtactgtactgtcatttccctgggcagtagtatttcctgtgggctagaatactggggaccccacagcacctttaggtccagtcagtactgtgaagatatggaagctgtgctctccaggcaggatgcagtcccctgatggctgtgctctcacaatggcacctggctacagccacttaggtctcagttcgggggcgggcaggagagtaagcaacacagcatgagtttcctgtctgttgcagtgctcttgcagcggctccaaatcactgctcacgtgtgtcagggtttatgtgtttcctatattccttataaccattttgatctttacattctgcattgctgtctacttttatcttgagtttttgtttatgacacttaaatttctttctcactttcttttgtgtatattctatagcaatcatcttaatgattcccaaggtgtattagtctgttctcacactgctaataaagaag

SEQ ID NO: 470126 - DNA, 695 bp, Homo sapiens
tttttgtttaatgggcatagaaaacaacacacacactgtctttctctctctctctctctctctctctctctctctccctctctctctctctctctcagaggaagttgcctagcaaggaagctctcttgcattaggaatgctgcaacggattgtgacagcaccctcgaaaatgaaggtgaagagaatgcatagtcaggctgctttggtcctgctctacacagaagagcctaagaagggaagggaggaggaaccatcacctaccttaccacctcctccttctccctcagcactgccattactgggtaaagacacaaaagagaaaatggagatttcccctgagcctcctcctccaataaattggaagaaagacaagggatacactacagctatgggaccctgtcttaggcaagcagcattagaaggggagctcttagcctgcctggtgatgcaagatcaacaaggcaatcagaaagtacttcctcaaggaatgctgaacagtcctaccatgtgtcagtatcacattcaggctttgctccccagtagaaaagaatttcataattgcaaaattattcattttatggtgatattttactagcagctctaacggagccagtacttttaaatttatatgcctctgtccaaaggaatacactgttaagaggtttaatcatagcacctgaaaaagtaaaaatgta

SEQ ID NO: 470127 - DNA, 3728 bp, Homo sapiens
cttcagtctgcaggcccacagtgatgttgctgtgagtgttggttgttaatggcagccttcttctggtcctgtctgcaaatttctcttcaggctgaacaagaacagcccttggtgggagcacggacatcatctaccatctcgactcctctgagcctgaatgcaataactgatgggcaaagggatgcaaaatgcagagtctccttgcctcaagttcagaaccagttgaaagatgaatacatgaaaaaactgacggatataaaattattagcattattattaataatttatgttcatagagcagtaaaaacaactcaagatggaaacgttaagggcaacataggcaagcggtggaaaaacctttatgcaaatattagcagtgcagagtacaataatttgttaaggaaacaccatgggttggaccttaaccacgatgaggatgagtcagaaaagaagatctaatctttgggttgtagattgtgaagggattctcatcagtgaaccataagaagctttctttacctagtgaaaatacactgtagcataataacctactgtcacaacctcagccctcttgcacaggaaagcttttatacaaccagaagatatgcaatgaaaatgacaattgaatgaaatcccttcaccagtctttaaatggtccatcaggtagccaaatgtacctgaagctttgattgtcttctcaggaatctggaacaaaacactggttttaaactatttctgcaatttataagtcaccacaccaacatattcaatttgaattattttatattttccatgacaagtcatggaatgcagaacctttaattacaaaagctttaaggactcaagaaggacaaggctgttctggtacttcaagagtccatacttaacattggacttacgtcctcttgaatacagttgtttttccaatttatgaactgataactaatggagtatcattaaaaattagtataataatataatagcactgataactaatgggttattataggtaatttgattagaccaagaagttcattcaaattgtatatttaaacaagtttagtattggttgatttatcatgataatctagagcttgatttggaaaggttttttaaataccaaaggttaaaacattggatattacaaaatagaaccttaggttaccataagtcattcatttagcctaaatgataactaaaatattttctaaaagaaaaaacattattctgatagaagacagctttccaaacaagacccaatggggatagcatgaggcaaattgactctgtctcctttctttcccttccctccctttttcttttgtaagtttacttaaaagccctgaatcttcagaatagtttcatttgcctcaacaaattaactaaaaactaatactgatttttataagttttcatcaagcaataagagtttatttaaaattatccatgagcagctcaggtactcagatgtgttcttagtgactgaaaatgaacaatttaagcatctttagtcattactattaaccgagaaaacaccaccagtaaaaggcccagtataatatatatcttaagatgctccacttgcaatgattgtattgttcttttaaggcttcatttattcttgacagaaacaattatgtgaagtaattatatctaaagtcaggcagtgtgcagtgttcaatttggaaggtaaagagcattgtttgactgttgttaccaggaacattcctgacagagaacaaatgcttacatcaataggaatcatgcacttggtaatttattcttttattcgcatatgccgttatcataataagtgccaggttaaccatcttaaacacaaggacgaaattactagaataacatcaatgggggaaagcaataaagtagcagctcatcagtattttacttgcatgacttgttattttatagggctttttctttgcatgaccaaatgttgcataattgactggacagaattgttccacaagatacccaaacaagatagaaaggccaaaataaactggctaatactgtgaattgaaaacatttaatttgaccaaattcttcaaattaaatgacatgcttcttaggtataagttatgtattttctcagaaacaaaaatgaattcatttcttaaggaatatgattagacacaaattgttacctacactaatacacagttttcttgtagtttgaaagagttcaaaattcctctgaggttgtccacattataagccaaactgacatatgagtcctttacttatatccaaataactccatatgcgatgcaagtttttaaacaatttatggtatagaagaaaataaaaatattgaagtattttaccttgaatgtgtattttgtttcttttctactctgttttactcggtaaagctacttatctattaatgaattaagtaatctatttttattttatgagaaaagttcattttgctttaagagattaaaaagtatttgagtgatctgtatttatttaaagccctattctgttacaacaaaccaacaattctgcatcactatgatctccagagtagaaggtatctctaagcaatgtcttgaacataccattttgccttctcaacaaaactaattttttaaatctaatttattataaatgacttgatgcagcatacattttatttcataaaggtgtaataaggccacttcacaccaaaaggcactggctaaaataaccagatattgaaatgattttttcctttgtgtacatattttatcttcattccaagagaaagtgaacaatatatagttttataatatatagaatataatattagcttttcagagatatccttcttcctgttatacttctagcataacttccagtatgacaggaagaaggatatctctgaaaagattctagattattctagaaaatgattctagatcccacatgtgcatcaaatacatgtgagagaccttaatttgggctacatagatttctaggatccagagattacctttaggaatctgtgaactgaaacagtgtgaagtttgttgcctattatttttgtggtgtcagggtaagcaattttttggtcatattctcaaagctttatgcaccctaaacatttataatatgtatatttgtgttgtagtttttcaaattgagaaaatgtaaattcttcttaaaagtgattatatttttgcaaacaaaattatatatgctaatatttaaatcgattcttgaaatttagcaagagagatattgtgaagagaccggaaaatcttaagcattagactatctctggttgaaagaataaaaataaaatatacaaaaagttgacagaagtgtgtacttctgtgagttatactttatcccttcgagaggagagatggtatgtcaaaaactattcctttcacatataccaaaattccatgaaaatttagatggttagctaaaaaaaaaaatatttaaaagaaagatttaattgaaatattatgcattgtgtgtacacccagatccatagctatttatttccataataccaaggtaaatattcatattaggcaattccaaatcaccttgtggtgtagataaaaactttttttgtaccctaagggtattagggacgtgaaacaataaaatttctgaacattggtaaaattttccttgaaactaattctatacaactgcctaactataactatactaagattatgactatctatgtatttatttatctatac

SEQ ID NO: 470128 - DNA, 1392 bp, Homo sapiens
ccagcataagaattctgacaccatgaaaaatataaacgagacatcaccaaaggatctcactagctctctagcaatggaccctaagcaaaatgaaaacttagaaattacagataaaaaacttaaagcatggattgcaaagaagcttaatgagatccaagagaaggttgaaaatcaacacaaagaaaccatgaaaggaacccaaataaggaaggaaaatataaatatttttaagaaaaaaatagagaaagaacttccgaaaatgaaaagctcactgaaggaatttccaaatacagatgaaagcgttaacaataatctagaccaaacggaagaaagaatttcagagtctgaaagttggtatttaaaattaacccaatcgaacaaaaataaagaaaaaataatctttcaaaatgaacaaagccttcaagaaatgtgggattatataaaacaaacaaacctacaatttataggcattcctgatagagaagaaaacaaagtaagccacctggaaaacatatttaagaaaataattgaagaaaacttccctaatatctctagagaggtagacatccatatacaaggagttcagagaacacctgctagatactatacaagataaacattcccaagctatatagtcatcagattatccaaggtcaacactaaataaaaaatcttcaatgcatctggagaaaagggtcaaattacctataaataaattacctatttatgtaaaatccatttccctatagagtaaatgtgtataggttttcacatgcatctaatttgtcataagaagctttaattaactgtgtagctacccaataatccagatgacagccaaaggaaataagaaaattcttaaaaggtccaaagccattcctaaagtttctgcaaatttttagaaaacgtacattatctcagtaacctctgtcttcattctgtaccatggtgatccatagaaatgaagctttttttatgtcttcccatcccaaataaataccatgtacataattaatgagtgcaacagaatgattttcaatttttaaaaatttagtttaattgataaataataatgccacaggatccttagggtgtcacttcaccagccagaaacttgtgtggctggaggcacctctgcctgaggtttgctccagccactgggctaattcacccactcagcctagaaggctgagctcgacttgcactactggcccagatcccatgtttgccaagggtgagccaggcacagagtggcaaagggcgtgtgagtgagtttatgctatggtttgaatgtatgtattcttccaaaatttatgtattggaaattagctcccaaggaaatgctattaacagagtattgtctgtcccataatgctgcaaaattacaaatgc

SEQ ID NO: 470129 - DNA, 934 bp, Homo sapiens
ccaacagcttgcaccatgcacctggaaaagccacagacactcaatgccagccctgaaagtagacaagagtggggctatatcctgcaaagccacaggggcagaactgcccaaggccatcggactccacctcttacatcagtgtgacctggatgtgaaacacggagtcaaaggaggtcattttggagctttaagatttgactgctctgctggatttcagatttgcatggggcctgtagcccctttgtttgggccaatttctttcatttggaatgcttgtatttacccaattcctgtaccttcattttatctagtaaaagactccgatgagacaatttctcatccaactctctggagctatttactacgagcgcacagggatcaattattagaagagtatactctggtggaatttgaagaaggaagtattatcatctaaatatagagctatttaaattatctatttcttcatgagtaagcttggatagtttgtgtctttcaaggcatttaaatatttaattcaatatgttcaagttcacatccatccatatgcctatagatttattggttgtattgattttatttgaaataccagttttaatatcattgattcttctctgatgtgtttctattttctattttataaattttggtcatacattacatatttcattctatttgccttggggtgaacatctttttttgggggggagggggttctagtttttaagatttagaagtcatgaatcattacttttgctactcaccagctagtaagagaaaaagttgttacataaacctggttttatcttacatgtaaagttcattaatacaagacatcaagatatagttaaaagaaaatttaaatattaacattatttatttaataatgagatatagtctcttttaaatgtattgtatttatctttgaaaatgt

SEQ ID NO: 470130 - DNA, 4476 bp, Homo sapiens
gataagcctaaatgccacctgctagcggaattggggataaaaaggacatgtgtcagataccctgtgaattagtcctttctcatactgctgataaagacatacccaagagtagtctgaataagggtggctctcttctcacatctccactagacattgcccaagtggggacactgtgtaggggctccaaccccacaattcccctctgcactgccccagtagaagttcttcatgaaggctctgtccctacagcaggcttcttcctggacatccaggcttttccatacatcctgggaaacataggctgcactgagcagcagggctctgctcctggcccacaaaaccattctgtcctcctaggccttcaggcctgtgatggggagggctgccatgaagaagaggttcttacactgctggttgtgccttatgagggttggtcctcattgaattgcttctttaaccaaagatacacaaagtgcaacattagatagatcaattccagacctggtgaatcagaaggttcagtgtattagcaaatattcaggtcagcttcttttcacagaggcttcaaacagtagtaatttaaagaagtaaacctttttcagttctaatggtcattcagttacataattctgaattatgtgcattctattgagaattctatacattgttatatatcagaaagtcagtactataacataacatatgaagatttgtggccagtgactgttcaaatgaagattttgacatgctgtacttcttactcaaatacaatttgactcataaaataaataaaataaagaaacaacaactaaacttcctctctcttttcatcaggtcccatgttcacttctccgtctaggttggagtcaacctcacagttggctcagaaaccttgaaatctggagattttctccatcgtgaaatatattattttaggtacaccccagtgtcttttgtcctcctctttgtgtccatgtgttctcatcatttagctcctgctttggagcgtcaaaaagaaatactcataattatctgaaaaggcttttaaattcacttcctttttctgaaagaatataaacatcagacctgattttcttttcatattttagccaaaacatatattatagatatagtgcagtagaatatatgaaaatctaattgtcttctaaaaagacaaatttgccaaaatacattgctcaataatagttgtgtgggaaaatgtttttataaaaatataagttatttttgttaaaatgtaatagatttattaatgttgaactattgtcagtagcggctactgtcatagtgatgttgaaagaagctattttgtttcatcaaaacagcatcatctatcacatgaaatcgatgacaacgttttaaatgttgatattttgtatttaattaacttagatttatgtttattagagtcagaagaatatgtagtttacaagtacttttaagtttgctacatgataaagtatattataataaaaataatttaattaaaaactaaatgtccatgtgaatattttattaggtttgtacaaccttcacattttgagaaacaaatatatattcatctttaaatatatttaaagacatgctaagtgatattaattatgtaataaaagttcacattctaatagcatatttttagtgttattcaattagatactattaatcataataaagagtacctcatttaatatttatacaatattttgggagaatagaagttgaattttaccaatttattttcaatccctattagaaaaagttctaaccattttattaaatattaaatattttcactgaatgttataattgattgtactaattggctttctaacttttttattaccttgcaataaatcttatttgtctatggttatctatcattttattttacgactggattaaggtgctagtgcttttttctaatattattggctaattttttataatattattgattattttctaatattgcttttataatgttatttctctgaatgcttatttcaaaattatgctatttgaaatatataatcataaatttaatagaaaaaagttttagtcttttgtttatattgaactagattactggacatgaaaatgatcagcatcttgagaggctgagagaatttttgtgatgccatttttagatgtagttctttaaaataattaatttaacaatatcatatttattgtacacatacacttcgcatattctatttctccttaaattaattgagtaatttctctgaaaattttaatcaagtttataaaacaaatgtcaccaatggtaatctttaatttattttgtctctataaatttgcctactctggatccttacttcatataattggaattaaacaatatgtgtctttttgtgtctggattattttacttaggatgtttccaaagttcatcccaattgtagcatgtatgagaacttcattcctgtttatggctgaataataccccattgtatgtatatactacattttggttttcattcatctattgatggaaacaggagttgtttccatcttttgcctgctgtgaataattttgcaatgaactgtggcctataagtatctgtttgagtccttgttttgaattatcttgtgtatatacatagaaatgaactactgagtcacatgctaattataattttagttttctgaggaaccattaaagtgtgttcaacactggctgcaccatttttccttcccaccaacaatgcacgaagcttccaatttctccacattctcaccagcacttgttattttctgtttttatttaaaataatagccattttaatgtgtgtaaaatgatatctcatcatagttttgatttacatttccctaattactagtgatttttttcatgtacatattggccatctttatgtattctacagataaatgtctattcccgttctgtgaccattttttaattgggatgtgtgcttctgttgcggagttttggggttttcatatattctacatattaatcacttatcaagcatgcaatttgcaaatactttcactcgttctgttggttgcctttttactctactgatggtgtcttttaagctggtaattttaatgaagtccagtatgtctatttctttttgccttgttgcttatgtttttggagtcatctctaagaaataattgccaaatttaatgttctgaaggtttttccccaagtttttcttctaagagttttataattttatttcttacatttagatatttatgatagctttttacatatttgtcttatatcttacaatcgtgctcgactaacttattagttctaggaagttctgtttgtgtgttttacataatcaggaacgtctatgtagaaaatcatgttatgagcaaatagtcttatatgttttttttttctaatttgtatcccttttatttccatatttcttattgcactggctagaactttcagcactatattgaataattatagtgggagatgacaactttgccctatacccatcttagaagaaaatcatttagtctttcacaattaagcaaagggtagggtgttcgtatttctgtatattacatgctcttttatcgagttgggtaagttcctctctctttctatttttctaagaggtatttttgtttcatttagtgttgtgtgtatgtattttttgttgttattttgcattacgaataggtgtttaatcttgaaaacaaattttcttctgcatcaattagtgtgaccatccatttcctcttttacttgttaacatggtcaatagtatttattgattttcaaatgttgaaccagactttgatgactaaaataaatcctatttgctcaagaggtataattctttctatatgttggtttattttatggctaatattttattaaggatttttctcctacattcaagagggcatattggtcaatagtttaatttttgtgtattccctttgtctgactttgatatcagagtaatactagctttatatgatagattttgaagctttattttcacttctaatttttcagaaacattgtgtataattgttgtgtttctttaacaacatttggactagagggtttttttagggggagcaggaggaggtgggtggtattaaatgataaatttattttctttaattgttataaggctattcatgttatctatttcaaagtgagtgagttgtggaatttttttttttttaggaatagttttatcaaagctgtccaatttaactatgcagatttattcaaagtatcccactatacttttagtatctgcaaggtctgtagtggtatcccatatttcattcctgtgggtttttctgctacagtatggagagttactgtctagaagttttctgtgtttccaggttgctcctttcctgttcctttggctagagagaggaggtctttattaagactatttttgcttgtgcctttggtttttt

SEQ ID NO: 470131 - DNA, 668 bp, Homo sapiens
cacagaaagaaaaatccaacaggatgctcatcaatagtggactggataaggaaaatgtgatacatatactccatgggatacaatgtggccataaaatgaatgaaatcatttgcagcaacatagatggagccaaagcccctgactggggctgctgcttttctttcagagatgcactgcccagagagcaggaatctaaagaggcagtctggcaacaggggatttccagagctgcagtgagctccgtccagtccaaacttcccaggagccttgtttacactgcaagtggaaaattgcttactcaagcctcagtaatgacagacaccccttcccccaccaaactggaacatcccagattgacttcagattcctatgctggcagccagaatttcaagccagtggatattagcttcctgggctccatggtggtgggatctactgagctagaccacttggctccctgcctccagccccctttccagaggaatgaaaagttctatctcactgacgttccagtcaccattggtgttggaggtggggcctagtggaaggtgtttaggtcatgggggcaccttcccacctgaatggcttggtaccctccctgcagcaatgacttcatgtcagagctggttgtttaaaagagcctagtacctctcttgctccttcttgcc

SEQ ID NO: 470132 - DNA, 2027 bp, Homo sapiens
gtttattctcctttctgctgccttgtgaagaagatgtcttgcttccccttcaccttctaccacaactataagtttcctgaggcctccccagccatgctgaatttttccattgtcatacaaaatgagaggattcctccttgctactggacagaagttcctactgagacttctggtctctacatgggctccatgatggtgaaggctttattcatcctgagtgttgatgagagtcctgactctctaccatcttcagatacagcccacgtagagagggacaaaggagagaataggtttaagggcaaactggaggcaaatggatcagttatgaaaactgattcaaaggtaaaagagaagatgatcatggaagaacctggtggtagtgatgtaaactttagattaaatgacaaagactttgagtcaatacacctgtgggtaattaacctggttgccctccccccaagagagccatcctgcctgccaatgatcaaaggttagtcttagcaacacatgagtaaacaagttatttagataaactcccttacattattttgtacctactttaagctatctactcaaggtttgttacataggtatacatgtgccatggtgggataacattaggagaaatacctaatatagatgatgggttgatgggtacaccaaggccctcacctcttaataccatcacactgccattaagttttaacacctgcattttagagggaacacattcaaatcatagcagtgtttccaaatagtactgtccaatataaccagaaggtacaaattgattaacaaaatcctttgaaaaacttttaatatatttaaaaactgtattaaaaagatgacttagtcccaatattttgagtgtacttattacacagatcaaaatgcattgaaattttaaaaaagaaaaatcagaaataacatatggcctttggatagcaacaaaagcacaattcaaagtaattaaaatcctgactatagatgttatttaggacacagttccctttatctgttgaagttatctcctagacatatttaaatcctgagttattccatcctgtacgtagataaggcaggaaaaattcaggtgctatcctaataaaaagacacattgatgtttattaatgccttacatttgaatgatgagtgtgtggctgaagctttctgaatgtggcttcttttcatccagaaacttaaaaatgaaagacaagttatgcgtccccatacacccaaatataatggtgagacaagaattgcaaaacttatctgtacatatttgcaagtaattatactgggcacaattgcaatgccatgaaattttacagtgtgtactcacataaggttctaataaatgtaaagaatatggttcagctgcagacagaaagcttaagcaaatatggagaggtcccagtgcctcaggtgcagctcctagagaactttctcaattatagaaaatatgttttgtgtttggacagtgaattctcaggatatttctaagatacattagtcacaaaagccaaggttcaagtttactgggggatcttttataccccattagtagcataacgaatatcctgctctataaccaaagcaggttttaatgatcggtatatacattttcagtaacaaacttgacaacttacgtatcccagtagggaattttcagactttaaacaaatataagccgttgtctagtatgtttcatccctatcttggccaaagacaagtacttgagttccaggcatttctcgctatcactatagagctaccatagactatattcatattaatcctacccacttcaaaaataaaagaacagtaagcacatagcagtccctgatcctgctgcagtacaactattttcagttctctgaaaaaggaaatgtgttttcattagggcctggttcttcttcctgagagttcatttctattacattattctctcttaatatagcctgcattctctcagatcttgtttctgccctcggaaacatatttttattttccataagaaattgtgc

SEQ ID NO: 470133 - DNA, 807 bp, Homo sapiens
cctgccagaccaagtgggtggaacgagtccagcaggcccaagcaaaatgggtaaaggcaccaccggccacagagccaagagagttaaccaggttcttctagaaagggatccctttcctgttctgatggttaataccaagagtcaacttgattggattgaaggatgcaaagtattgaccctggatgtcaacagtcttgaccttggcagtgcagacatgataggcagcttgattccagtgagtgccttcagaggatgggcctttactgtggacatctatggtccaaagccaaagaaccagaagtctgatgtccaagggcaggaagagaggaagaaaacatccatcacaggagaaagaaggaagccagaagactcagcaagccagcttaccccaccttcttccctgctttattctagtctgatgtccaagggcaggaagagagaaaggagacatccatcaggggagaaagatggaagccggaagactcagcaagccagcttatcccaccttcttccctgctttattgtagccgtgctggcagtggattggatggtgtctacccacatcaaggatgagtgtctttctctcccagtccactgacccaaatgtcagtctcctctggcatcaccctcacagacaaacccagaaacaatactttactagctatttaggcatccttcaatccaatcaagttgacactaatattaaccattacaaaccttccatacagttgactttgggaggataggaatagactggttttgtttatactggttctatactggttcttgatgataacgtagaaatta

SEQ ID NO: 470134 - DNA, 2838 bp, Homo sapiens
gcagactgcaaccagaactggcagcccagttttcagacttcagactgtcgttggcttgaaagtcgagctctacaagaagcatggtgccggcatctgcttttggtgagggcctcaagctgcttccactcatggtggaaagggatgaagcccacttgatcatggtggataagctttttgatgtgctgctggattcgcagacaggaccctcagctgcaggtctgttggagtttgctagaggtacactccagaccctgtttgcctgggtatcagcagcggtggctgcagaacagcagatattggtgaaccacagatgctgctgcctgatggtttctctggaagttttgtctcagaggagtacccagctgtatctcaagctgcgtgctggaagaaccactactctcttcaaagctgtcagagagggacatttaagtctgcagaggttactgctgtctttttgtttgtctgtgccctgcccccagaggtggagcctacagaggcaggcaggcctccttgagctatgactaatttatgtatatacacatacattgatacatatatgcctaatgaatatatatgtatatatacacatacacacatatgtcttgtgtgtgtgaatatatatctgttattatatcattagctttttattagtgtttgcctcagttttttcaatgcttttaaaattctatggctttatattttgaatcttccccttataaacgatgtgtatacagtatgacaattgatattttaacatattgcttcccttgagtttaaatgctggctctgagtctcattactttgataccttaaaatagcattcaggagcctagtatactgtatgtaaaatgaggataatcatacttgcctcatcaaaggcactatatttaatacatagcaaaatatagagcacagtgtctggcccatgctaagaactcaatggatgagagctaagtcagccttatgtaatcaataaacatttaaacttacaatgtattttccaaatgtaagaactgtctttataattttaatttgaaaaaaaaaaaccagttatttaatgcagagcattttagcagcctaaaataaatagatcttattctccccctcacttgtgatgctatgtgcaaaggaataagatataaagaagtatactcaggattatctcatatgcagttcttctgaaatgaaaacataataggcatgtggggtagatgatgataaactgatttaactgttgctatcaagtactggttgattaccagaggtgaagaccttacaaggagaggctaagagttaaaataatcaaatcaggtcttttttttcatattatcatcagcatattagacatggaaaagaaaaatccaagggacgtaactgttgtagtataagaggaataaaagaaataaaattgttaacagtaagttcttaaaagaaaactctcacaaatatggcttcacctccatatacttcatgcactaattaattttttatgtctgttatggaaagagtttttgctatttaattattatgaaactttgatatgttcataaaaactattgaaaaaaccactttctccctattacccaccttgttatgtttatgttatgcaatatgatactctactgaataaaagttaataatttacagatcgtttagtatgccatctgggcttcaaaaaaatgacaacatttttgcctaaattttaatgggaaataatatgaacttttggaaacgtatctggagaattcaaactgatataagagtaagtaaataatcgtgtatagaaaattgtgctataaaagggagaattaactctaaccttctccaatttagttgcctacttttcttcacctctcctttttaaaatacaggtaacctttaatctttgactttcccttaaataaaaatgattactatttcagtagtaacactcattctatgtttgaaaaggtgcacattgagaaatactatttaaaaatttatttaaaaattattttatagttcaaaaatgaaaattttattcaattaaatttaagaaatcaatgttgaatatatattatatgaattaaaaatgctttatttctcaatttcatattacagtgtatctgactggtggaaaggtcaaagtattcagaataatatatggagaaatcataaaaaataatttaataacgttttaaacacagaaactgaaatgttcaaataaattaaactgatttattttttatatttaactttacttgcattcatggactaaacttcactttcctctttttaaaaatataattggacctaattttcaacttttttttaagaatttacaactatttgcatgagaaggatcatgtgtattttttcccttgttatattattgccagttatgctgtcctttgacttgagaatgattccctccttttctgtaaaagttcatgtaaaattgttgttttttctttcacaattagaaataatttgttagagaagcaagttaccctgaatttttatttgtttgtgggaaagacgtatacataggttaattttcttaaatacatatggaaggcttggaactactttttctggtattaattttggtaagttgcgttttttaaagaatttctgtccttcctcaaaatattccaaattatatacagtcattcataatatattctcattgtttattatacgttggttctataattatgtgtcctcttttactccaaatattagcaactgcatactcttattttttgtctgtataattgcttgattatacacttattttttatgtgtgtaattgcctgattaatttattgatgattccaaattaataactatgttttc

SEQ ID NO: 470135 - DNA, 605 bp, Homo sapiens
cttctctctctctctctgtgtgtgtgtgtgtgtgtgtgtgtgtgtgcgtgcgcatgtgtgcgttgatataaattcaaagccatgtactataatcacttacctgaattttggttcttattaaggtgctttttctttgtatggatagttgttaaatttagtgttcctgtggggagaacaatcagtggagaaaaggaagagaagatgaagaaaaatttgaaactttctagaaacttgttaaatcgttgtgaccaaaaggttgacagtgatatggacaatgaagtccaggctgaggaggtctcagatgtaaatgagaaacctactgggcactggagtaaaggtcatatttgctatgtgttagcaaagagcctggctgcactgtgttcctgctctagcaatcttggaactatgaaactgaaagagatgtttaagagctcattgatggaaaggacttgccttgtctcagatattttggactttggacttttgagttgatgctaaaataagttgtatgcatttccaaagactatattttaatagaaattattgagtcggaggtatgtaaattatatttgtatttgtgctgccaaatcaaacaccaaatattt

SEQ ID NO: 470136 - DNA, 872 bp, Homo sapiens
tgaatatagtgccctatatctcgtgagacttattcactaccatgagaacggtatgggggaaactgcccctctgattcaaattatctcccactgtgtccttctcacaacatgtggaaattatgggagtacaattcaagacgagattcagtctaatggaatcattgtgtctcctggtagaaacattcttctcttaggagctgagatttctagtcaacaagagaataaagttatgaaggcaagaagcaaaagctttcacactacagagaggatccccggagaatctccaacccaccccacaagtgtttgtgtcagatgctattgtgcagatgaggcagctggctcaggggcttgtctgggtgtgcccaaaacagactcgggggcccgcctgcacaatgggaaagtggggtggagccactgggaattcatgccttgtgcaggaaggaggagcctggcctctgcagctcctcctccctgcacaaggtggcctggtattcaatcttgaaaatatggagatattttcataaaaacaaaagcatttttatcagcaacagaatgtcaatttataaagaagaacaataccacagaaaaaaattgaaatgcaaaagaatggtgaagatataacattgacaaaaaggaaaaaatgtaatataaaaattatccatataaagtttttgaaatgatgataataataacatactgtaaataatgcatattttgaaggaataaaaaattttagaactaaagcattggaaaaagtattagtaagtcagcaagagaccgatttttgttacatcccctaaaatatttccattagtaaagtaaaggagtaaattaatattaaactctaaagtcataatagtagaatattaagg

SEQ ID NO: 470137 - DNA, 440 bp, Homo sapiens
gtgataaggcgataatgtcagagctcttgaaaatatatattttctttgagatctataaagatttttcttctagcagtaggagaccaataccactggccatgttcagctgttctggcataggcgaggaaaagtacattgttagagagaatcagcgtcggacattttttcaggtcaatgcaatgaaggaattgtttctggtttcctctcgtttgcatagacaatgtcagtgggaagatctggggctcaagggctgctgttcagattctttcatcccatggggtgctccctggatatgggtgtccaggttgtttctttctgagagcccaactgcagtgattgttatttctcttctggatctagccatccagtggagctaccatgctccaggccggtactggagagtgtctacaaagagtcctgtaatgtgatttgtcttcaga

SEQ ID NO: 470138 - DNA, 1415 bp, Homo sapiens
atgtttgtatggtcctattggatgacaattttcacatctcctgcttccccctccaaagaattctacttgtccaattctgaaaaggaacgttatggaaaagaattcagccaagaaagacaacaagaaattttgagaagagcagcaagagctttacctatctgtaccacgccagtttcaaaaactatcagatattgtgaaaaatgtcagctgattaaacctgatcgggcgcatcactgctcaacatgtgactcatgtattcttaagatggatcatcactgtccttgggtgaataactgtgtgggattttctaattacaaattcttcctgctgtttttattgtattccctattatattgccttttcgtggctgcctacagttttagagtactttataaaattttggacgaatgaactgacagatacgcgtgcaaaattccacgtactttttcttttctttgtgtctgcaatgttcttcatcagcgtcctctcacttttcagctaccactgctggctagttggaaaaaataggacaacaatagaatcattctctgcacccacattttcatgtggacctgatggaaatggtttctctcttagatacaataaaaattggagacaagtctttggtgatgaaaagaaatattggctactttcaatattttcaagcttgggtgatggttgcagtttccaactcgccttgtagggatgggtccagaacaagcttctgttacaaaccagaatgagtatgccagaagtggctcaaatcagccttttcctttcaaaccacttagtgaatccaaaaaactcttgttggacagtgaattttcactcagtggctagagaatagagctgaagaaggcatcgtcataccaggtgtatgaaaacattatagactgatgttttcaatttcatttgcaagaaaatgatcaatggaatgaaataattgaagtataacagaagacatttttttaaaaaagaaagcctttgtacagttcctgggatccacagaagcactactccagagcaggacgatgccttaatcttaagtgtccatttgtgcagcattgacttagagctacaaaagtgacttaatgttattctggaaataactcttacctgttatgagatgctataatgagctatcatcacattttaacatgtaaatgtatttttcaatacctgaattacattattagcatttcagacacatacgtactccaaaataattgattgctttcagttagtgggtggagatgaatctcagtagcatctcagctgcggaagtagcaaaatatttgctttctatttgtctccaaaatttttggcttctaggattttaatttagattgaccacttgtcattttcatatcaaatttcttttggtgtttgaagtaaatattgcagaacacttttta

SEQ ID NO: 470139 - DNA, 3634 bp, Homo sapiens
gaagcggcactgaaagactcctgacactactttgcattttactgacatgccatctcagtcacctccaacctgtaacagtttttcatacccttttattgtttttatgaccttgaatcgtttgaagatttctgcccagtacacagaagacaatagaagactagataaggtgagaatcaaaatgaagtacaatattactatgtgttacagacaaaagtttgatcttgttgaaggagattggaaaaaccttcatggaaatggtgacattcctaatgattgttcaataatgtgcagcctccagaagaaaatagcttgtgaagccatcaggtccagggcttttctttaccatggaaatgagaaaaatggaaagaagtggtttgaatctggcttagacactattgaaagaatctgcagaaatccctcctccctaaacatacacacagagaaatattgcataggttttctaaaaatggaaggagaaactaccaaactgtacagcctggatgacattaattacagagtgaaatgttaaccaacatttaaaatgatggatttctatggattgtcttcaaataattatattgaatgtcagcatatgattaatatatgaagactaatcatttcaatccacaagtggactggtatctcctacaatgatttccttttttctgatgacgggaaatagggagaatatgactcatctaaagtaaagggaacttatagaaggagagccaagtaataaaacatttcaacactgaaattttaccaatatttaacagatagatactaatatttaaaccaaaaaaggggaaatttattggaagcaaacatattacaatttcttatgctgaagggaaatgaatatctcttagaacttgcaatgtattataaatatgtgcttttatttttgtgtaaatcacaacaaaattcaaacaacaattcacttactggccagtcttcacattttcaatagaaatggaaaattggggtaggaatcaaacaagataaggagactagaaatgatgttcactttgtaccaaaaaaaaaaaaggacaagaaggaggaaaacaatatcctaggacaactaatacatattcaaatatatttcttaagtgttactaccacacacacacaagaagaaaattataattattgaggtggtggatatgttaattagcatgattttggtgatcatctcacaatgtatttaggtatcaaaatatcaagttttggccttaagtatatataattctgtcaattataactgaagaatttaatagattggaatgaaatgaaaataaaaaccaataactaatcccccccaaaattcacctatttgtgttatctatgtgtttgcaattgtgctgtgcattagttaaaatggtgaacacatatagtacttacttttattccagtgagaattgtactaagtcatacattctattgaatatagaaccagaagtctgtatacatgtaagatggaaaatagtttagtattccatgaccctattattattattattatggcatttaatatggatgacaaatttggtgcttagtataagacaagtaccattttaagaggtttgcatgtaatatttcatttaacccttacaatgaacctatatattattattgtttattagctccattttaccagtaattgaatttaagaatacagtgaagacaagagaactgcataagatttcacaactgataagtgggtgtaataagtctttgaaagccagggcattatccactggatgtgagacaacaattctaacggaaatcctcactttgttgtctgatcttgttggcctagaagaatcagaaaacaaaatctgaaactgctatgacatcagaaaatcttgaaagacaagacaataaactgctgtagaattttcaacctgcaaaagttatgcatatatatatatacataggtatactatttgtttcctagcttcctttgccacttcaaaagtcccagagattaatgttttaaaggcgacaagagcatgtcaagaaataagaacagagcttattttgtactgaggcaacagaaatatcatgttgtaaacatgtttattaaccttggcttagagagcagacagacagcctactgctgtgttaataaccaacctgaagaggacaaaatgaaaatgtaattatgtgacatcaaaagcttattgatttgtcaaaatgcaatctttcaagcattttttttactattattctgccagaattctctctcattaacctcttcatattttaacaccaggagtatcaccatttatgaaaaataaatgtaactgagataatttcagtttatcaaaagatgttaatttaaaggttttctaggaagaaaaatattaaaaattataaaaaagagtatggacactagttttatgaaagttgtattttaaagttattcatgcttgaaggagtggcaatggatatatatttcttattttatttgtttaaaggattccaggtatatatgcaatacttgctataactagggaaaagaaggccatgaccatatagtcaatttaaaaacttaaaattataaatgatattattacgtttaggtacaatgaaaggtttacctttggttttggagttattttagaaatgttcttaaagtcttaattcttaaattgaagttaatactccaaatatatatatatatatatatagagagagagagagagagagagacagaaacacagagagagagagagattaagaataaattgttatattaattaacttttcagttacttaacgacttaacattttacagaattaagttagtttaaacttttggagagaagtgttatatttaaaaacattcacatagagcaatattaatttgataaaatatgataatagcaaaaaatcagattatttaagatataattatatcttttttatttagaaagagaatttgattcatcaagccacctaaaagaaaacgagaacatgaaataaacacatatgaaaggtattaactctttcttaacctcagtctcctcgaaagcagagcctaagtcaagaccctggaccagtgatgatttagaaaatgatctctgaaagcaagaaagagaagccaaaggagttgactgaggttattccaattttggtctcgtgaattttcttttcttgacaataagccatattttctgttttgtggggattttttgacattgagaataatatgatatactgtagaaatgacgcattctgccaaatttctctgaagaatattatatttttaagaaggtagttgatttggctgaattcatactgtaactatttcttaagcaacagagagtggagtaaatttcagttcaattcctttaactttagcttacctgcatgaaacttgattatacataagtggttcatggatccataataaaatgagcaaggagtacaggtaatatgcagaaagtcaatctcacttctttgacatttctcacttttcaaaactctggttgacccaaaccctagcacatgttttttcaggacaagattgcatgttttctgttaaaactttacttcttattgtacaaactttgataagatctataaaaataagcttcagatatatttgggaactgtcacagtattcatc

SEQ ID NO: 470140 - DNA, 728 bp, Homo sapiens
aatggtgttagtgagttcaactatgtccttactgatttttctgcctaatggatatttccatttccgagagaagggtattaaagtctccaactatgtttgttacacaggtatacacgtgccatggtggtttgctgcacccatcaacctgtcatctacattgggtattactcctaatgctatccctcccctagaccccaccccccaacaggccccagtgtgtgatgttcccctccctgtgtccatgtgttctcattgttcaactcccacttatgattttccatctaacagtcaggaccctctgctgcaggtctgctggagtttgctgggggtccactccagaccctctttgcctgggtatcaccagcagaggctgcaaaacagcaaagattgctgcctggtccttcctttggaagctttgttccagaggggcacctgccagatgccagccagagctctcctgtatgaggtgtctattgatccctgctggattgtgttccagatggctcttctgtcctcccattaaacagggagattgcagaatgcaggccgtcaactgcacaaagtatttgttgttgttgttatttgtccactgatgtatgtttggatagagtgcgcttgttttatgtacaattggggagcagatgatttatgagttagatttaactcctagccaaagctcaagattacctactcttcctctaccctgaaaataaaatgtatttgggcca

SEQ ID NO: 470141 - DNA, 1500 bp, Homo sapiens
tttcaattattgtaataagcaaatgctgcatctacccttgtttcatagctctctgatagcagttacaagccttacagatttctgctgttatctcattttctttgaaaaacatgcttataaatcacacacactgacgtgtaaagacataaaagaaagtcgaccatcttcagcagatgtggtgttaactgaagaaatcggtcaacttacactagcaaaagacccatctagtgacccaataggagccgctccatggctgtggcagaagcctaacccattcatgcacctggtaacaagcatgcagtatgcaaacctaactggagactctgaaacagaacattgccctgttgtcaaccctagtgaccagggttctagagtcaattttatgtgctcagggacaaaaagaattcatgctggcctaagcccatgataacaggctaccccatgtgtggatctcactgtgcacccaacagcagccatgtaatcaatctccaaccctgattgactgtaatcctggagaaaagtccataagtctttggactcaacaagagaagaactttacctgctgaaattactatttaaagactgaaagaggtgttagctccttccaatgcacagatgcacatatctcaacaaaagcctccatgtatcattcacaatcaggccaacacaacaccataaatggtcaccaataaagccacagtaaccacccctccaaaaaatggagatctatggattgtctgaataagaattcaaaataaatcttaaagaagctcagtgaaaatgaatagtttacaaacaaaatgaatagttactaagaaaattaaaaccatgaaaaagaaacaaacagttatcttggactcgaagaatacaataaatgaaaacttaaatagcttaactgcaaaattaattaaacagaagaaataatcagtcaacttaaagacagatatatttaaaattagccagttagaacaaactaagtccaaagttagtaagaagaaaaaaagaataatactaataatcagagcagtaatatagaataggcactaccaagacaatagaaaagataaaaaaaaatgtaatcatcaaggaatatagagtccctattcccaaatttctgtgggagagcaggagcctaactttgataggctcattgtcgaaagttagaaagctcttaattttttggctcttaaaattttccagtcctagtttcaaagcaatagacttgaataaagtttatctttcatatttaaattactccagtgcaatttttgctttgacattgttttcatgtttttattttggttaacttaaatatgtatttgaatgtttacctttgactaagaaaatggcagaagcaacagaaacctttttgaatagacgtattccttcttgtggccttctactgcttcgacttcccttccagtaaagttatttacacaagcatataatttaaccatggtaatagtactatttaagaattgattcttaattgattcgtaa

SEQ ID NO: 470142 - DNA, 614 bp, Homo sapiens
cagcgccgtggagcacgctgtacaggaagcatgatgctggcatctgctaggcttctgggaaggctttaggaaagttacagacatggcagaagatgaagcagtgagtgcttcatgtgaccagaatgggaggaagaccgagtcgagagggaggagatgccacacacttgaaacaaccaggtctcataagaacgccatcaaaggaaaagcactaaagtgggaaatttgcccccatgatccaggggatctgagctcagactatccttgggtggggcttgccacggtcactgtgcgggatggaggggtggttcttgagccaatggggttcagagggaaatgtggctgcctctgtcgccagggaagtgggggaaagccggtagcagtaggcctcacccagctccctcacagttggtgtggccggcactgtccaaagaacctgcctcactttcagggcacccggattgctggggagatcagcatagctgagacatctggagatggcttgcaacaaagaagaaggacaagggctatcagtatcagccacaagagggtgccaccgtggtccctggtgacttgctctgcacaggacgccagcggccttcaccactgagaacatc

SEQ ID NO: 470143 - DNA, 646 bp, Homo sapiens
caaagactaacaaaaagccaacagcgactgttctcctgagcagtggtcgtttatctccatctgccttctcccctacctaagtgcgtgccgccacgcgatggaagattcgatggacatggacattagtgaactaaaggccaacaaagatgatcactttaaggtggataatgatgaaaatgagcaccagttatctttaagaacggtgagtttagcagctggtgcaaaggacgaattgcacgttgttgaagcagaggccatgaattacgaagggattccaattaaagtaacgctgacaactttgacaatgcctgtacatccaatggtttcccttgggggctttgaaataacaccaccagtgctcttacggttgaagtggggttcagggccagtgcatattagtggacagcacttagtagctggggaggaaaatgcagagtcagaagatgaagaggaggaggatttgaaactcttaagtatatctggaaagccttctccccctggaggtggtagcaagtttccacagaaaaaagtaaaacttgctagtgatgaagatgatgatgaagctgatgatgatgaagatgatggtgatgattttgatgatgaggaaactgaagaaaaagcgccagtgaagaaatctatatgagat

SEQ ID NO: 470144 - DNA, 762 bp, Homo sapiens
caaccctcaccccactcccacttccccaccttttggcatttcctgtctatttttccactctgcttgtccataggtatccattgtatagctcccacttgcctgagagttgaaagctctgtcttgctttctttactacaacgttctctcctttgactgagactttgcccaaaggatgcaatgccagggcaatgccacagcatctgctttcacaaaacaaatgtcatggactgggcaaggctgggtttctgttccagggcgtgacctccatggatgagcagaggctgcctcatgcccagcatctggtcactagcctcctgagtgtccatgtggactgtagcaggtacagtgtgatccagcaaccagttgaggagagctatttcgatgggaactttgagcagcactgtatcatagcatttcattttgctgaggacctgtcagcaggacacacacgggcctgtcctcatggcattgacatgcagagatgtgacttgcagccccggagactgggccctgtgctctccccaccaagtgttttgccctcctgtggggacagcagccggctgagcaggatgaaacgcccctgcctggactgcaccctgctgcccaccaccagaactttctaaacatatgcatgctctctcactcttacagacttctggggactttgtctttcctttactgcaattgttctcaactttggatgcacattagaatcacccaagaagtttcaaatctcaatgcctcaggccacatcctggacca

SEQ ID NO: 470145 - DNA, 1674 bp, Homo sapiens
gaatggtgttgaagtggtacttccggttcatgcactggaacagacaatggagcatttggcgggaccgaacaatgcttcgaaactagcccggccgcagaggacgcccaggtgatccagtcctgggaaaacggggcgttttaagcagctgtgtaaaagtagcgtctaccatggctttccttttaacgagattagtcttgcttttcccctcctctttatttcactgtctgggggccacctcttggctctcatggcctttgccaacctgcgaaggttctctggacagtgctctgaaggggattcgaaggttcagtgacccaggagcccagagacttgagcagttgtgtcaaggcaccatctgggcacaaagacacgagtctatttggaagtacacaaaggctatcagtgtcgatgttattcagactgtgagtaacagttccattcctgccaatgctgtcttcattcttccttctccagggctcatggtcatcaagtccccccagtgggacaaatactgcatatcttgtgagaaccactggattactaagatgttagcagccccatggacttcccggagcctgtccctcgtcaggaaatgtgccatctaacgcatgcacatcagttcacagtgatgcacagtaaaaccgaaagccaagggtctgattaactggcatcactgaaggctctggttttattcccatcctgggtgacctgggagcatccttcagattgtgcatctaggtgcttacagcagtgcctgaaactgcgcttagaaatttggggtgtgccagtggaggctgcagtacccatgggagtcagtgtcaattccaggttgtatccacctccatttcagggtgcactgcctgaaattcattccctgcatggaagggtggtcaagctttatataattttaatatacaacttctttcatttgtctatttatattaagataattcctttccaaagtccccaaccctgtgtagttcaaaacttactttcagttgggaataagtcagccttattcacatttcttcacctaccattcccaggcagtactgattgctgtcagttctttttctcaggaagtctgtggacttatctcagcctcttcaaaatattttctttttctgccaacctaaagctttccacaacagttttactgcacttgactgtttgcagtgcctagtatgtgttaacttattcaattctccccatggcttcttgcctctgctcaatcagttaccattcaatttttgctttccagcatccaaaaatgttgttgctacagtctcttgtctctggttcatttgtccttctggggtaatatgcttttttgaaaaaggacctcaccattacttatttgagggttcagaggaagcacaagtaaatgcttatattcaatccaacatcttttataaggagcccaaagtgagccctttgcatgtagtgtcattgactcatcacaataatcctgcactgttattatcctcatttcccagatgaggaaactgaggtactgaaaagttgaataacttgccaagaccccaccgtcaggaagtgggacagaactagaatccaattccaggcagtctgactccagcatttatcattttttctctagaagaggggaggtgctagaaatagaaaactgactgaaggtctgtttaagaagtagtt

SEQ ID NO: 470146 - DNA, 610 bp, Homo sapiens
caaggccagctcccagagaggaggatttgaactatggctaaaatacatgtctgcctcagtgaatgttacaaagtcccaagtcagatcaacaactccaacaaagtatttggtaacacagagagaagcaggaactttgatgttgtcattatgaaaatgcatccaaagacttcagaaaaaactgtggcatgcatgaaggagctgctgaagtcaatggaggaagatgtagaaagaagtgagcctgacaacaaaggcccggatggagcatgtgacagcaggtggcatttacaggaaaggctgtcggggattgaactgcatgagagaccagggagactgcttgaattcttgctgttaataaagccaattctggagaaggaggaggaggaaaagaaaccaaaacatttctataggcttgtagaaaaacagaaggctgctgctgagagtagtcagggtcccagaccaatgcggacatcgacgtagaaggataagcatactttgtggtcgtaagagatgagaatcaggttattaaaataggatcaagtctttctgtggttaccacttgttctacctggcccaccaaaatggaggtctcaatctcttggtcctgagtggc

SEQ ID NO: 470147 - DNA, 1063 bp, Homo sapiens
cactcagtgcaggaagaggtagggactcaggagcccggctggcttcacccattggatcccgcgccggggctgcaggtggagctgcctgccagtcccagggctgtgcacccgcaatcctcagcccttgggtggtcgatgggactgggcaccgtggagcagggggtggcgctcgtcggggaggctcgggccgcacaagagcccatggagcgggtgggaggctcaggcatggcgggctgcaggtccagagccctgccccgcgggaaggcagctaaggcccgtaccccctccacagctgctggcccgggtgctaagtccctcattgcccggggccagcagggctggccggctgctctgagtgcggggcccgccaagcccatgcccacccggaactccagctggcccgcaagcgccgcacacagccctggttcccgctggcgcctctccctccacacctccctgcaagctgagggagtgggctccggccttggccagcccagaaaggggctcccacagcgcagcggtgggctggagggctcctcaagtgccgccaaagtgggagcccacgcagaggaggcgccgagagcgagcgagggctgtgaggactgccagcacgctgtcacctctcaataacaacccagctagtcttatatagacagccccatttcagtgaccaggaaactgaagcttggagaacaactgtgttgcttgagaccacagaactggggttagaagaaggtctaactgaccccagagcccatgctcttcccaatatgctgtactgtctccacagcacaccacgtgccacacatttcccatttccaatccaaagatcatgcccctcacataaatcaaaccacagaccatgggagctacacacaggacactcagcaaccctctgactataattatttgatgttgcttgccacaggctgtttgtgctgcctgacaattatgtctgtgcagccagaaagcggaagagatataaaagctgacagcaatccacactacaagaatgctgaaagttcttaaaacagaaggaaaatgataccgaaaagaaatataa

SEQ ID NO: 470148 - DNA, 536 bp, Homo sapiens
tttcaaagttcttgactccaggcaggagcagatggttcagaccatggaccctggtgactgtttgggatgcagagaatcaacaaagtcaatggtgttgcattggaggtggtggaaggagacgatgacctcagggtttctggctttcccattgcggttgatagagagaagttaaatcaactgaaaaaaggaacaatggaggagaactgggtttggtggggagaagatcatatggacaattttggagatgttgagcttaaaaggactttggacattgaagagatgttaagtacacagcaagaaaaaggagagagttggagagaagtcgagggcttttctcccaaaatcctgggggatgacgtggcatcagccgtggcctatagtgcacaggccagaaactgccccctgcagctaaagcactggaacagaaacgaagaagattcatgactcagctgaagagaagtgaaaagacatagacaaacttatgctaaaatgaatatggaaaggctcaggatctagaatagctgaaataatcttgt

SEQ ID NO: 470149 - DNA, 597 bp, Homo sapiens
tcagctctcctctgttcttcgggcttggcgcgctcctttcataatggacagacaccagtggccttcaaaaggtctggggtgggggaacggaggaagtggccttgggtgcagaggaagagcagagctcctgccaaagctgaacgcagttagccctacccaagtgcgcgctggctcggcatatgcgctccagagccggcaggacagcccggccctgctcaccccgaggagaaatccaacagcgcagcctcctgcacctccttgccccagagaccgtccgagctggagccacaagccctccattcctcttggaatcttcaaccccaaggatccgggggggatcacgcgcggcgaccctaccgagcgctccgtgcgcgcccccatctctcggatcgtgttcctggctctgtcgaagctgctgagtcccgcgattcgggaaatccggcacttgtttctcaccctacaccatcacgtggaaatcattgaaaatgggaaccctggtggagtatctgggagagcacgcttgtgccgaggggcctgagctatgggacttcctccaggtccctctgtttcctgccggcgtaggggactcgtagtgtc

SEQ ID NO: 470150 - DNA, 1189 bp, Homo sapiens
gctgattcgaaggaaaacaaccctctatgcagatagcttcaattcatttcttcagtattcatgcacagtttggtggtattaaggacattcacgttgttgtgcaaccatcattgctatcccgctccagaactttttcatcttggaaaactaaaaccatgtgcccattaaaccccttcccacttctcccttcctccagcccctcaccaccgccacccactgtctctctgaatctgactactctaggcacctctttctggtggagtagcatcaggggtgtagccattcccactgcttgtgccagcgtgtccctgagccaaaggcgtttcatctcacaaattcagatgtctctctcctgctgcagacgaactgagccccccagccccaaggtgcaggcaggagctctcacagccccagagaccctcagtgtgtggaggaagtgggagggtggttcatgcacagggggtgagccttcagaagtcaaagaaaacagcatacacgctgcgtgattccatatacatatacctatacctacacctatacctacacctatacctatacctatacctatacctatacctacacctatacatatacatatacctatacctatacctatatatatacatatacctacacctatacatatacatatacctacacctatacctatacatatacatatacctatacctatacatatacatatacatatacctatacatatacctacacctacacctatacatatacatatacatatacctatacctatacctatacctatacatatacctacacctatacatatacatatacctacacctatacctatacatatacctataccatatacatatacatatacctatacatatacctacacctacacctatacatatacatatacctatacctatacctatacctatacatatacatatacatatacctatacctatacatatacctacacctatacctatacctatacatatacctatacatatacctatacctatacatatacctatacctatacctatacctatacctatacctatacctacacctacacctatacatatacctatacctatacctatacctacacctacacctacacctacacctacacctatacctatacctatacctatacctatacctatacatatacctatacatatac

SEQ ID NO: 470151 - DNA, 675 bp, Homo sapiens
ttgagctccagaaccaggaagaatccacagcctcggagcttcctgtctcaacacatgcctgacttgatgatcctcaggcagtgttgtaagactgaaagagcagacttcctgaagcacccacgaacgttagaacacgcaggcaagagtttaaactggaattcaagtctggaatccagactggaatccaggtccactagggtatccaaaggagctgtcatcgtttgctcatgctgggacctgcacttgcacccagaacaccctgacaatttctgtcagactgttcaactctcacctaccatgtatgagtgtgggcccaggtgccctgtgcccaggaagtctttcctgagccctctcgtcaaccagacccttctctcctctggaatgtacagtgcattttatgtcccaggatatggtgtcttggtgaatgttccacatgagcttgagaaggatgcatattctgctgttgttggatgatatcatttatagatatcaattatatccaggtgattggtgggaaaggatggctagggtgagctggagctggatgtttccgttctcccaggtcacttaggctgtaattaaaccctagcaagttaggctctggttgaccagtttctcctgaaagcaaaccttgttaagaagaacggagcactctgtatttcaaaatacaggtcc

SEQ ID NO: 470152 - DNA, 919 bp, Homo sapiens
tctcctctgagctgttactggacaaacgagcttctctctacacacacgtggacacactcattcaactcacaatgcgtgtaagctgctacacccctggtgaacaggccgtgaaattgccaagagctttctccatgggtgctactggcatccagcaggtagagaccagggatgctgctaaatatcctccaatgcacaggacagctcctcccaccaacaaaaaattgtccagccctcaaagtgccgagatctctcttaccgggggatgcaccaaagcccagctgttcagtgtcaatggctgccagctcccaactacatcccacacagacgggagccacctcaatgtctgcgagatttcctgtccctccttttcaatcccatcaaggcaccctctaccaatgactgatggatacagggatacaaaagcccagacacctatcttccaagaggaaaaaactctgtggtggtgccatttatgttccagagcaactgcgggatcaagctgaggctggactccagctgaaaccacatgcaacagactgaatgcttgtgccctcccaaaattaatatgttgaagctctaatcccaatgtgatgatggtattagggaggcttaagtgaaggtaatggaaatcatttctttaagtgaaaggggattaaatggtacctatgtaaattctatacacttaaaagattaatttccatcaaatgggaaatatttttctgttatactttcttacctgaaataaattcgttcatttctatgtaattttaaaaacggttttactgatagttttatctatagctttacaaattggcaatttcaatagtgaaataattactttttggtgtatccttaatgttgttaaaagtgactttaatttccggcattttcttttgcaagagttgactctggttgtttc

SEQ ID NO: 470153 - DNA, 850 bp, Homo sapiens
gtccagggcgaggctggagtgtagcaggacctggctaatgaacatactccatcctatcatgactagctcaaggatcaacctcattccgagtctcattcctagagcttcttctggagtgacagggctgctctgttgttcctctggggttgctgtgctgaggaatggtcctgagactgtcacaggccactctgcagagaggattggcctgacactgaagccagtgtatgaggaactagagctgagagaaagagagagagagagaagccaaggcctgatagtatctcttagagctttcagcagctggctgcttggcactgctccagctaattggagctggcttctcttactggtgacccaaagaggcctgtatgacatgcccggcactcaggctttgctaacgcaatgggcatcctgtcaccagcaccactgtgctgctccatccagcagttgggtcctcactgataccgccctcaccatcccccgagctgggctgaaccttgcttttactctgacaaaactagagctttctctcaaatcctctgaacaccaaggaggcaaagtcatttctgcctggttctcttgtgctcttgactggccattccctctttttccagcataaattaagtacttttcattcatttacgcaacaaatgttgatttaacactgtgctgggcatagaagatatgacagataagttggtttcacttgtatagggaaaagagttgtgcccatgtctaattagactgtgctttgtaagaaaaaaatgtatacctgtttcacttagtgagggagagagagagagagagtgcctgtgtgtgtgcgtgcacgtgcgtgagacattgaaagtac

SEQ ID NO: 470154 - DNA, 647 bp, Homo sapiens
tcgttggctgggcacagtggctcatgcctctctaaaaacatgactctttcactaccatacaacccatatcagtcctgctgtgatgaaaagatcatagaaagtaaagagcacattttccttcttcattttactggaaagttacttcactcactctttcctgtgtgcaaacgcatcgtctacacagcagcagcagcagaagacagagatacacccacattccctaacctgccattgaagctgagatttttccagatgcagatcctgcgaaaaggattcatgagaggattattgatttgggaagttcagactctaaaagcaggagctgtataccagggactggaaatgtcatatgtttttaaagatattggaagtcttccagtcctacgagccaagcagaataccacagctctgtcatctggaggaggcttccgtgtgtctctgtgccccacctataaatcaaggtatgtagcagaccagtctgcagcttcttctacaaccatttccacccttccccttcttccttgctgacacaagtttggtgcagatgccaggtggagagaccctgttcctagggaatcaggctagattgtatagtgttagtttatgtgcaaattgctttccctccatttccactctgtgttgtgcac

SEQ ID NO: 470155 - DNA, 1381 bp, Homo sapiens
aaggatcctgtgacagtataatttgaagtccggtaactttatgcctccagatttgttctgtttgcttgatattgtccctcagctgcaggtctgttggagtttgctggaggtccactccagaccctgtttgccgggatatcaccagtggagtctgcagaacagcaaatactgctgccttatccttcctctggaagctttgtcccagaggggcacctgccagatgccagccagagctctcctctatgaggtgtctgttggaccttactgggaggtgtctcccagtcaggctacacggggagatgccctgcccacagaggtggaatctagagaggcagttggccttgctgagctgcggtgggctcctcccagttcgaaattcctggcggctttgtttacacttctctcacagcttaccttggctaggaaaaggaaatcccccgaccccttgcacttcccaggtcttctttaatttcagcagtgttttatagttttcagcatacaggtcttgcacatattttgttaaatttattcctaggtattttttgttttttgatgcttttattaaatggtttggtttaaccttaattttttcagttgtttgttgctagtatacagaaatacaatgattcatacatatcgactttatatttcacaaccttgctaaattcatttattagttctagtagtttctttatcttaatgaaggttctttagaattttctatgtcatattatttgcagataaacagttttactttttccttcccaatctatatcccttttatcgccttctcttgccttatatctagggctcccagtatggtgttgaataggagttgtgaaactggatacacttgccttattcccaatcttagagggaaagcagccaggccttttaccataaagtatcattagcagtaagcttttaaaaaaataaaatagatgccctttatcagtttgatccctagtttcttgagaatttttatcataaacggatgttgaactttgataaatgtcttttctgcatccattgatatgatcgtgtgggtttttttccctttattctgttgatatagtgattaagtaatttttaaatgttgagtcagccttgcattcacaggacaaacctcatttggtcagtatatataatctttttaatatattgcttgatttgttaatattttgttgtgaattttttatttacgttcatgagggatataaattcatcatttactcttcttgtaacttctttggtttcacatgaaggtaatgctgacctcataaaatgagttgggaagtgttccttgcttctattttctagaaaagctgtaggtagtactaatatgtttattccttaaatgtttagcaatgaaaccatttgc

SEQ ID NO: 470156 - DNA, 611 bp, Homo sapiens
cccagcagctgcctctacttttgtgcctgacctttcaaggatacacgggggccagggacccacttgaggaggcagtctgaccattagcagagctcgaacgctgtgctgggaggtccgccgccctcttcagagccatcatgcagggacgtttaagtctgctgaagctgtgcccacagccaccccttccctcaggtgctctgtcccagggagatgggggttttatcttgaggcaatgccccaccctgcttcggcttgccctccatgggctgcacctgctgtccgaccagtcccaggatgaagccgacttgattgtgatggataaactttctgatgtgctgctggatttgcagagctcgagcactgtgcttggagaaccctctttgtcaggatccactgctctcttcagagccggcaggcagaaatgtttaagtctggtgaagttgcgcccacagccaccccttcccccaggtactctgtcccagggagatgggagttttatctataagctcctgactggggctgctgcctttctttcagagatgcccttcccagtgaagaggaatctagagaggaagtctggccacagctgctttgctgtgctgtgttgagtt

SEQ ID NO: 470157 - DNA, 674 bp, Homo sapiens
ggcgagagctgaaaaattacctatggggtacagtgttcactgtttggggcaccaagggcccgccctgtggttaggcgtgcagagggtcatgcctggccctgcccccaccctgccctgcccgtctggtggagggcggcaggggcaccgtgtcgggcctctcaggatgaagggcagcagcagttctgagcaggagcaggagcaggaacaggtgacccagacccaagtccgcgaggtggggaggaggcaggaggcaggaccgcacaggagccgagcctccaggccctggggaacaagccccattgtcccggacttcacttacagaacaaaaggaaggataactgtgttgagaatttcaagatggtgtccatggagccttgaagcccaagttggggggcccctaagagcgtggggccctgccggcgtacctcgccacacacctgtccagagggttgaagaagtgccagttgtgtcttacatcacaagccccaacagagatgctcattaataatagctgatgggaagtgaccgtctactgcatatcaggcatgggctgtgctaagtgatttgcacacattttcttatgtgattgtacagtcccccgggacaggtactactttggtcttccatttaaccaattaggaaggtgaggcttagagggttaggcaacttgctga

SEQ ID NO: 470158 - DNA, 622 bp, Homo sapiens
ggcacctacaaggggctttagaatgcatttcatattaggcagtggacacccacagaagagcttcaagaagttgtggggtggtgaggatggtggtggccgctggagcggccggaaggttggtagtggagagctggcagctgccactgtggcgctgaagacacatgagaaggaagagatgacatgtggaaaagatgccatgctgtggacacaaagtatgtggcctaagttcctgctgagccagtgtgctgtattgtatttaggatggcaagagaagcctgccagaaaatcacctaaggtgcttcgaaacgatgaatgggacaaatgcagcttttcatggttggtggaacaggccgtaaggatgggagagcatctccctttggttcatcagggcccactggatggacgcctgtcacaggctgtacacaacagtctgctcgttggtataaggtcctttgaaggttctgatagtacttacctggacaaagaaagagacctgaaggagtacttttatattgtccgcaaactcaagaaatagacaaaaatgtaaatgtcatcctgacattagacagatacattcccctctgtatagggccccatcccagtttttggacagccctgtttt

SEQ ID NO: 470159 - DNA, 954 bp, Homo sapiens
tcagacagctgcagccgtcaactgccaacacccatttacgctgacccctttgattagaaaatgaaaaatgccaccacacttcgggccctgtcagccgtgaggtgtgcctgtaaggctgccatccccctgcagatgcccactgccctcattccagggggtattgtccagccagagctgcaggctggtgagatcagtgttgaagcaaatgttgatgtgatgcgtaatggaggtgcgtacagaggaattgaatgtattagaaaggtgtctaagtttgagacatcaaagaaggcagtagaagaagagacaaatttgaaggatcagttgagtttgcagagtcgaaagggtattgaggtggctcagagaaaaaacagtcaggggcatccaaaagaatctacttgtccctgttcagaaggtgttggagggtggtgcatggaggcacacttggctgttggagttcgattcattgttactgtgttgttccagccctggccttgctgtctcgtagctcaccggtagccaactagcaaaattagagaaagcaaaatgttactacatttcatagattaacttaatagaagataaattcttagttgagaacatataagatttataggaaaactaagttttaaactctggattttcatcatgaactatgtcattgtgaaatatctgaactcatgtatttggttactcttcagttttaaaatgcttttcaagtgtttaaaagcaacaccaaagaatcattttacatacctttcctgtattattgcagaagttcattgtcttcctggaaatataaaagaattaaaaggccatcatctcatacattattaaacataacaaatcctactactggctaaatcaatgaaccattaaccttctcacaacacagtgtgtcgggaatcaatttcataaataatagacttttgcaatgatagtgcaaaatgggatttc

SEQ ID NO: 470160 - DNA, 719 bp, Homo sapiens
aaatcggggacatcatggggtgcagctgcagtgggggcactacccagatgatctgggggaccagggaagctcaagcctccctccttcccactgatggtcccagtcagagggaccatcagaggggcctagcagctgcctttaattttgcatgtctgagcccagactgtcctcggtgggtgggcttcctgtggctgttgtggaggatgggggtgtggttctcaggccaatggagttatgattccagggagattatgcctgcctctgctgggtcacgcaggttgccaggggactgggggaaagctggcagtgacaggccttacccaatgcccatacagccagcaaggccagtctcactcccaccatgtccccccaacagcacgagagggacatgccccaggctacaagcctccctgctgagaaagcaagcgggactttcaggtttcacgcctccccacctgcagcagcttctgtgcgcctatctgtactcccagatcacctcctctccagactctgtccaggaaactgcacaaattgtttcaaagttcagctggaagtttccttctccctgtgatctttccccagttcctctggcacccctccccaagaactcctgagagacaaaagcagaaatggcttccctggggtctgagagtgcccacggaactcttcccactgcttcccctacccctatattttgctcagctctctaaatttgtctt

SEQ ID NO: 470161 - DNA, 1023 bp, Homo sapiens
tccctgagacatcatggtgaaggtgaaggccagagtcgacagatttggtcatgttaggtgtctggtcaccagggctgcttttaactctgctaaagtagatattgtggccatcagtgaccccttcattgacctcaactacatggtctacatgttccagtatggttctacccatggcaaattccatggcactgtcaaggctgagaacaggaagcttgtcatcactggaaatctcatcaccatcttccaggagcgagatccctccaaaatcaaatggggtgatgctggcactgagtacagtgtggagtccaccagcatcttcaccatcatggagaagtctggggctcacttgcagggaggagccaaaagggtcatcctttctgccccctctgccaacaccctgatgttcgtgatgggcgtgacccatgagaattatgacagcagcctcaagatcatcagcaatgcctcctgcaccatgaattgcttagcacccctggccaaagtcatccgtgacaactttggtatcatggaaggactcatgaccacagtccatgctgtccctgccacccagaagactgtggatggaccatccaggagactgtggtgtgatagccatggggctctccagaacatcatccctgcccctagtgacgctgccaaggctgtggccaaggtcatccctgagctgaatgggaagctcactggcatggccttctgtgtccccactgccaacttgtcagttgtggatctgacctgctgtcttgaaaaacctgccaaatatgatgacatcaagaaggtggtaaagcaggtgtcagagggccccctcaagggcatcctgggctacactgagtaccagcttgtctcctctgacttcaacagcgacacccactcttccaccttcgacgctggggctagcattgccctcaacgaccactttttcaagctcatttcctggtatgacaatgaatttggctacagcaacagggtgatggacctcatggcccacatgtcctccaaggagtaaga

SEQ ID NO: 470162 - DNA, 852 bp, Homo sapiens
aggaaacggactctcccctggagagtctagaaggcaccagcctggccgaccccttggcttcagcccagtcacctctgtggacccgctgcatggaaattaattagagtcagaccatgtcccccgtggcttggctccggccccccaccccctgacaggcccgggcttgtgatgttcccctccctgtgctccctgtgtccatatgttcttgttattcagctcccacttatgagcccctctgctgcaggtccactagagtttgctggaggtccactccagaccctgcttgcctgggtatcacgagcggaggctgcagaacagcaaaaattgctgcctgttccttcctctggaagctttgtcccgaaagggcacccgccggacgccagctggagctttcctaattccctgcccagagaggaggaatctagagaggcagtctggctacagcggctttgcagcactgaggtgggctctgcccagttcaaacctcccagcagctttgtttacactgtgaggggaaaaccacctactcaagcctcagtaatggcagatgccccttcccccaccaagctcaagggtcccaggttgacttcagagtgctgtgctggcagcgagaatttcaagccagtggatcttagcttgctgggctctgtggggatgggttctgctgagctagaccacttggctccctggcttcagccccctttccaggggggtgaacagttctctctcactggtgatccagacaccactggcatatgaaaaaaaaaaaactcctgcaactagctctgttctagggcttgtttcacattctcctaacagtacattttgaagaggttatgttcttaattttaa

SEQ ID NO: 470163 - DNA, 1009 bp, Homo sapiens
agtttcaaagttggggtcctacagcagggatgcccttcagatttcggctctggagacgttttgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagaatggctatgaccgcgtttgccagtacaacactgatgatgtttttagatccatcacaaagcgaagtcatgggagagccacacttgatggtggaatataaacttggtttactgtaatagtgtggtgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccacgtgacaattaaaagcactaaagggagatcatgttaaagctcttaatttatattaaaacagtagcctttgtctttaaaaaagttgttgctcatgaatattataaaatgatctacaggtttcaattcaacctgtttctaggttttttttgtccttatgcactcatggattcttcttaaatgctttagagtctatttctacacagtacccttttgatggcctaaacctaaccattttattgagcaggacttcaatttgaaaatgactgatgtcaaaatgttaaatttaattttagcatttttcattgttatttcagagtatcaaatataatttgagatatttttgttatcataatcatagatattac

SEQ ID NO: 470164 - DNA, 512 bp, Homo sapiens
atctgagaagccatcacttctccagagttcatccttgtctcagaatattttctaaaataattcattatgaaatatagagtatacaattattttcctatgtcaccacatgtggtgttcataagaattaccactcaagttcttggtgtgattgcaaaacctgctgcttcttctacgatgttttacaataatagggactgggatgagactgtatcacctgtgaaaggagattcaacacagcagttactgaaaactctaaggcgataccgtagatgtaacgtgtctgtcattgttctgggcaaagattttatggagaaaaactcaaaagaagagataacaaaagcaaaaatagacaaatggaattatatcaaattacaaagcttctgcacagtaaaggaaacaatcaacagagtgaagagacaactgagacaactagaagaatgggagaagatgttttcaaactactcattcaacaagcgattaatatccagattaaaaaaggaactcaaatagct

SEQ ID NO: 470165 - DNA, 597 bp, Homo sapiens
gtgggtaaatgcgacatcggcactcatgagtggtgcctgccaaggttgccaggcctgggggataaaaagatggaagagaaagggagagtgcttgctttctctctccataacactccaagttttcactgaaagagggaagggaaatttcctgtccttcagaataagcaaccaactctcttcaccatccccagcttatacacctctggagcatatcctgaaccacgggaactgctttgaccctcagaatctgaaggaaaaatgccttatagctctctgcacaaaagtttggctaaattatgaaggattggttggcctcaggaaggaaccattcatttcaataaaacctggcagttggaaattttctgtaatgtttgacccatgtcaaccaaggaatacagaggttcctggagcacttcaggaaataaatcgtgtgggagtaagaagattgtgaaagaaggaaagcctctcacaggaactgatgtttacattgcatctgcagtaataaataattttttacctaaagaaagacgtttctgagccttatgagaaatataaaaccaataagacaaaagaaagcattgtctaaattgtacttca

SEQ ID NO: 470166 - DNA, 1175 bp, Homo sapiens
tgtgtcagcttctgcctaagtagatcacccagagacttaaagaatctttagcaggaagaagttggagaatttcatcaaagaggagtccccgggcaagatggccgaataggaacagctctggtctatagttcccagtgagaccaatgcagaaggcaggtgatttccgcatttccaactcagggggttgacgccagggagccaagtggccttgctcagcagatctgaccctcatggagcccagcaagctaagatccactggcttgaaattctcgctgccagcacagcagtctgaaatcgacctggacactcgagcctcctggggagaaggacatctgccattactgaggcttgagtaggcggttttcccctcacagtgtaaacaaagccgcctggaagttaggactgggtggagcccaccgcagctcaccagagcccctgtagccagactgcctttctagattcatcctctctgggcaaggagtctctgagagaaagacagcagccctagtcaggggcttatagttaaaactcccatctccctgggactgagcacccaggggaaggcgtggctgtgggcgcagcttcagcagacttaaacgttccttcctgtctaccctgaagagagcagtggaactcccagcacagtgctcgaactctgctaagggacagactgcctcctcaagtgggtccctgacccccatgcctcctgatggagagacacctcccagcaggggtcgacagacacctcatacaggagagctctagctggcatctggcaggtgcccctctgggaggaagtttccaaaggaaggagcaggcagcaatctgggctattctgcagcctctgctggtgagacccaggcaaacagggtctggagtcaaccgccagcaaactccagcagtcctgcagaagaagggcctgactgttagaaggaaaactaataatcagaaagtgatagcatcagtatcaacagaaatgacgaccatacaaaaactccaccaacatcaaagaccaacgttagataaatccacggagatgaggataaaacagcacaaaaaggctgaaaattccaaaaaccagaatgcctatactaaatatggaaaggaaaaaccggtaccagacactgcaaaaacaaactaaaatgtaaagaccatcaacatcatgaagaaactgc

SEQ ID NO: 470167 - DNA, 702 bp, Homo sapiens
aaagttacctggaaattgtgtttggcaagtagtcctcgctgccagcagctccttttgcagcagctgaagtagaaccaggcggagttgtcgagttcttggcttattggatgccgacaggcctggagcagagaaactcaattgttctaacgttctcactcctcctcaggggactgtggctgtcagtggagtaacgagaaagaggaacaaagatgggaaaagaccagcagctatttgtgaggctgtggccattcctgcctccacccccagaccacctgctgaagggagagatgttaaaaagaaccacgttttccattcctcaaagccaaacaaacacagagagtcggctgagcctctctaaatcagtgactgccaggggagtcctgtccacaggctcagcgcgctatgtcctgccctgcccacgctggggtcaagaaaggaagttttgctcatcttccaaggcccagctcagccgcccccttctccagaggcttcctccttctccaaggacagatctgctacttatttgcctcttcccacaatacttttttgaaaatcttttccacagagagccccagggatccactcgctggcctcaaggatttgtgaattcctaaaatgttgtgtggattttcgtatatgagcatctgtatgtttttatctaaggagaaaacaacggatagctttatcaggttcttaaagagg

SEQ ID NO: 470168 - DNA, 522 bp, Homo sapiens
acgaggcttccataacgtacatgtgtaaaaatcatggcaaaatgcttggcaaaccgctgactgtggtcttactgggcttaagtcaagctgttgtcagggctgtattgctttctggaggctctagagagaatccatttacttttccaacttttagatgctgtccctattccttggatcatgggaccatccctccatctttgaagccagtaatgtgggatgtctatggtgtcttgatgctgcatcttccagagacaaggaacactgtgtcctcacatggtggaaggcaggagagcaagagggatgaactccctccatggagccctttcatgagggctcctaaacccattcctgagcaaaataaatatgttcttgtttctggaattattgaagctttgaaaatggacttatcgacctcaaaccaatgggacatattcctatgtggccttctgccctgttaggttttcccagggaagtttattgatcaacatataccgtgtttatgaaaatccggctaagataata

SEQ ID NO: 470169 - DNA, 539 bp, Homo sapiens
tctggccggccggcagcagccacctggcggcagtgggagagaatggcgcagacagaaaatcttcagataccactcactgatgacacaggccatttagaacataccctccctactgacaaactgcttcagttcttatctcgtactcctgtaattatgcctacaaaagtagttccctcccccatacctaatgctttaacactgtttactgatgctcagctgtcacaaaagcactttgctaaaacctctcaagacataaaacctgcagttttatggaaaggtgtaaacactaatgaatggtgtggtccaaatgatttgctaacatggagaagaggatatgcttttgttcataccccctcaggtcctctttggattccagcacaatgcatcaaaccatattatggtatggctaggacccaacccagtaccagaaatgaagaaaatgaccctataggacccgcagccccagacaatgcggcttctgtggatgacacaggacccagacagaatgctgaagaagacaactcagaaggctaagcaaa

SEQ ID NO: 470170 - DNA, 657 bp, Homo sapiens
gtgtgcttagtccagctgcagcctcacagagagccagctaccatgccagcacctggagctgccttcccggaggcagcagctggcgtgtctgactgtgcggtggccagaccctacaatcattcacacccaccccccccaccccccactgctccacacctgacttgcagtctcccttggaggcgtgggatccaggccagtagtgagacccttgaggttgtccacacgatacttattaagcacgcagcagtgtacaaaccacagaaaacatggcatctgtcacgcaaactacctgagaagacatgtctactcagcaaccggaaccaggcattccaattctgcagaaataactgctctacccttaaagatttacatgccacttttccaacagagctctggctatcaactcattgtcttggttgtgtggtggtgattggggaacaaagattcatcaataactagatttcaaggatgagatagggtgggttaaatcaagacattaacaaccaggagatattgtaaactggaaccagtatctgcttgtacatatagtaatcctattgaagtaacttttgtgaaaaacagcaactctcccctagtttaaataacagatgatagatgattgaaggaggaggaggaggaggaggaggagggagaaat

SEQ ID NO: 470171 - DNA, 1616 bp, Homo sapiens
tccaagattgggcagctgcatctgggatcctgttgcagctctgcctcagccagtctgtgcacagagcatggagcaccagggccatggagcatgtgggctatggaatcgggttgcctattttcatcttgactccatcacttgctgggcaaccttgactcaatgaatgacatcataaaaatggaacattcaaatgagaatgtccaaggacctgctgacttcactgatgaattctaccaaatatttaaagaagaactcatattttccaaaaaaccaaagaggaaggaatacttccaaactctttttacaaggcaagcattaccctgataacaaaactagacaaggacactgcaagaagagaaaattatagtccagtatgcttcaagaacataaatgcaaaaatcttcaacaaagtaccagcaaaccaaattcaatagcacattagaaagaccattcaccgtgattacatgggatttaaccctagggtgcaaggatggctcaacatatgcaaatcaataaatgttatacaccatattaacagaagggataaaaaccatatgatcatctcaatagtttcagaaaaagcatttgacaaaatgcaacattttttcctgattaaaaactctcaacagattcggtatagaagaaatgtacctcaacacaatgaagcccatatactgcaaacccatagctaacatccaactcagtggtgaaaagttcagagatttttcctctaatatcaggttcaagaccaggatgcccactctcatcacttctatttaacatagtactggaatttctagccagagcaattagacaaaggaaggaagtaaaagatgccaagaacacacaatggggagagaagactttgctaagttgtgctcagaaaactggatattcacatgcagaagaataaaattagacccccgactgagatgtcacccaacatcctgcctttctaataggccctctggtgatgctgatggtccaaggatgacacttagtaaaagtgctccccgaggatgtgcctacgctgaagtctcaagaagatcatgcctttcccataagaagcccggggaagaagcttatgactttccagcagggaaaggcagcggcaagctgaatgctcaggtggttttgccttttctccccatcaatggcaagttggaaggtggagctggtggcttgttccactctgttcagctcagctggtgtttattgcctatctgctctgggcccaacactgctaagtatatggatctctgggatccagggttcttctgtcttgttgtttcactggacatggctttcttactcaaagaacttcatcatccaaaatggctacaggaactccagccatcagatccacattccagctagctggaaggaggcaggtgggttggtaaagcaactcctctttttaaggaacttcttggaagttgcattcactgttatgcttaacagatgcattcaatttaaaatattataatcaacttgctttttttttgcataagaacatactttttatgtgaaggtttccagtccaggtgctagactggaaagttttccagacaaaagcatgaataactttggaaaatggctgttaggaacactcatga

SEQ ID NO: 470172 - DNA, 872 bp, Homo sapiens
ctgtaagggtctggcagagggtcctacgcccacggagccttgctcactgctggcacagcagtctgagatctaaatgcaaggcggcacgagtctgggggagggatgtccgccattgctgaggcttgagtagtagcctaactggggagacacctcccagtaggggctgactgacacctcatacagccaggtgcccctctgagatgaagcttccagaggaaagatcaggcagcatcatttgccgttctgcaatatttgctgctctgcaacctccactggtgacacccaggcaaacaggatctggagtggacctccagcaaactccaacagacctgcagctgagggtcctgactgttagaaggaaaactaacaaacagaaaggacatccacagcaaaaccccatcaacaaacggctaaatagaataaatagcgtagagaagaccttaaatgacctgatggagctgaaaaccatggcacaagaactatgtaacgcatgcacaagcttcagtagccgattcgatcaagtggaagaaagggtatcagtgattgaagatcaaatgaatgaaatgaagcgagaagagaagtttagagaaaaaagagtaaaaagaaacaaacaaagcctccaagaaatatgggactatgtgaaaagaccaaatctacgtctgattggtctacctgaaagtgacagggggaagggaatcaagttggaaaacactcttcaggatattatccaggagaatttccccaacctagcaagacaggccaacattcaaattcaggaaatacagagaatgccacaaagatactccttgagaagagcaactccaagacataattgtcagatacaccaaagttgaaatgaaggaaaaaatgtt

SEQ ID NO: 470173 - DNA, 990 bp, Homo sapiens
cctgaaatatgcagcattggcttcaggtgacagcgatggtgatggagccctgagtaggtggaggacatggtgaccctggcatgtagtgaggtagcatttggcctcaggggcaataacttggaagacagtgttcactgtccttctcagaaagacccaggtgcacgttgtcatggttttgaaggtgtcgctaaagtcacctcctccaggaagccctccagggcttctgctgctcatgttggtcttgccctccacagagagaagagcctgacgcccaccaggatggatgagatgcttccttacctgaaccaagccccagctctcgccgctccagcccagcatcctgaggagctgcctgactcgtacctgcctataaaaggttccctgattatggaggctgaaaagtcccatgatgagctgcctgcaagctggaggactggggaggcccggagcatggctcagtccaagcctgaaggccttagacccagggaagctgatgatgttactctcagtccaaggccgcaggcttgagaaactgcggctggttgacatttatttgatttatcaaatgaaaattttaccaaagaatctttcatgctagcagagaaaagcaaatcaagtcatacattctcaataaatggaaaagcccaggtgacaggatgatatttcacaacaacatttgagatgatgccgtggaaagctgcgagtgtatcctttctatagacttgaaaagtgactaacattctgctaaagctggaaggatgttttggggtgagcgaccataacaataatgtaaaatgttatatgattcactttgaaatgaccctttctaaagtaacaacttggattgctaaccagcattgggttcttttaaaaaactgatttggatgtttatgtgtccctctctcaatcaattcataaatttgttgaccgtgaggtttggtgtgatgaagataaatacaccttcgtagtgtagagaaataactagaaaac

SEQ ID NO: 470174 - DNA, 494 bp, Homo sapiens
tgtgatgtgacagcagtgggcattttccatctggtcaacaaaatgaccttgctcatccagatggcaaataaagatgatgaagatgctgttttctatctatatttttttgaagatgccccaaatggctctctgctttgtgagtgctacacctgggtggaatcacccctctcctctttcacagttgagagtcagcagctagagactgtaaacaatgacctaagaactagaaatggcaaaggacagaatgcacaaccccaagagaggagctctgtgcccatgaatgtgattaagaccttaagaagtcttggagtggattcttacattgaattagatgctctacatgactcattacaaaccagatatcatggtcctctgattccagccatggcgactgcagtgttcccgggagaccactggctgctgtccagtgagtgcactctcctgggaatggttccccacggccctggaacacacagagtggccatgccttaatt

SEQ ID NO: 470175 - DNA, 547 bp, Homo sapiens
tccctgactctacgcagtcgcaaaacatgatcactaagaaaaatcctaacaaggcagaaataggggaacaggaggaaatcaatattatacctctgcttttgctgaggcaaaaacagaggcaagaaatgatgactttgacattccagcccccagtatgctgcctgcagggtgctttttggtttgagaatgagtgttctacatactggcctgtaaggcagtgctactccaagtgtggtccacaggctggcagcaacatcataggggagtatgttaacaatgctgattctccagccccagctccggactctgttttaacggtctatccagtgctgcttcttcagcaaagtggtatttatgaagtcccaagatggcctttgcagcccatgaatcactgtgactctatacacttctgtgaatgcctggaccctggcaggaggtgcccactgggtaaagattagttaccagtcttcccagaagggttaatgactcttgcagttcttactgcctgtgacatatgcccaagacaatggagatctagaagggatag

SEQ ID NO: 470176 - DNA, 982 bp, Homo sapiens
ttgatatagagagtgatagaggatgctgccttggtcagcaccctcagctgcaggtctgttgcagtttgctggaggtccactccagaccctgtttgcctgggtattagcagcggaggctgcagaacagcagatattggtgaacagcaaatgttgctgcctgatcgttcctctggaagttttgtctcagaggagtacgcggccatcctcctcaatggtgggtgcccctcctccaacttcgctgccaccttgcagtttgatttcagactgctatgctagcaatgagcgaggctccatgggcataataccctcagaggcatgcacaggatataatctcctggtgtgccgtttgctaagaccgttggaaaagcacagtattagggttggagtgacccgattttccaggtgccatgtgtcacccctttctttgactaggaaagggaattccctgatcccttgtgcttcccagataattcaaggatactgtgaacacctttatgcacacaaactagaaaatctagaggaaatggatacatttcggaaaacatacaaccatcctagattaaatcaggaagaaatagaagccctgaacagaccaatagcaagtagtgagactgaatcactaataaagaaaaattgccaacaaaaaagtccaggaccagatgaattcacagctgaattctacctgacattcaaaaaattggtaccaatcctgctgaaagtattctcaaagattgagaaagaagaatttctctctaaatcattctgtgaagccagcatcaccataataccaaaatcaagaaaggacataaaagaaaataatagatccatatcactgattaacatagatgcaaagatcttcaagaaaatactagataattgaatctaatagtgcatcaaaaagatagtacaatatgatcaagtgggttttatcccagggatgcaaggatggtttaacatacataagtcaataattttgatacat

SEQ ID NO: 470177 - DNA, 722 bp, Homo sapiens
gcacaagtaggatttttcaggcccagaaacactaacccccaatatgatggtctttggagatggggcccgtaagaagctctctatgctgtatgacttggaaagggatttttgcataaatcgttctctacgccaggggcttccaaagcatagaaccggcagcatcaacatcacctgggaatttgttagaaatatacaacctgaggcctcatccaggacctataagattgaaaactctgaaagaggaaccaagaaacctcttcaaggggtacatgtgcaggtttgttacacaggtaaatttcatgtcacaggggtttggtgtacagataattttgttacccagatctactctgcccagaatgcttttcctctggtctttctttcatcatcgcacagactacctggcaagtatctgttcatcctccaagaagaagttcatttatcatctattctgcagcaagcagagcacgtggcttctttctctttgctccttcagcattctgctcctggcctcctttgaagcacagttgcattccatcattgctgtgtatatttgcacaggtctttgccttgtaccacattgtgagctccttaaggacacataatgacaattgatttatttctgcatctacagactgaacccagtgtctaatgcacagtagactcttaataaatgtatattcaacacgtgtgaatgagttctatgagttcaaacctattatgtc

SEQ ID NO: 470178 - DNA, 690 bp, Homo sapiens
taagtgcagagctgcccaagaccatggaaacgcacctcttgcatcagcatgatgtggattatttgtagaggtcgtgatattcacactgtcctgtgctctggatcagtggttctcaaagtctgctccctgaacttgcagcttcattgtcacctgggaaatgttaaaagtgaaaattctcagatccacttcagacctgctgaatcagaaactcaggagtgggatctgggaatctgtgtcttaacaagacctccagatgatcctgatgcaacagaggccagagaagaggttcatattagaagaacaagcctatttgtaagatactgtgaaagcagcagctacatgaaaaaacctcagaggcggaagtttactgtaaactcaggggggaagaggaaggatgagaccctaagagatctgcctttgaccagcagcaggatgcatcacctccatgagtctttgaatatgcaaatagaagcccctgaagggtagcacaatatgccaccccaaaatatgctagccacttttgcctaaggataattttgagctaaaggcatattaacaaaaaataaaattctaagctcctgaataaacttaggctgaatgggccctgccttggccaaggggattccaaaaaaacctgaagaactagttcaggccatgatggggtcgggggaggggaaggatgggggtctg

SEQ ID NO: 470179 - DNA, 564 bp, Homo sapiens
ccttgacgctcactgacatctcagtccttgtgacgttggagcatgggaaatgaaaaccacattttaatcttctctattggtgttcaaattaaaacatgtaagagactaacacaacagtgggaaaaatgggttgggcaagtatgtaagtgggagtgtctccaagcttttggagctggctctgctccagatgagatgctaaaagtcctaaatatgtgttctagttctggaagcatggtggcaataaatccctttataaagaaaaagatatgccccacaaaaacctcagttttaaggatttccagacattggctgcaaatgcctgaaaagaacagaaagataatgcgtgtgggaaacaatcaaggatctaggcaaggttatcacatctctggtgtgcatttgttgagagagttacagggatgcaagcatttcaaagctaaaaatgcagcattcctagacaaactggatatctgagcatcctagatctggcatatttagtgcctataaactttatcttaaactagctatttaaactaaagctttttaaaataaggaggacaagtcaga

SEQ ID NO: 470180 - DNA, 531 bp, Homo sapiens
aatctagagatgcagtctggctacagaggctttggagagctgtggtgggctccgcccagtccgaacttcctgatggctttgtttacactgtaccgggttcatctcactggggcttgtcggacggtgggtgcaggagagtggatgcagccaactgagtgtcagccgaagaagggcaaggcattgcctcatccaggagacgaagctttcagaggaatgatcaggcagcaacatttgctgttcagcaatattcgctgttctgcagcctctgctgctaatacccaggcaaaagggtctggagtggacctccggcaaactccaacagacctgcagctgagggtcctgaatgttagaaggaaaactaataaacagaaaggacatctacaccaaaaccccatctgtacgtcaccatcttcaaagaccaaaggcagataaaaccacaaaagtggggaaaaaacagagcagaaaagctgaaaattctaaaaatcagagtgcctctccccctccaaaggaacgcgactcattgccagcaac

SEQ ID NO: 470181 - DNA, 516 bp, Homo sapiens
cctttctttcagtttatcaccaagaaaatggggaaaatgtctccagggcatgtcagagaccttcacaacagcctctcccatcacagacccagaggcctaggaggaaagactggcttcatggaacagggtctagggctctcctgctgtatgcagcctagggacttggtgccctgcttcccagctgctccagccatggctgaaatgggccaaagtacaactcaggcagtggcttcagagggtgcaagccccaagccttggcagcttccatggggtgttgagcctgcatgtgcacagaagtcaagaattgaggtttgggaacctccatctagatttcagaggatgtacggaaatgcctggatgttcaggcagaagtttgcttcaggggtgtggtcctcatggagaacctgtgctagggcagtgcagaagggaaatgtggagctggagcccccacacagtccccactgggacactgcctagtggaactgtgagaaaagggacactgttctccagaccccc

SEQ ID NO: 470182 - DNA, 444 bp, Homo sapiens
ttcctagaacatgcctgtgcttcctgtatgcattgagcaggcccactttcccgccgaccctgaccctttggacacatccttgttgtcatgcaaggcttcttccctccttgcatcaacatttgttctacctataataagggccacctcctatatgaatctgggtcaagtgtggaagaactctgtgtctaagatgttatccctaccttttaggatatgcactacagagtacatatccaacagttgtcaagatctctcaggatggacacatggcaatgacagttttatctcaggagcatacgctggaccagcaaagagacaaaggagctgttatggaccaaatgtgtgtgtctcccaaagttcatatcctgaaattccaacgcccaatatgatgatgttaggagataatgtgttggggaggtaattagataccacatataagtgaag

SEQ ID NO: 470183 - DNA, 586 bp, Homo sapiens
acatcaaagaccaaggtagataaatgcacaaagatgaggaaaaatgtccaaaaatgctgaaaattccaaaaaccagaatgcctcttctccaaaacctcacaactcctcaccagcaagggaacaaaactggatggagaatggagaagaatataaatgacctgatggagctgaaaaacacagcaggagaacttcatgaagcatgcacaagtatcaatagccaaatcaatcaagtgaaagaaaggatatcagagtttgaagatcaacttaatgaaataaagtgtgaagatgtgattagagaaaaaagaatgaaaaggagtgaacaaatcctccaagaaatatgggactatgtgaaaagatcaaatctatgtttgattggtgtacctgaaagtgacggggagaatggaaccaagttggaaaacactcttcaggatattatccgggaaaacttccccaacctagcaaaacaggccaacattccaattcaggaaatacagtgaacaatacaaacagcaacttcatcaagaagagcaaccctaagacccataaccgtcagattcaccaaggctgaaatgaaggaaaaaatgtt

SEQ ID NO: 470184 - DNA, 753 bp, Homo sapiens
gtgatgttggtgacgtttgagagctcctatcagtcctcttgtgagataaatcgggagagacaggtaagaaagagtgaagcaggaaaggaaacaacgtatgcaagaatgaggttccaggtgaaatctagcttcagccacatcttacaggaagctctggagtataaagtgaatggcagagcccatcttgcatcggacaaaggaccacagagacttcagacatacatggaaaatcatctagagaaagttgtggagatgacccgttacccaaggtatctgtggcaggtgggcattaaaaacaagaaccagactgaggaagaggattcaggagatctgggcaaggcatcaacaatgtccacaaaggtccacctcttgcaccattcaggtccatttgcttttcacgttagtgaacaattcggtggcattaagcacattcccactgttgtgtcacattaccgctatccatttccaaaacttttcatcatccaaacagaaactctgtccccattaaacaataactacccatcatccctctcccagccctagcctacttctattctgctttctgtctttatgaatttgaatattctaggtgcactaggagaaatcacacagttccctacctcaaggctctcacagcaaacaaatctaaaaaaatgattgaactgtatacttaacatttgtgtactttaggtaaattatacctcaataaaaatataaataaaaccaattttgctatatgctatgggcttttat

SEQ ID NO: 470185 - DNA, 1363 bp, Homo sapiens
tgagtcgcctgttgaatttgccatggtgttgccagcctggggcaggggccacattgccatggccaatcctcagatgctaccagtgggcagcagcagcttccagggtggcctgggtggaggctatggcagggccagcagtatcggaggcatcacagctgtcatgatcatccagagcctgctgagcccccttaacctggaggtggaccccaacatccaggccatgcacacccaggagaaggagcacatcaagagcctcaacaacaagtttgcctccttcatcgacaaggtacagttcctggagcagcagaacaagatgctggagaccaagtggagcctcgtgcagcagcagaagaaggctcggagcaacgtggaccaccagttcgagagctacatcaacaacctttggcagcagctggagactctgggccaggacaagctgaagctggaggcagggcttggcaacatgcaggggctggatgatgagatcaatgagcgtgcagagatggagaatgaatttgtcctcctcaagaaggatgtggatgaagcttacataaacaaggtacagctggagtctggcctggaagcgctgactgatgagatcaacttcctcaggcaactgtatgaagaggagatccaggagctgccgtcccagatttcccacacgcctgtggtgctgtccatggacaacagccgctgcctggacacggatagcatcatcactgaggtcaaggcacagtatgaggagatcgccaaccgcagccgggctgaggctgagagcatgcaccagagcaagcatgaggagctgcagacgctggctgggaagcacggcgatgacttgcagtgcacaaagactgagatctcggagatgaactggaacatcagccggctccaggctgagattgagggcctcaaagaccggagggcttccctggaggccgccatggtagatgccgagcagcgcggggagctggctgttaaggacgccaatgccaagttgtccgagctggaggccgccctgcggcaggccaagcaggacatggtgcggcagctgcctgagtaccaggagctgatgaacgtcaggctggtcctggacatggaaatcccacctacaggaagctgctggagggcgaggagagccggctggcctttggctctggctggaggctccagctccttcagccgcaccagctccatggttgtgaagaagatggagacccgcgatgggaagctggtgtcctagtcctcagacgtcctgcccagctagctatgccaaaaaaaaaaaaaaaaaaagaaaaagaaaaagaaagaaaagcaaaaactaaaactactagaagaaaacatagaggaaacacttcaggacatt

SEQ ID NO: 470186 - DNA, 981 bp, Homo sapiens
gcctgggagcagtaggccgtaccatacagcctaggtatgtagtgggcttcgccatctaggtttgtgtaagtgcattctgtgaggttcacacaatgatggactcacctaagggcgcacttctcagaacatagctccgttgttaaatcatgtgtgactgtgtagaagatggtgtgtctttttaccggggctatcatcagcgggagtgggcggcactggatgtactcctgtgcccttgcaggaatccagcctcctgcccccttcctcccctgtcctggtggccctctgcctcctctcagaacctcgtggggacaggagatgggctctgcactccagtctctgtgggtggcgctgcctggtgtgagcagagatggcaggagggccacctgggtgcagtacctgcagcagggaggagggagagcagcctgcgggccctgcagcggccagccaggggcagcagagcagagcacagctcccaggctggggcagagggctgagagtgtgcggattcaggcaaccctttgggggtgcaaccaggctcccttcagggtacaactgggctctctgggcaagaattccgagaagggagcctgctttggggctaagtcaggaatgggagcacagcctctgggtctgagaacagaaaaaatttaaacagctttggaaatcttcatacgtagaagtttttgaagactttgcctacagctgtttgagcatatttccaatttcttggtgtttatgggaacagttagtgttttggtcttttggggaatcaattgtagtaatttagcaagttatctttgtcatcctgggttttgaatttatttgcatagagcccatgctttgtttattatactttttgccagttgacagcatcgcacctcttaatgatgtacattctctacagccctttactatgtcactccttgtataactgaattatataaattaaattgtaaaaactaatttaatgtgttcacatgc

SEQ ID NO: 470187 - DNA, 1416 bp, Homo sapiens
gaggatggttgtgttggcttgcttttctctttttttaaaataactgatgcaaagacccaaagaaggatcagaaaaatcatctcttaactccactgtctgtctcattttgaacctgagcatgaggacccagagggaagcctcattgtccaaaactgacagggtcttagaagctctgccccagacaggcaggcagcagagccttttgccggatgaatcaaatgacgttaggaggaccacacacattggctcaaaacacaacagaggcccgaagcaaattccagcagacaccatttgttctcacatgacaggagtggaccgggacccgggaggaccatgtgatgctgaggaatacggcttgagggacagaagagaatggcaaggagagggcttggtggaagaaggcagccatctgcaaaccaagcagagggccctcaccaggaatcaccagccccttgacgttagacttcccagccttcagaactgtgaggaatgaatgtgtgttctctaaactaatctatgatatttttgttatagcagcctgaactaaggctcacatactcacaagaaagaagaaaaatggtagtgttgaaggaagccaactgatgagaaagacagggtctcactatgtggccccaggctggtctcagactcctgacctcaagcaaccctcctgcctcggcctcccaaagggctgagatgacaagcatgaaccacggtgcctggccagtcatttttattataataattataatatattataaattattatatagtacatatcatacattacatcatacatcactacatgctatataatgtataatatatacgttgtataaatgtatattaacataagttttattttgtaatttagaataacatgatctgtaacagtatataataaaacaatcagcggattcggaaaccacacgtctctgtattcctttcagaaccactggcacacgcacctgcagttgtttcgggctgtggggtgtgtgctgcactatttggtttttgcagcatcatgggaagggtttaacattatcctggtacataaaggaaaacacaagaacagacaagaggccaagctgtccagtctgaaaatcatgtatcaccttgaacaagcagtgaaggctggaatgtgtgtctcaaacatgaatttcaaagccagcaggcagcgaggaggctctgcccgcccggcctggcctgtgagcagctggcagtgccttggcaggctccatgagtaggcgccacgctccctccaattctggcttcggcacctaagtgggaatattccaggaaccaggaaatgattcagacccgaatctgccactcagcccccgcacagaattttgtcagcttttggccccttcaatcctcagtctcctcaccagtcctggcggcaacaggaccctc

SEQ ID NO: 470188 - DNA, 623 bp, Homo sapiens
ttgagctgacctctgtccagtctgtacacattggatcctgaggctgagcttgggtggctgtggcaggaagcacttggtgttgtcagacattttacatttttgtctaatgcgtgaaagtgctgtctacatgaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatc

SEQ ID NO: 470189 - DNA, 2389 bp, Homo sapiens
acgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgggtcactgagacctgcagcatccaaggaaagctggccacactctggggacatggggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccccatcacctccccctccacacacaccccagcccccatcacctgaccgttgggattaaaa

SEQ ID NO: 470190 - DNA, 949 bp, Homo sapiens
ccttcgtggtgagtgttacagctctcaaatcggcgcgtctggagttgttcgttcctcccggtgggttcgtggtctcactggcttcaggagtgaagctgcagaccttcgcagatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttc

SEQ ID NO: 470191 - DNA, 1477 bp, Homo sapiens
gacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataatattgctttagctgcactccacatattttgatatgttttgtgtccattcagttctcttgattttttctttgaggctttctctttgatccatgaattatttagaactgtggtgtttaattttcacatgtttagagactctcttt

SEQ ID NO: 470192 - DNA, 2483 bp, Homo sapiens
ttgtgacccttattagtggaagttgatgtcgcacttgcacagcattcgggcccacaccttccctcaggcagcccatgtcaacttctgaagctctgagtctgagaagtttcccaaactgcctgactccctgtagcgtacaccctgggactaggctggtagtcgaggctgcctggacacaggcttttcccttcctcatagcggcctttcagaagacaatgtccccgcttcacctaacacccaccacaacaaagccccagtgccacacgccattcaggagacatggttgcttcttcatcatccatcctgccgcccgctcgacattccctgccacccgacagtccagggctgcggctactgtcagacacccttcacaggagcagatggtgctcacagttgggaccctgtcagtgcccaaggacacccagggccctgctgggttcccacctgcaagctcccttcctagacagtgcacctgtgctcgagcttctggggccaccagcatctgccaagaacagatcatgttcccttgtgagtgcctcctttccattactcaaatcagaccaccctgcaaggacaaccactggtcgatttatcaccttagctttcctgttccaaaatataagagttccagttgctgacatgaccacatccttgctgacattcgccttaccaagtatttagtttgagccattctggttgatgtctagtggtttctcattgggattttaatttacatttccctgatgatgaatgatattggcttattggccatttgtatacattatgtgtgaagtgtctgttcaaatcgttgaacgttgttgatttgtaggagttctttatatattctgggcaccagtcctttgtcagatatatgtaatgaaaatattttcccattccattacttgccttttcattttcttaacaatgtttttgtaaagagcagatgtatttaattttgattaagtactttttaattaatttttcgggtgtttttaatagtgttttctctgtcctgcacaagaaaactttgcttaccctaaggttgcacacatatcctcccacattttcttccagaaactttatggttctaacttttacaactaggtatatgatccttcttgcattatattgtttgtgtgaagtgaagtagggattaaggatcattcttttccatgtggatgtactgttatgttaaatgggggcagccctaaaccaatgactaatggaaactgtcatataaatacccaagttcccttactcctcagttgggacagctctgagatgtgtgtaataccctgttccctaagttttccagtggaattaagttccacttacccacgatgctaacttgtttagtaatgattcattttgggctaacttccctaccctgtctccctctgctatcagtgtttcctgggatcgcctctcaaataaattgcttgcactcgagggtctgcttatcccagggtctgcttctgtggaaactcaaaccaagacagtaacaaacaagacagaccgtccctaccctcatgtatttagctttaatatagttgcatataggaagatgctacaaccagcattcagaggagggagaagtcattctcaaatgaaagtagaccctccaatgcctcgctgactagaagcagcagaatgacagcatttgaaggcagaactaataaatgacaggttactatgagttaaaacatccccttctttttttttttctgtagagatggggtcccgctttgttgcccaagttggtctcaaactcctggcttcaagcaattctcctgcctcagcctctggggttactcgcatgagccactggatccctacatccccctcttagaagactattaccagttagaaaaacctagcccctgaagttttaaaaaaagagaaaaagtcatttatttcactgaacagtgttttcattccaaattcttttactgtgtaactctattttgcaggtggcataaatagcacagagagatgctgtgtgagtaagtcagcatcactgttggaggcaggctgaaggactggttttggaaccctagcatgtgtctttcagagcagaccagggaccccatacatccgttttgcccaggatattgagtcagcaaaggaaatgatggcttcagtctccttgggtcccctagatgacaagacgacaggaaaagctgcacctctgctctgcctgctgtgtccctcagcaacagctctggggacacacaaagtgattgagaactgcagaacaatgttgatggctgtgagatttcccagaaaagccctgtttgcatcagtcaagccagatgaactgtctacattatgacagacctgtgtatactgtgtgagaaggggatgttcccatggtactttacactcactgctaaaaagcaattattttcaagttgctactctgtatcttccacaagcaaaaatcaactcctccatcgcaggtcattgaaagtatttcaatgtga

SEQ ID NO: 470193 - DNA, 698 bp, Homo sapiens
tgttccagcatgggaaacttcaggccagttttgagaagggtgatcaagttgaccacagcaaatcattcatgtgggagtgtaaggtttgatcagtttgtttcactgccctttcagttacagcattctgcagggcttgtcatcaaacttgtgaagctattttgtggcccatggctcttcctcatcacagtggaggctcctgcagggcaggcctatgcctcccctatggggctcagccagagcgccatgctctgcagctttgccaaatccccttctgaccatcaggctatcagcagtgttcctcccgtgaccatctgggttccaggtgatgcttctcccagacgttctggtttgcattttttacaggttgaagaatgtgaatatacttaacactactgaagtggatactcaataatggctaagatggtgaatttagtgttatgtgtttttttaccgcacaggaaaaaagagaaacaaagagttcttaatggtgaggagaaatgcttatggtagaatgctagagagaagggggacacaaaattgtatagaccatcttatccatcttatctcatctgtgaacaattacatataatagtaattatatattttatatataatatattatatatatacatatatatgtatatataactacagtggagggaaaaggtttaagaaaatattttaaaatactaataaaa

SEQ ID NO: 470194 - DNA, 2359 bp, Homo sapiens
cctgctattacatgagccttctgctggatgccttccagaaagagacactccactgtgtaatgagagctgtgccccaggccaccctgcaggatccagagaagaggcagagccagggagagggcaatggagactgccacataatctatgacagatgtggtgacaggggctgtcatggaggctgtgacagagactgcggtgtggactgtgatacacaccgtgacaaggtctgtgatacagactgtgacagggactatgacagaggccaggctgtgatagagactgtgatagagactgtgacagagactgtgacagaggctgtgatagaggctgtgacagaggctgtgacagaggctgtgacagagactgtgatagaggctgtgacagaggctgtgacagagactgtgatagaggctgtgacagaggctgtgacagaggctgtgacagaggctgtggtagaggctgtgacagagactgtgacagaggctgtgacagaggctgtgatagatactgtgacagaggctgtgatagagactgtaatgcagactgtgatagaggctgtgatagaggctgtgatagagactgtgatagaggctgtgacagaggctgtgatagaggctgtgagagaggctgtgacagaggctgtgatagagactgtgatagaggctgtgacagaggctgtgatagagactgtgacaggggctgtgacagaggctgtgatagagactgtgatagaggctgtgacagatgctgtgacagaggctgtgatagaggctgtgatagaggctgtgacagaggctgtgacagagactgtgatagaggctgtggtagaggctgtggtagaggctgtgacagaggctgtgacagagactgtgacagaggctgtgacagaggctgtgatagatactgtgacagaggctgtgatagagactgtaatacagactgtgatagaggctgtgatagaggctgtgatagagactgtgatagaggctgtgatacagactgtgacagaggctgtgatagaggctgtgacagagactgtgacagaggccgtgacagaggctgtgatagaggctgtgacagagactgtgatagaggctgtgacagaggctgtgacagaggttgtgatagaggctgtgacagaggctgtgacagaggctgtgatagaggctgtgacagaggctgtgacagaggctgtgacagagactgtgatagaggctgtgacagaggctgtgatagaggctgtgacagaggctgtgacagaggctgtgacagaggctgtgatagagactgtgacaggggctgcgacagaggctgtgatagaggctgcgacagaggccgtgatagaggctgtgatagaggctgtgacagaggctgtgatagaggctgtgacagaggctgtgacagaggctgtgatagaggctgtgacagaggctgtgatagaggctgtgacagaggctgtgacagagactgtgacagggactgtgacagaggctgtgagagaggctgtgacagaggctgtgacagaggctgtgatagagactgtgacaggggctgtgacagaggctgtgacagaggctgtgacagaggctgtgatagaggctgtgacagaggctgtgacagagactgcaacagagactgtgagagaggctgtgacagaggctgtgatagaggctgtgacaggggctgtgacagagactgtgatagaggctgtgacaggggctgtgatagaggctgtgacagaggctgtgacaagggctgtgacaagggctgtgacagagactctgacagcgactgtaacaggaattgtgacaggggctgtgacagaggctgtggacagggacaggcactgcgatggggactgggacagaaatgtgactaaatctggaaccacaatcagagttgggacaacagttcctggagcccgggcccacactcccacggtcgacagagcagttggcggtgacagcagcaacacagcaaacacagaggcccagccaggcccaggcatttgtggggacgccagcaggctgaagctgccgcgggaagacagcgagagggagatccctgaatcagatatcaccacctgccccatgggaagcctgttagccagccggatctctctgcttagcacacagggctgtctctctcccaggagcaaggcctttgccaaacagcaggagggtgaagcgccatccctggtacctaccactctcttgaagattcccacaatgatggtgaaggaaacgcagtttatctctgactcataacaggcattccataaatatttgttgaatgaacaaaaaaatgggagaatttctttgaggaacattcacacaagcagaagactctcatctgggag

SEQ ID NO: 470195 - DNA, 754 bp, Homo sapiens
cttcatcaaagaaagaaaactatccaagaagcctacttccagcaaaaccgagcatgggtctcacagctggaagagttagcccaataagagaacatttgtatagagcagcatttttatcacaagatgccagtgctcagcaaggtttttattatacaaaatcaaaggacttaaaatactcaactagaactacagttatcaagaccaagagtttttcaaagtacaacattaatcccccaggatttttagtaggggttagacagaaaatgaaggcggtcggggcattctcagagaaaataaatctggaaagtgtcaagggaagtcgtgggggaaggagcctgaggaactgtgtgctccagcccagatactgcacttttcccatggtcttcacaacccacagaccagcagattccctccagtgcctgccccaccagggccctgagtttcaagcacaaaactgggcagacaccaaactagctgcagaagttttttttccaaaccccagtggtacctcgaatgtcagcgagacggaaccgttcactccccttgaaaggggtgctgaagccagggacccaagtggtctggctctgtgggccccatgccatggagcccagcaaactaagatccactggcttgaaattcttgctgccagcacagcagcagtctgagatggacctgggatgcttgagcttggtggggggagggacatccactattgctgaggcttgtgtaggcagttttaccctcagagtgtaaa

SEQ ID NO: 470196 - DNA, 685 bp, Homo sapiens
atctcccttcgctgactctctttttgcactcagcctgcctgcatccaggtgaaataaacagccatgttgctcacacaaagcctgtttgcaatgaagcatatcaatgaagcatatcaatccaagttagtggaagaaattttgctaaatgcccaggtccaagctttgccctaccgcagaagcacctgggacactggtgtgaatggtcatcggagtggaggtgacacaaaacagagacctgagcaacaggaagagagaggtgctcggaacatgcaacccagatccctcaaatgcacagttcacaatagggttcatgctccaagagaatctaatgctgccactgatctgacaggaggtggagctcaggcggtaatgctggctcacccaccactcaccttctgctgtgtggcccagttcctaacaggccacagactggacaagtgtagtggcagtgaaaataaagaaattggacagacttgagatatatttgtagttggacagaatttgctgataaattcaatgtataagtaaaggaaaaaggtgaatttaggtattcaacttgaggaggtgagtgtatggtagtgccattcatggaaatgagaagattcaaggcagaacaacaaaccaggcttgggagggaaagttaagaattctattcgaccatattttaaaggttgaaatgtttgcc

SEQ ID NO: 470197 - DNA, 566 bp, Homo sapiens
ggctttgaggccagcagttcagggtcccagggatggataggagatgattttggaaagtcaaggaaatttggcccttatgttatttaataagataaatgcaaaagggtggaggaatgagggctggggtacagccagaggaaaggtgctgatgtatgacaaaacatggtgcctcttgagtggcaaagagtctgtttcttataacacattcaatggtctccctctggggttccactcaacacaaaggttttctaactccatggatgatgaacagttgagcaaagacatttctctggtgcatcactgggagaacttgtccaaggtcctgaagatagaggatcccagcaactatgacttgaaaactgtgcttcctggttgcctgacacgaggtaatgcagccatgctggctgacctgggcatgagtgttcacagtgagaatggggctctgggaggaggaggagccaatgaacatagtattccctggattgtaaactgcactgaaggtttataaaaacttttggagaaaaccttgactaaagttagctggggaatagcaagaacttggggag

SEQ ID NO: 470198 - DNA, 545 bp, Homo sapiens
gggttgcttcttccctgcctccccgacgaagaatgggaacaccaggtttgatctacaatagtcaggatccactcatggagctggaacaagatggacacccgaacacaactgaagttctattagaaaggcgaggacataacaactgctcctcctgtaaagttgaacttttatattcactaagtggttcaaagaaaggatcacctgaggagcagtatagtttcctctccccactttcccacctcatcccttcacattggtctactggaagacaagagcaatccctggaggaaaaacaagaagtggatgaatccagatggcagcaatcaaggttctcctcccgaaagcacacccatgaccccctaaactcactcaaaggaacccagactaagacccaggttctggtgctcctcacaggagaacgtcaccaatcaagtgaggtgatatcccaagaggataaaaatgagctaaaattgaaacattacaaaaatccaagaagcgtgagaaacatgaaagagtgataacctaaggatggattaacttgtact

SEQ ID NO: 470199 - DNA, 748 bp, Homo sapiens
attgtgaaaatgacagtgaagaccagaagtgaccttctggtgtgtaaaatctcaagccttggatattcatggatgtcagatccatggattaataaagaaacaaggtctttggtggtctgtgtcccaaactttctgaagttgatatctctgaagcaactattgtctgctgctattcagaaacaaattccaatttgttaccatgaatattggggaggagatgaaaatatgggaagatatttggaggataaaatcatagagttttctgaactgaatatagatctaaattatgtgaatggcctgaaaaagaaatactggcttaaagcaatgatgtttatctggggtcgcaaaatttttggatatgggagactcctgccatctctagatgagaaaggaactgaaatgtttcctagctgatctgattatcacagtcaacttaatgacctggtcgggctgccacatgatcagtccagttgattgctgcaaaaccagtcttcaagctctgagattcgttcctctgcttagtctattttgctattaatacttgtgattgcattatgaaattcttgtagtgtgtttttcagctctgtcaggtcagtgacatttttctctatactgactattttgtctgtcagctcctgcaatgttttatcatgatttttagcttccttgctttgggttacaacatactcttgtagctcaatggactttgtacctattcgtattctgaattatacttttatcatttcag

SEQ ID NO: 470200 - DNA, 737 bp, Homo sapiens
ttgtgagcgccagacccggctttagttttcatggataaacaaccagcactggattaattccttattggcaaacaatgactgtactgtctgtcttctggaaccatgtcaacgatggcagcatcaccagacttcaagaatttagggccatcttccagctttttaccagaatggcgatcaatcttttcttcagctcagcaaacttgcatgcaagcaaagttgccacgacaaagatccttgacagacacattcttgacattgaagcccacattgtccccaggaagagcttcactcaaatcttcatggtgccttttgacagattttacttcagttgtaatgttgactggagcaaagatgaccaccataccaggtttgagaacaccagtctccacttggccaataggaacagtaccaataccatcaattttgtagacatcctggagaagcagggcttgtcagttggacgagttggtggtaggatgcagtccagagcctcaagcagcgtaggtccaatggcgctgcagtagttacaggtgaatttccatcccttgaaccaaggcatgttagcacttggctccagcatgttgccaccattccaatcagaaattggcacaaatgctactgtgccagggttgtagccaattttcttagtacagggtctcactccgtttctttctttgtgaagtgctacaggttgtaaaacattccctgaagtctctcaagtctattttaggtttagc

SEQ ID NO: 470201 - DNA, 793 bp, Homo sapiens
ctccagaatccactgacagcttgcaccatgcacctggaaaagctgcagacactcaatgccaactgtgaaagtagccaggagggcctgctggagggagaatgtggagcagaactgagtcagcccagccaacctccagacctgtgcagccccaaccaacagccaactatcccccagtcccgtgagatcccatctccaggaagcaatgcaggcagcaggaggggcgttctgcacttcccaacagaatatggtgtcgctttgatggtcaaagtctccattgcctcgggagaaatgccctgtgggcaccatcagtctgtgcccaacagaagggagaggaggccagtaggagaggcgatgccagaagaagtgatgtgcaagggtataacggaattaggagtactagagccaggtgaagggaagacagtggctactgccatgttgcaactggcccaatttttccctgagcatgtgttacctgatttaggtgatcagtctggcttccgggcatttgttacaaaagtcagtgatcagcagtgcctttccaagtgacttgggtgaacacttaagtgtgcagtgaggtacagcaatctgatttcaaactctgcctctgccacaacagggttacgtcttttcattgcacttcacaggtatagtgatttttagaaaggtttgtaaactcttcgaaggtttgcggtaaccgtttttatcggcgttattttttcaacagcatgtgctttctgtctctgtcacactttggtaattcttacaatatattaaactttttcattatcatatc

SEQ ID NO: 470202 - DNA, 1423 bp, Homo sapiens
gttaagtggggtgtagatgtgcttctgcaggaaatgccctggaccaaggttatcgaagctgttaatggattggacagggactttaactgggataaaaataaagctcgatctccttcctggggagcttttctccttgagaggctaccgaaggcaagctggtatgagcagcagaaccccaagcttgaggccttgtgtgggatgaggacaacagattgctatcactgggaattgttaaatcaagatgttttggaggttgcccaaccagtatcttggtgtaactgggatctgaaaggcacactcacatattctttgtctctaaacagctctggaatgcagaccaattcccagtttttcactctgatgtcaaagctgttagctgatctgtatcaagcccttggacttttcagaggagagtcagatagcagtacccagtgttcactgggatttagaggaaatgtataactcccattatgtaaaggttagtttgcttgatggtgtcccataattcctgaattcatcattcttttcccttgtttttcttattactcctctaactggagaactttaaatgtcctgtcttcaagctcactgagtcttctgcttgatgaagtctgctattgaagtttttaattgaatttttcagttcagttatcatgttctttatctttagaattaatgtttttattgtttctatttctttgtcaaacttttatttttttcataaattattacctaaattttatttaattttctattaatattttctggtagttccctgaacttgtttaaaatgattattctaaattctaaacagtttttcaaatagacttatttacactcaagtccttgtctcagtgtttttcacattcatcttttgttttacgcttttctaatttcataattaaaatattccaatagcaattagtgtgtcaactttagtgcttacagaaagtgttataatagcagtcatgtagaaaaacaataatacatcatttcatattctataagttaaaagattcatttccctctgattaagagtttattttgaaaattctgggaagttgctgttgacttctactccctgctttgcatcctgataccttgcagttttaacacttatatgacgtagtttaaaatattcagtggcatctcatgtaagtttttttctccctttggaaatagaatattggagtagataactctgtgtgacctgtttgattttctgccccacattcatacagctgcagattcagctctgtgccaagctctatcattcatcatggggagtctaattaaggtagaatccagtcagcttgtgctagggactgaatgtttgtgtcccctaaaattcatatgttgaatctctaacccccagtgtgatggtatttggaggtgagacctttgggagctgattaggttagac

SEQ ID NO: 470203 - DNA, 783 bp, Homo sapiens
tattccatagcacagccaagtttgagacagtggggtctaagaaccatgtagaactaatgagaatcctgaagtgtctccttagtgggtatccacctttctctgagcacaggactcaagtgtcactgaaggaccagatcaccagtggaaaacacaacttcattcctaaagtctgggcagaagtctcagagaaagaagttgttggtagtggatccaaaggcatgttttacaacagaagaagccttaagacactgtggcttcaggggttggggctgccattattaaatgctgacctcatttggaactgccaagagttggaagatgaagacatgaagagaaagtttcaagatcttctgtgtgagaaaaatgaatccacagctctactccaggttctagcccagggccccttggaaagttccagggaaaggagcatagcaaggttgggggtggagtttgtagagactggctggctggctgctgacatcttcatgagaacagcaggtaccttggtgcataataacaggccaggttatattctcatccttgccctcataaagatacaggtctacagtctctgaaacctttgggctagataagttgtgaaatttaattacccaattttaggaaggtgatacatttcagtaagctaaggttaatttattgaagaaaagctttaaaaaattttggtgtagcctaagcatatggtgtttataaagtctacagtagtgtacagtaaggtcctatgccttcacactcactgactcaccacagcatcttccagtcctg

SEQ ID NO: 470204 - DNA, 2889 bp, Homo sapiens
accctttcacagctggggagtggagcctgggcctgcgcctctccgcgccagcgccggcactgtgcgcctctccgccgctgtccgcctctccgccgcgccgccgctgtccgcctctccgccgctgtccgcccctccgccgcgccgccgctgtccgcccctccgccgctgtccgcccctccgccgtgccgccgctgtccgcctctgcgccgctgtccgcctctccgtcgctgtccgcctctccgccgctgtccgcctctccgccgcgccgccgctgtccgcctctccgccgctgtccgcctctccgccgcgccgccgctgtccgcctctccgccgctgtccgcccctccgccgtgccgccgctgtccgcctctgcgccgctgtccgcctctccgtcgctgtctgcctctccgccgtgccgctgctgtccgcctctccgccacgcccgcgccggcgctgtgtgcctttgcgagggcggagctgcgttctcctcagcacagacttcggagatacagcgaaggcggagcagtgttcacctcagcacagacccgggcgggcgggcgggccggtggcaccgcgagggcggagctgcgttctgctctgcacagaccttggggcactgcctcgctttgggacaactcggggccgcatcgacggtgaataaaatacttcctgtttgcagccctgtttgtggttggtggcagcgatggacactgcagccagccagagcgtagaaaggcatcggggcgtcactgcccgtcttgggtggctggttgggtgtgctatctggggctgtgctgcctgcaccggggggtggtttgggggcccaaaccggggctgcactgcctttggcggggagccggttgggggcactatcccagactgtattgctggcaacagtgagaagatggccacagagacagacagcagcgtggtcagagtggtaggagccggccatcagcgagagctgctccatgcctggctgctgggtgctagagtctgcggcccactggcttgcctcactgtggttggtggtggcggtatacgctactggcggcattgggggacagaggtggggggtgctattgagggcaggactagccgtggagtgggggacgagttcggtgctatcaggctgcactgctggtggcggtcaacagagttggcatccaaggaaggagtggttctcctctccctgactccacactccagagggcgacccactcttggtcatactggaatgcggcagggcacgcagcgcttttctggctttgcccgcccagctgctccatgccaggaggaggaggagacacctagagcctgcaacaccacggctcgcctcgctacaggccctgcccctgctgctgccctggccctggcctggaacctggtcctgtcaaggacctgccctgactctgccatggccctggccctgctctgccttgttcctggccctgacccagacccagaccctttcctggctctgcactggcctttccctggccctgagctggcagtgatgaacatgggcctgcccctgcccttgccctgccatggcaatggcattggacagtccgtggtcctaaccctggccctgccgtggaggtgccactctctgggccctgccctggctctggccctgccccggccccagccatagacctgccctgctctgcctcgactctggacctgccctgactctgctcagccctggatctaccctgactctgccttggtgttgccctcccatatctatggcctggctctggccatgccttgcacaggccatgctctgccctgcatgtcccagcctgggcccagccctcatcctaccatattcctgaccccagccatacccttgttctggccgtgaccctgccgtggccctctcctggcccttccttggtcctgccctgcccttccatgccctggccttgccctcaccctgcattggccctgcactggtcctgccctgccctggtactgccttgccccggccctgccttctccctggccttgccctgccctggccttggctttgccttatcctggtcctggttctgccctgaccctggccttgctctggatcctctctggttctgccttctccctggccctgtccttgctctggccctgtccctggcccagccttgaccctgaccctggccctgacaatccccaggtctgacactggctatgcttggccctggcccctccttttggccctgccctggccctgccttggccctgtgctatcttagtcctgccctggccctgaactcgccctggccctaccctcaccctacactggccctggcctaccctggctttgccctgccctggccctgcctttggcctgctctggctctggttctgccctggccttgcccttaccctggaccctccctggccgtgttttttccatggtccttctctggccttgcccttgccctgtcccctttcttgtcctgccatgtttctggccctgccctgtccatgtcctggacctgactctggccctggacctccctgtccctgccctgccatactctggcccattcttgctctacactgaccctgtcctgccttggccctgtgctaccctagccctgccctggccttctgctgaccctgatcctgccatggccctggccctgccatgtccctgccctggccctggttctgccctgcttctggccctggccttggtcctctcatgtccctggctatgaccctgcccctggtttttctctggccatgaccctgccccagttctgtcctatccctggccctgtctcagttctctcctagccctggcctttcacagtactttatgcttagtaagggctccatagtgtctgtgagttgaatgttgtgttcatagtatctgcc

SEQ ID NO: 470205 - DNA, 4442 bp, Homo sapiens
tgttttctcccccaatccaaggcactaggttttggctaggttgcaggttccaagctgctctcctgctgtgtcggggagggctgtgcatctgcaatgactctcagggggctcccggtggtggcaattggtgaatctgcacggcagtgtttcaatattgtcacagccctgctgtctctcatgctctcaaaaagcatttctcttacctgtgacagacttcctatacctaacagcttgcaaaaatgttccagacctgatctggggcttgcaccctgggtgcagcatgacaggggtgggcagggtctggctctgggccagaggaccctttctgatggacttcagctgttggccttccaggggagactgatcaacctcacaagagtcatacggtgggagtaccaggttgaaaccaaggacaccttcctggaggagctgctgtttgagccagctctgagaacaggtggggacaggactggagaggagaagggtgtcccctatgagcaaagactggccaccacccaatctaacacccccacagggcccctgtggcatccctgtccagtccctgtcaccacccagtttttccctctggacccaggaattcaaagtaagcaaggaggtccgctgctccagttggctgcatataattacaaccttgagcccaagcagcactttgggtcctggtttgggaccatgaagcggctcgatcctgtggtctggcaatgcctggggtacccagacctcactctggacaggccctgggagggggccctggaacctatagatttcaggatcgaacactgggattccctcagcactaaaggaggaaaattgcaaacagagctgaaagtgcaatgtgcaaagaagaacataaaggacaaatctacaactaagatcatactgagtgtggaaaaggtgaaagattttactgtgaacaagaaaaagattttactggaacaagaaaaggatgcctattctcaccaatcatatttcacatagtgaaagtcttaaccaggacaattagattaaggaacacaaagacatctttttcatatttcgaatgtaaaactgttttggaaactgttatttttagaaacagttaaaaacattttttcattagtttttcatgtaaaattatgacaaccagcatgaaataactgtcatcacagaagcatggtatattcgattccaaaacatattctttgtaagttttaatatatttatgtattatttatacttagattgtaacccataatgttacaatttatgttacaatattatttttccttcaactcttaagaatattcttaaataataaaattaaaattaatgaattataatttttgttgcttgggaaaaagagtagacacacacgtgacagtgcatcacttcaccccatcatttcatctcatcatttcatctcatttcatctcatcattttatcccatcatttcatctcattccatctcacctcatcattttatatcatctcatcatttcatctcaccatttcatcaaatctcatctcatctcatttccatttcattttcattatttcatttcactatttcatttcatctaatttcatttatttcattttgtcatttcatataatctcatttcgtttcatctcatatttttgatatcatttttcatatcatttttcatctcatcatttcatctcaattcatttcatctcatcatttcatctcctcatctcatcatttcctcctttcattacatttcatctcatttcttctcatctcatttcaatttcatttcattatttcatctcatttcattatttcacctaatttcattatttcatctcatctcatctcaattcatctcatctcatttcatctcatcatttcatctcatcatttctcatctcatcatttttcatctcatcattgaatctcatttcatttcatttcatcatttcagctcatcatttcatgtcacatctattcatttcatcatttcatttcaacatttcatctcatcatttcatctcatctttcaatttcatttcaatatcatcatttcatcatttcatttcatctcatttcattatttcattatttcatttcatttcaaattcatctcatcatttcatctcatctcatcatttttcatctcatcatttcatctcatcatttttcatctcatcatttttcatctcatcatctcatctcatcatttcatctcatttcttctcatttcatctcatcattttatctcatttcatctcatctcatttcaatttcattatttcatttcatttcactacatttcatctcatcattttatctcatctcatttcatctcatcatttcttctcgtctcatctcatcatttcatcatttcatctcgtttcatctcatttcatctcatctcatctcatctcatcatttcatctcatcctttcatttcatctcatcgtttcatctcatttcatctcatctcacctcagcatttcatcatttcatctcatcatttcttatttcatctcattttatctcatttcatctcatatctcaattcaatttcctttcattatttcatctcattcatctcatttcattacatctcatcatttcctctcatcattacatctcatctcatctcatcatttcatcatttcatctcatcattgcatctcatcatttcatctcatttcatctcatcattcatctcatcatttcatctcatctcatcatttccatttcattatttcatcatttaatttcatcatctcatttaatttcacctcatttcatttcattttttcatttcattatgtcatttcatttcatctcattacatttcatctaatttcatttcatctcatttcatctcatcatttcatttcatctcatcatttcatctcatcttttcatctcatcatttcatctcatcatctcatcaactattttcatcttatctcatcatttcatcatttcatctcatcatttcatctcatctcgtatcttctcatctcatttcaatttcatttcattatttcatttcattattgcatgtcatctcatctcatcatttcatctcatcacatctcatcattttatcattttatttcatcatctcatcttatcatttcatctcatctcatttcaattttatttatttatttcaatttcatttcattatttcatttcatttcatctcatcagttcatctcatcatttcatctcatcatctcatctcatcatttcatctcatcattcatctcatcatttcatattttatctcatctcatcatttcatctcatttcatctcatctcatttcatcattacatctcatttcatctcattttatgtcatcatttcatgtcatcatttcatcacatctcatctcatcatttcatcatttcatctcatttcaactcattgcatctcatctcatcatttccatttcattattccatttcatcatttcatttaattatgtcatttcatctcatcatatttcatctcatttcatctcatctcatcatttcatttcatctcatcatttcatctcattttatctcatctcatcatttcatcatttcatctcatcatttcttctcatctcatcatttccatttcattttcattatttcatcgtttcattatttcatttcatctcatttcattatttcgtttcattatgtcattacatttcatctcatttcatctcatcatttcatccatcatttcatttcatttcatcatttcatctcatgatttcatcttatctcatcatctcatttcatctcattatttcatctcatttcatctcatctcatttcatcatttcatttcatcattacatctcatcatttcaactcatcttatttcaatttcattacatttcataatttcctttcattatttcatttcatctcatttcattatttcatttcattatttcatttcatttcatctcatttttcatctcatcatttttcatctcatttcatctcatcattcatctcatttcatctcatcattttatctcattatttcatctcatctcatctcatttcaatttcattatttcatatcatttcattatttcatttcatttcatctcatcatttcatctcatttcatctcatcatttcatctatcatctcatcatttcatctcatttcatctcatctcatctcctttcaatttcttttcaactttgtcatttcgtctcatcatttcatctcatcatttctactcaccatttcatctcaaaatttcatctcatcatctcatctcatctcatcactttgtcatttcatctcatctcaagtcatcttatcatttcatctaagtgaaatgatggaatcatgaaatgaaatggataggatgccctcagtgatgttaaatttaaaaattgtttcttttcatgtatgcatttttatatttatatgtatttatatttata

SEQ ID NO: 470206 - DNA, 5057 bp, Homo sapiens
caggtaatgcaggcctgttctacctgtgtgagtgagcgcgtgggtgccgtgtgggagtgtgtgtgttgatgtgggtgtgggtgtgtgcttgtgtggctgtgtgtgcctgtttatgtgatgatgagtgtttcttgtgtggttgcatttgtgtcagtgattctggagcagccagccagccaagccagccaagccagccagccagccagaaaaaccagccaagccagccagccaggaaagccagccaagccagccaacccagccaagcttccagccagccaagccagccaagccaaccagccagccaagcctgccagccagccaagccagcaaagccagccagccagccaagccagccagcaggcccagccgccccagccagccaaccagcccaaccagccaagaaagcccagccagccagccaagacaggaaaaccagccagcaaagccagccaagccagtcagccaagccagccaagccactcagccaggcaggtcagccaagccagccaagccagcccagccagccagccagcaaagcgagccagccagccagccaagccagccaagccaatcaagcaagccaagccagccagccagccaggccagccaagccacctagccagccaagccagccaagccacccagccagccaagccagccaagccacacagccagccaagacacccagccagccaagcctgccagccacccagtcagccaagccagccatgccagccagccagccaagacagccagccagccaagccaaccaagccacccagccagccaagccagccagccagccagccagccagtcaggcagccaagccagtggaccgcccagccagccaagccagccaagccacccagccagcaaagccagccaagccactcagccagccaagctggccaagccacccaaacagtcaagccagcgaagccaaccatgccagtcagccagccaagccagccagccagccaagccagccaagcaacccagccaagccaaccagccagccaagcaagccaagccagccagccatccaagccaccaagccacccaagccagccaagccagccaagccacccagccagcaaagccagacagccacccagccagccaagccagtcaagccacccagccagccaagccagccaaggcagccagccagccaagccagccaagccacccagacagccaagccagccaagccacctagccagccaagccagcgaagccacccagccagccaagccagccaagccacccagccagccaagccagccagccacccagccagccaagcctgccaagccacgcagccagccaagccacccagccagccaagccagccagccacccagccagccaagccagccaaaccacccagacagccaagcccgccagccacccagtcagccaagccagccatgccagccagccacacaagacagccagccagccaagccagccaagccagccagccgtgtaagccagcccagccggccagccaatccagccaagccacccagccacccaagccagccaagccagccaagccacctagccagccaagccagcgaagccacccagccagccaagccagccaagccacccagacagccaagccagccaagccacctagccagccaagccagcgaagccacccagccagccaagccagccaagccacccagccagccaagccagccagccacccagccagccaagcctgccaagccacgcagccagccaagccacccagccagccaagccagccagccacccagccagccaagccagccaaaccacccagacagccaagcccgccagccacccagtcagccaagccagccatgccagccagccacacaagacagccagccagccaagccagccaagccagccagccgtgtaaaccagcccagccggccagccaatccagccaagccacccagccacccaagccagccaagccagccaagccacccagccagccaagccagccaggcacccagtcagccaagccagccatgccagctagaaagccaagacagccagccagccaaggcagccaacccactcagccaaccaagccagccagccaagctaggcaaaccagccagccagccaagccacccagccagccaagccagccaagccggcccagccagccagccagcaaagccagccaagccagccagccagccaagccagccaaggcagccaagccagcccagccagccagccagccaagccgggcaagccagccagcgagcccagccagcccagccagcccagccgggcaagccagccagcgagcccagccagcccagccagtcagccagccaaaccagaccaccagccaagccagccagccacccagcaaagccagccacccagccaagccagccaagagagcaaagccagccaagccgccagacagcccagccagccagccagcacaggcagctaagccagacaagccagccaaccagccagacagcccagccagccagccagcacaggcagccaagcaagccatgccagccagccagccaagccggccaagacagccagccagccaacccagccaagccagccaagcctgccagccagccaagccagccaagccacccaagccagccagccaagccgaccaagccagccaagccagtaagccagccaagccagccaagccagccagccagccaagccagccaagccacccagccaggcaagccagccaagccacccagccggccaagccacccaaacagtcaagccagcgaagccaaccatgccagtcagccagccaagccagccagccagcccagccggccaagccagccagccaagccacccagccacccaagccagccaagccagccaagccacccagccagccaagccagccaggcacccagtcagccaagccagccatgccagctagaaagccaagacagccagccagccaaggcagccaacccacccagccagccaagccagccagccaagctaggcaaaccagccagccagccaagccacccagccagccaagccagccaagccagcccagccagccagccagcaaagccgggcaagccagccagcgagcccagccagcccagccagccaagccgggcaagccagccagcgagcccagccagcccagccagtcagccagccaaaccagaccaccagccaagccagccagccacccagcaaagccagcctcccagccaagccagccaagagagcaaagccagccaagccggtcagtcaagccagccaagccagccaagccagccaaccagccagacagcccagccagccagccagcacaggcagctaagccagacaagccagccaaccagccagacagcccagccagccagccagcacaggcagccaagcaagccaagccggccaagacagccagccagccaacccagccaagccagccaagcctgccagccagccaagccagccaagccacccaagccagccagccaagccgaccaagccagccaagccagtaagccagaaaagccaggcaagcctgccagccggccaagccagccaagccagccaagccagccaagccagccagccaagccagacaagccagccagccagccaagccagccaagccagccagccaagccagcgaagccaaccatgccagtcagccagccaagccagccagccagccaagccagccaagccagccagccaagccaaccagccagccaagcaagccaagccagccagccatccaagccagccaagccagccaagccagccagccagccaagccagccaagccagccagccacccagccagcaaagccagccaagccagccagccccccaagccagccaagccagccagccaccctagccagcaaagccacccaagccagccaagccagccaagccacccagccacccagcctagccagccaagccagccaagccagccaagccagccagccccctaagccacccagccagccaccctagccagccaagccacccaagccagccaagccagccaagccacccagccagccaccctagccagccaagccacccaagccacccaagccagccaagccacccagccacccagcctagccagccaagccacccaagccagccaagccagccaagccacccagccacccagcctagccagccaagccagccaagccagccagccccccaagccagccaagccagccagccaccctagccagccaagccacccaagccagccaagccagccaagccaacctgccagccaagccagacagccacccagcctagccagccaagccacccaagccagccaagccagccaggcacccagtcagccagccaagccagccatgccagctagaaagccaagacagccagccagccaagccagtcaagccacccagccagccaagccagccagccacccagccagccaagccagccagccaccgaggcagccaagccagccagccaaccaagccggccaagccacccagccatccaagccggccaagccacccaaacagtcaagccagcgaagccagccaagccagtcagccagcgaagccaaccaagccagccagccagccaagccacccagacagccaagcaagccaagccagccagccatccaagccagccaagccagccaagccagccagcccaccaacccagccaagccacccatccagccaagccagctagccagccaagccacccaaaccagccaagccagccagccatccaagccagccaagccagccagccagcctagccagccaagacacccaagccagccaagccagccaagacacccagctggccaagccagccagccacccagccagccaagccagccaagccagccaagccaggcaagctagccaagccagccaagccagccagccagccaagccagcctagccacccatcctgccaagccagccaagccacccagccagccaagccacccaagccacccagccagccaagccagtcaagccacccagcc

SEQ ID NO: 470207 - DNA, 486 bp, Homo sapiens
atgcctggtccacttattgtttttgatggtagccaacctaatgggtatgagtctcaagcctgggtctgggttccttcggggaggcagttctctccaacctctgagcttgcggtgggtggggtggggagcggtcactgtagtccccagtggggcgcctgaatttgggactttgaagcgacagtgccctaattacctccaaggaccaataaggatgctggaagctgattcaatcagacgtataataacccctccttctggagcggggccaggacacatagaagacgtcctctatgaggaacaggccctcattgacacccaatctactgacgccttgttcgtggatttctcggcctctagaactatgagcaacatatttctgttgtttatatattactgagtctgaggctggtgttttgttttgtttttttttttttggagatggactctcgctctactgcccaggctggatggagtgcttcttttttt

SEQ ID NO: 470208 - DNA, 3129 bp, Homo sapiens
tgctcctggtccggagactacatgtttgagagccacccttacatactaactgtaaattgtagaactctagaaaaaagcgtagtttggactgggagaagaagcacacaggtgatggagcaaatcatgaaaaagtcaacccttgatcccagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacaccaaaaagaagaaaataaataatggcactaaccctgagacaaccacttctggtggttgccactcgcctgaggatgaacagaaggcaagccaccaacatcaggaagccctaaggagggagctagaggcccaggttcaaaccatacgaatccttacatgtcagaaaactgagcttcagatggcactttactacagccagcatgctgtcaagcagttggaaggagaggccagggatctgatcagccgcctgcatgattcatggaagtttgcaggagagttagagcaggctctctctgctgtcgctacacagaagaagaaggcggataggctactgctgtgcctgctctatcctgacttaacctttctctatttgcagtacattgaggagttaacaaaggagagggacgccctgagtctggaactgtacaggaacaccataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagcgggaggagaagatacaggagcaggaggagaagatacgggagcaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggagaaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatgcacgagcaggaggagaagatacggaagcaggaggagaaggtgtggaggcaggaggagaagatgcacgaccaggaggagaagatacgggagcaggaggagaaggtgtggaggcaggaggagaagatacgggagcaggaggagaagatgtggaggcaggaggagaagatacgggagcaggaggagatgtggagggaggaagagaagatgcatgagcaggagaagatatgggaggaggagaagaggcaggagcaggaggataagatgtggaggcaggaggagaagatacgggagcaggaggagaaggtgtggaggcaggaggagaagatacgggagcaggaggaaaagaggcaggagcaggaggagaagatgtggaagcaggaggagaagataagggagcaggaggagaagacacgggagcaggagaagatacgggagcaggaggagaagatacgagagcaggaggagatgatgcaggaacaggaagagaagatgggggagcaggaagagaagatgcaagaacaggagaagatgcggaggcaggaggagaagataagggagcaggaggagaagatacgggagcagaaggagaagatacgggagcaggaggagaagatatgggagcaggaggagaagatacgagagcaggaggagatgatgcaggaacaggaagagaagatgggggagcaggaggagaagatgtgggagcaggaagaggagatgcaagaacaggaggagaagatgcggaggcaggaggagaagataagggagcaggagaagaagatacgggagcaggaggagaagatacgagagcaggaggagatgatgcaggaacaggaagagaagatgggggagcaggaggggaagatgtgtgagcaggaagcgaagatgcaagaacaggaggagaagatgcggaggcaggaggagaagataagggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgcgggagcaggaagtgaggctgcggcagcaggaggagaagatgcaggaacactaggtgaggctgcaggagctggaggagaggctggggaagctggggcagaaggccgagctcttggggggagcaggcggaggtgtgtgcaaaccctggagatcatacagaacgacctcaccacaacttagcagatggtggttggctccctctgcttttccaccagtctgtggcctacagtttaaatggtgggaagaagggtgtgagatttgaggctggggagggaggcatgggcctctaggcaagggaggcagtcatttaggcctggaggaaggggccagggccaggggcctgggtaggcgacagagccccgcagtgccctcactaccctgtttatgggcccagaatctggaagccagccactacctaccctgacgcct

SEQ ID NO: 470209 - DNA, 2186 bp, Homo sapiens
aagaagcttagtggggtagacagacaagtgacaagtttgtgctttcaataaagtatgatggcagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccggggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagtgctagctgagaatcgcttccctcataccactctcagtagttcaccccaagacacactggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtactcacaaagaacctgatattgacggcacatacatttcttcattaggaagaataaatttagactgtaacaatttaaaaaaccagaaaatacaactgtacattttagctcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatcgaataaaccatagttcagaaaataatttctgaattaagaaaatatgaataataaaaccaacagtttatgtgctgaatttcaaatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccatgattatacatagtataagtatatgtgtaaatatatgtatatgtgtacatatatgtatgtaatatgtgtatgtaaatattatgtaaatatgtatgtatgtaagtatatatgtaaatatgtatgtgaatgtatgtaaatatatacacatgtaaatatgtatggaaaaatatgtatgtaaatatatgtatgtaaatatatgtatatatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaaataaatgtaaaatgtaaatgtaaaatatgtaaatatatgtatatgtgtaaatatatgtgtgtaaatatatatgtatatgtgtaatatatatgtatatgtgtaaatatatatgtatatataacacagcatacagcatatgccaggtgtcatttcagtacccataattatacatagtataattatacatagtataattagactactatgttagctaaaaaatgttgattagatacaaatgtataaatttatcttctctaaaagtggaaattctctagaggctatttccagcttctgtgtggattgtagagcaggctgctacctgt

SEQ ID NO: 470210 - DNA, 1657 bp, Homo sapiens
aagaagcttagtggggtagacagacaagtgacaagtttgtgctttcaataaagtatgatggcagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccagggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgaagaataaatttagactgtaacaatttaaaaaaccagaaaatacaactgtacattttagttcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatctaataaaccatagttcagaaaataatttctgaattaggaaaatatgaataataaaaccaacagtttatgtgctgaatttcacatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccataattatacatagtatatgtatatgtgtaaatatatgtatatgtgtacatatatgtatgtaatatgtgtatgtaaatattatgtaaatatgtatgtaaatatatatgtaaatatgtatgtgaatgtatgtaaatatatacacatgtaaatatgtatgtaaaaatatgtacgtaaatatatgtatgtaaatatatgtatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaatgtaaaatatgtaaatatatgtatatgtgtaaatatatatgtgtaaatatatatgtatatgtgtaaatatatatgtgtaaatatatatgtatatgtgtaatatatatgtatatgtgtaaatatatatgtatatataacacagcat

SEQ ID NO: 470211 - DNA, 2459 bp, Homo sapiens
gcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagagcacttgcttggcttttctcccaaaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagggccctttccccctgtgctttgggcaggtttgctcgttgaagaaggagaagaagcatgataaatatcgggtagagaagctggagaggagcttgtccaaactcaaacaccagatggctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggtgaaggagacggtaacctccaccccatccaagaaggtctgggaggtggagctgaagagccaagaggctcagagtctgcagcagcagccagaccattacctgggtcacctgcagcagtacgtggccacctatcagcagcaggagcgtctggaagctgcgagccagcagaaacagcagctaacggcccagttgagcctcatggctctccctggggaaggagatggaggaggacatctggacagtgagggggaggaggcacctcggcccattcctagcatcccacaggacctggagagcagggaggccatggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtggggagacccaccgggccctgcaggaaagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccc

SEQ ID NO: 470212 - DNA, 931 bp, Homo sapiens
taaataaataaaatcaagatgaaaacggggacattttcattgatactgtagaaattctaaggatcattagaggctaggcaattatatcatttattatatataatatatatattatttttctcaacttttttttacatctgaaactttctattgaacacatggacatgtcccttgataactggggctgcttccccattattctctcagcagcccttctgattttcactccatcttcattcttagagattctggattttattttttttttttttgggaagttcaagtatgtctttgcaaggattatcgagcatgtctacctactcaatcatattatcagaaacagaaaaagtgtccagattcttgtcttgtcctgttcagattttttaaattccaagaacagtcaccttctaccagacactctgatgttggaagacaaagcatatttgaaatttaaggactcagctctggtcaaggtggcaaagggtctgtttgtctttcctcgttagacagaggtcttgtcctgctaccctaattgtaaaggggtgactgggaaggggagatagggacagtgtggtggtggagaccccagccccacttctccaggctttgctgacaggggcctgcttttaattttaatttttatttttatcccatgcctttttttttaaatcccataacttctttttcataactttttttggtaacttttcataaaactttcttctactttttggtcacaagatttttttgccacaacttttttacattttttatcccataactttttcaccccataacttttgttaatcccataacttttttattttgtgttcttttaataaacccttgcatagttatattacaattttgtaaaaatgaaacattatctcatgccaagcatgctcagcatttgcacagtatcaataccttt

SEQ ID NO: 470213 - DNA, 387 bp, Homo sapiens
gcggcagattcatgctgctgtcatttgtcgttaaaacgatgggctccctgtcttcagcgtatgtgtttacttgcaggcctgagacctgggaggaagctggagaaaagatgccctctgaatctttgtgtttggctgcccaggctcgcctcgactccaaatggttgaaaacagatatacagctgatatttttaccaaaagtcatatgttttggttccaagtatgtttatggcagttatcctgttagtgatgtgaacagaaaaaataacagtgctgagggaaagctgttccttctacaaaaactgaaggatgctggcttggtttctgtcgctacagaacaagttaccaaacacaaatttggcagcttgtaacaacaagcatttacactct

SEQ ID NO: 470214 - DNA, 815 bp, Homo sapiens
tgccctgagagcatcacccaacaaccacatccctcctcagaagaagcccccagagcacagctcctcaccatggactggacctggaggatcctctttttggtggcagcagccacagtgaaggtctcctgcaaggcttctggatacaccttcaccgactactttatgaactggatgcgccaggcccctggacaaaggcttgagtggatgggatggatcaacgctggcaatggtaacacaaaatattcacagaagctccagggcagagtcaccattaccagggacacatcttcgagcacagcctacatgcagctgagcagcctgagatctgaggacacggccgtgtattactataaatgcaccgttactcatgtggattctttcctcagacaaacacacatgtccccacgtggactctttcctcagactaccacatatgttctgacatttactctttcctcagaaaacagacatttcctcatgtggactcttgtctcagacaagcaaacatgtctccatgtgaactcaattcagataagtacacatatgtccacattgactgtttccttacacaaacacatatatccaatgtcgaattgttctgtggcaaaatgatctcaagataatgataattataaaccccctccctgacaaggcgtagatatgtatttttttcattgtaacctaactttgccttattgtcaagaacagtagtttgcagctctaaatgtaccaattagagacaggtgtccattttctctggaaacatatttttatgttcttactggacatatttgttgataatgtttgctattatg

SEQ ID NO: 470215 - DNA, 645 bp, Homo sapiens
cggcttcattcttgaagtcaaccattagtatgaatacataccacagacctaatcagccatctccacagaagcaaggtacttcaagacaagagaaaaatgattcttccctctcacataattcagaggtcatcagggctgccactcccaccacaggcccagagtgtaagggctccaaggaaatcactatttcagagaggccaccagcaccttcaggaccttggagagctatgggcccaggcagagagccactgtggtggcagggctgcccagagcccttaggacaaaccctccaagagccttctgagctcaactcctacccagcaaggctgcagaggcaggatcaccacctcagctcaaacacagtgaagatcaagctcagccattcattttctccttgtactcatgggagccagggagataaaaggcccttgtgaaagctgattactctggcagaggccacgagatctatggggccaagctttcagcttttcactcaagagctctcacgctggtatctggtgctttttctctgtcctggatgctcacagaatccaaagccttcctggaacccgacatccaactatctgtaaggcccaggagccatttgtctctggaaaggcaggaatgatgaggaggctggcaagc

SEQ ID NO: 470216 - DNA, 688 bp, Homo sapiens
ccccagcaccattcactagtgcagttggaccaaaccaattctaaaaaatatgacagcaggtggaaatggctccaccctcgagggttctctcgctcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaagaagataatcaccccaaatgggttcagaccacaaattccaagttcctgcaagacttgtgtggattgtggttgctgagctgcattgactccacactggggagactggaggaagggaagtgtcttgctcacctccagctctgtggtacttccaactgtggtctcctttctgcatcggcacctccaactgtgatccaccttcctgagcccggtcgctgctgcctgcacgctgtccaggggtcccgactgcacccagtgggacagagggtggcagtggtgagtgctcactcacctcacccactgctgggtcctgcccttggctttcacaggtaagaggactgtggttccattgtgtatgatggattatttaaggtgtcaaagttatttgggtgaagatttctctaaagccagtgtttcaaagaatgaaatatttttgttgt

SEQ ID NO: 470217 - DNA, 775 bp, Homo sapiens
cgggcggcgtcggagcccaccgaggggagagggggtcatcaccccccaacccagccacagatcccctctgatgacaagaccgctgccagagtccataccactcctgaggcacaccggactgcctctgggctccacccaccaaagtcttgtcagtcagccctgccccttcagcaagcagcccagtccctgccctctccaatcaccccatggtgactttgggtgggtgactcttggggattcccactccattactgggccctcacctcctaccgccccaaactcaacctccctgggctctttgggctcacatctccaaggaccttggtcccccagccccaggccccgccctcgccagtcatccctgggtgactttgggctggtgactcctgaggctccctgctgcagactctgccctcccctcctgctgcctcaaggtcgacctccctgggctctttgcgctggcgtctccaaggagctgggtcccaaccctgtgtttccctcccccatcatggagcagcaactcagacatcgtgctgatgtccctccccatgaccagaagggtggaatgtagtgatccatgatatcaatccctctcagtcactaaatgattgtgacaacaccttgtacagttgttggtgtcgttaaatcagatggtgtataagagtattttgtaaaaactgtaaaggaggatgtggctgtaggggctgacagttcttatgagtattactgctcttctttcccacagttaaaagaatattggcagaaaaacagccct

SEQ ID NO: 470218 - DNA, 1862 bp, Homo sapiens
ggaagacagctcagctagtcggggctctttacatgatgggatcattgaggctttatttgtgcctttggttgttgctgcacttcctcactgacctttatgaccggacagcagctcccagccacgaactgtgggctgatcctgtggccggctccctgtcctgtggcccagagagtgtcttcggctggggatcctgctgtcggggccctgctgtgcctgctgccagggcctcaccagcctgctctgagcagctgggccacactgagcacctgccctgccctgcttggcagaaacgtgcacttagcaggctgaggcctaaactcagctatgggcttaggatccagaggaggagccctggagagcagcacgcagaaccttttggctttgagaaggagggggatgaggggcagggggcaggggcgactgcctcacatgaaccgtacctccccagcacctcccatgatccccatctccccaccctggactaagcactgggagggggctgccgggaggaaaggccccactgtgggagataggggagtagggagtatcaaaggggcacagagagaaggcatttcaggaagcaccttcaccaggactggccacaaataatccccaggcagagtccattccagtggttctcacctgcagacctgtccctgcctcctgcctttccctgtgcatgctctgagccagaaaggacaactaagagacggtgacagaggggcttcaggacgccgcctctgtggggagctggtgggctgtggcatcccttagggggtaaccccactgcccagactgctgggctccagggagtggagggggcagagggcacccgcccccacctctgcactcggtggtcctagggcccccggtctgcagggtccattggggcagcagctagaaaaatgtctggctacaagggacaggggcccaccccagaggcttagggcagcagctcgttttctgccacagagagaggtctggggcaggcagctgtgcacgttcagctctgctattcgagggccttccggggggcctccctcctggtgtggtgctctagacactgggccgccagcaaggggtgaggaaggcaaaggccttgcctgctgcggcattgctgatatcagggaagcaatagattttcccagccgaccttgtttagggtctcaggccacccaagctgtgagctaggctaggagagtgaacggggctgtcgaaatggactttgaccgcagccgccgaacagcactcaggagtgggcgggatattaggatattggagggttctccacatcgtgggacactgctatattgccgaagggatctcagggtacactgggacctgctccgagcagctccctcaggcgtcagagcagaactgggcagtgagctctgcagggcacacaaacccatgtttctacaccatgtaagaagtcatattgccttggggccaccaggctgtgaggaatcccaagctaaccacatagaaaggtgatgtggaggaccactaaggcactaagcagtggttctgcctctgccacgtggaggccttcagctcccaacaggggtggaggacctcagctgcccatctctgcctccccagccccagcccagtgtctggcagtgagtgatgaatgcaggcatgctgatccctgtttgcaaagcttggtcaggaggcccaagtggaatctgggccagcctggtacaaaaggacatgatggacacctcaggggatcctaggccaccggaaaggctctgcgtggcccaaggtttcagtcccagagccagcctttttgtctttggcttcgaaaacctcaatcgtaaaatggagctaataaaaacaccaagcccagattggaggac

SEQ ID NO: 470219 - DNA, 538 bp, Homo sapiens
gagcaggggacaggtgacagacctcatttaacttggcacccaaggccatgacagcatgtctgggccaggacagagcagcggcacagcggtgtcagtgccaacctggtcaccataggcgctacagaagccgggcctacgggcaggatgtggcttgtgttccctgcaagttttcccaaatcagtcatatatgcaatctcggaaaatcacagaaatctttgctgttctgggagctcaggaaatgccccttcctgtggggcccctggctggagccctgcctgaagaaaggagcagtgcttttgcctctggcccacgagggtgctcagaaagggcctcacatgctcaaggctgggcctgagaggcagttcctggccccacggaagctccggatggcagcctggtcaaccgcatggcatctgggggatacgactcatgtccaaatccctgttccactgcctgctggcctcatcctctgagaggatcgggtcacttctgtaaatggaagtttccagatttataagatgggagtaaaatcacacct

SEQ ID NO: 470220 - DNA, 907 bp, Homo sapiens
gggtatttattctgcttgatattttctgagcttcacgggtcccacctacgagtgggaacctgcagtatttttgtctttctgttctgacttagttcacgtaatgccctccagttccatctgcattgctgcacattatgcatctggaacagggaaatatccacaagatggattcaaggacccactggaccaactgcccatctacctagtgactaaaaacgctgctagttttgagtggggcccagagcaggagaaggctatgcaacaggcgcaggctgctgcgcaagctgctctgccacttggaccacatggtctagtgaatccgatggtacttgaggtgtcagtggcagatgttgaggctgtctggagcctttggaaggccagtaaagcgagcagctgtggcaccatgcccctttctgggacagccattaaggacagtagtgaagggaaatcttctcaatgggaagaaatggccagatgtgcaattgtataccagatcctgggctgtagcctgtgggttggctggatggtcagggacttagaataagattgaactattggtgacgaagttttatcaaggacttattaattttattcattttctcaaagtacaagccaattgtgtttacatgtttagtttctatttggttaatttgttcttttacttacaatttcccttttttccatcgtatgtgaaaaaaatggaaagatataccatgctcatagattggagacaatattgcaataccatcccaatcaaaactccagcagacttctttattttgtgaaagttgatgacctgattatatactttatgtgttgtgtatgaacaaagcaagagaaatgacacactggggaaaagtatttgcctttatatagcagacaagtaatttgttttcttaatcatttc

SEQ ID NO: 470221 - DNA, 673 bp, Homo sapiens
ctctctcatccccttcagtccatcacgatgcatcatgacacagcacaacaagggctcttcaatcaactctcagttctactttggatggaacgcaagctggttggatgtgggcacccagcagccctccatcaatctccagtctcttgtgctgtacaggaagtgtggtgctggcatcttcttggtttctggtgaggcctcaggaagcttacagtcatggcacaaggcaaaggggaagctggtgtttcacatggcaagggcagcagctagagagggaggggagatgctacactcttttggatcctgcaagaattcactcactattgtgaagacagcatcaagccatgagggttttgcccgcaggacccaaacacctctcaccaggcaccacctccaacactggggattacatttcaacatgagatctagaggggacatacattcaaaccacatcaatgggctttaggaaatgtgttgttcttttttgttaatgtaaacaaaactgtaataaatattttaacatatatcttaaatgtatatattactcactgtattctgtaggctaatttataaaattattgtgttaaataggatgcaaattcaaattttcatgtatattctcaattcctctcctaacaaccgtgcatgtgagtgcaccttttcttaggcccctcag

SEQ ID NO: 470222 - DNA, 690 bp, Homo sapiens
acgcagtatattgcccttgccatgaagtgtcttaaatgtattactgttaatgtacacatgtttaaacaaagggtcagcataggctttcataactgcggtaagagcctagaagaaggattagctgtttttggagagtggttaatagaagaggtgacagctgaactggattcacctcaaaggatagcagtcattctgccaggagaaagggacgccaggggtccctggagagcagacaggcgtgcccttagcttcatctggctcttgagtccccctaccacttctagcagtccggacatcacagagcaggcacttgatgaattaattatctacaggggattagttgttggtaaagggagaattagaagaagggaaataaaacccagtagcagaatagagaaagcccatgaagcatcagtgaaaagattctcagtggcacatcccctgcactggtcatgggactgtaacaacactcttctacgagcgctgaaagtacctaagagccctgtcttcccttctagaagagcatgagcccatggggccaagggaatttattgattttttctggagtatggctatcaggatcacattcctgaaaccagaactgcttctttaccgccattgcaccccataatatcagaaacctagaaataaaccattttcagaattcccttcactgtatttttttggctc

SEQ ID NO: 470223 - DNA, 542 bp, Homo sapiens
tgtgagtttgatactcttgtttttccccactgtccagctacgtaaaactgttagaaggaatgcccaggctacaagctataagcaggcaggagggtggggcccgtggagcccagctctctcccacacgaggccctgggagttcagtcaaccatcctgggtcgcaaaagtcattacccaagaaggcgggagtaaaactcgtgcttctgccctcttgccctgtacgaggtgggttggaactgagaaggccaggaccttcaaaatgctgcattctccctgagaagttggaattgaaaaaaataaaatctaccatccagtgcaagacgatgaaaaagaagcatgactgttttaggctgtgctcagtcagggctcagagtcttccatgggaattcacaacagatgagggaaggggtgcctcctggtgctggtttgatatgtccagcagaacccaggaaattccagcaccaattgtagtggcatgcaaagtggtctgatctgtcctgtttcaaatgctttacatatattaacaaccttctgaggaaagc

SEQ ID NO: 470224 - DNA, 658 bp, Homo sapiens
gcagccattgacctgttatgttttgttttgttttgttttgttttgttttgttttgtttgagatggttttccgaagaaatggtaccggctcctctgtacctctggcagaattcggctgtgaatttgtctggtcctggacttttttgggttgcttccttgcaatgggttcgaacatgctcctttagcttggagaagtttcttattgccgaccttctgaaacctacttctgtcaactcgtcaaagtcattctccatccagttttgttccattgctggcaaggagctgcgatcctttggagaagaaggggtgctctgtaaggcccctcagctgcaggtctgttggagtttgctggaggtccactccagaccctgtttgcctgagtatcaccagcagaggctgcagaacagcaaacattgctgcctgatccttcttcttgaagctttgtcccagaggagcacccacctgtatgaggtgtctgttggcccctactgggagatgtctcccagtcaggctacacgggggtcagggacccacttgaggaggcagtctatccattctcagagcttgaacgccgtgctgggagaaccagtgctctcttcagaggtgtcagacagagatgtttaagtctgcagaagttgtctgctgccttttgttcagct

SEQ ID NO: 470225 - DNA, 721 bp, Homo sapiens
gtgtggggagctcggtgcatgttcacgccagttgtttttctctgtgcctcaatgttccagctggagcggcaaatggaaaccacccagaaccttgtggactcctacatggccattgtcaacaagaccgtgtgggacctcatggttggtgtcatgcccaagaccatcatgcacgtcatgatcaacaacaccaaggagttcatcttctcggagctgctgtccaacctgtactcacgtggggaccagaaaacgctgatggaagagtcggcagagcaggcacagtggcgcgacgagatgctgcgcatgtaccacgtgctgaaggaggcactcggcatcatcggcgacatcaacacgaccaccatcagcacgcacatgggggcccgtggacaactcctgcctgcaggtgcagagcgtccttgccggatgcaggaaccttgccacacccgcacgtgcaccctttactccttggccctcccacagctgctgtggcacacctgcaagtccatcccatcctgagagccccaggcccccctttgacctctaaacagattcctcctcttctcagagacttccctttccaagcctgcctgggcggctgttctgtgacttggcagtggctcccccagccccaaaggcagcccccttcatctgtgacttcgtctattgttgcggtgagctgacacatccaggtgtgaccgttgctgaaaacttgtgcccccctctg

SEQ ID NO: 470226 - DNA, 793 bp, Homo sapiens
actgactgtcccttctccaagatgagtcatattgagaagaacggcctgggcccatggagaacaactgccatcaaacaatcaattggcagcatccatcaaatacctgatggagggaaaaaaggaaagacagaggcacatcggggcagatatcacgaaagacagttttcaaggacacagagagggattctcaccaacagtgcttcattctgcacaaagattctatgcagcaggcagcattttctgcacctgaaacgagaacttgaagaacaatacaagaaatgtgataaaccccacaatgggtatacgaccatctttgatcaattttacaactgctactgctcacccctcaatgcccatcagtctctcacaggaatgcaccaagagaagagaatctccagcaggaggcccagaggtggaagaggcagggatgcgaagaagcagaggaggctggaaggaaccggcgagaagtggggacagcgggagtgtgtctgttcataactccacactgcacttacctctcacggctccttaggctctcttggtggtgacagattctctgagttttcttgtttttgatgacactgataaatttgaggagtaatggtcatacttgatactttaaaatttctcttttgatttcttatttgagccattgatttcaggagtatgctgtttaatttgtacatatttgtgaatttcccaaaatctcttgtgttattgatttctaatttcatacaactgtggtcagaaaagatacttgatatgatttcaacactcttaaatttgctaagaa

SEQ ID NO: 470227 - DNA, 740 bp, Homo sapiens
gcacacctctacaaccctttcagggacaatggaagatgctggtgagagcccctccaagccagtggaacccaaggaagcagagttccctatcagttccagacatcagtttttcttcccaaaagcgttgttctggattgcaggcctaggtcaggacggaagtcatattgaattaggacccaggcatatgacctcgtttaaccttaattgcctttttaaacactctagctccaaatccagtcacgttctgaattttgaggcaccaaaggggtggttagaacttcaacatctgaatttgggggggatgcaattcatcttacaacacccaagatggttcttacatccgttctcagcctcagatgtcctcagtcctggtgctgcctatgtggcgtgcctgagggcagagctcactgccagcctggtgctccacagctgaatttctgactgtccagcaaagtatcctttgtccaatttgtacccacaggtaggctttagctttcaggccaatgttagattcttctcctggctttagaacaacttggtggtctcctccagtttctagggacatctctatgcctctcaactcctgattccatttggacccatctctgtatgacctctcacaatgcgagcttgggtatctttcccttcttattgtgactcaccactaatagcagtacaaaatcctgtttcataaagtgggttcctcagaacattagttatgttggatataaatagatttc

SEQ ID NO: 470228 - DNA, 561 bp, Homo sapiens
ttcagcaggtaatggtccaggccaagcacgtgcaggcctgccctgccgcaagaggcctaggagtcagcccagccgagtgccctgaagaactgagaatcccaccaacagcactgatgatgaccatggagggctatgcctgctgtagccctgttcatggtgctgtatctaaatctgcaattgcacaaatctatgcaatgtggaaactcccctccaaacaccccctgccaggacgtttgtgctgctgtagccatagcagcaattacatacagacctctgattttagcagagaaagcaacatgcccaagtggacactgaatcagagggctcccagcagaatgacactgctgcagaaaccagagccactgtcaactcctcagtcccaaagggcgctaggctatgaagtggtggcggcaggatggagccaggctggggggcctctcccaccacgggccatcttcctacccaaagcatagcattggaatcccacgggggttgttttgaaagttgtgtcgtgacacataaatgtacgcattcggtaacaataatgaatagaaaacttct

SEQ ID NO: 470229 - DNA, 655 bp, Homo sapiens
gggcagcattggatttccacagttctacctctgcccctcccaacaccagtgtctgaaaaatgatcgttttcagttattctttcaaaccctgcaagtatgctttgatgaatagaagaagtggcatctttaatactgagataatcagaaaatttgaagtcatgtttgacaccttactctctctctgtacccccaagccaatcagtcatgaagtcacgagaagttattcaccaaattactttctttccatcatcattactgatctgctgcttcctctcctgggtcccagcgcctctggccagtactgctgccgccacccttcaccaggcctgcagggtcacccacatcatctcccctaccctgccaggttcccctgcagtgtgagcccatgccagcagtgcctgcctgttcacagcagcatagaggggttgtgtcactgtgcgtcacgtctgaggacacccctacagagcacctaccagtctgttagaaaaacccattcccttacgtgactgaagtactgggataaacagttcataaaagaaaaataaaagtgagcaacaagctttataactgtgttcaattctcactagcaattgatttcaggaaaaccacttggcagtatcaccaagatcctgaaatctaatactcagtctcccac

SEQ ID NO: 470230 - DNA, 717 bp, Homo sapiens
actgactgtcccttctccaagatgagtcatattgagaagaacggcctgggcccatggagaacaactgccatcaaacaatcaattggcagcatccatcaaatacctgatggagggaaaaaaggaaagacagaggcacatcggggcagatatcacgaaagacagttttcaaggacacagagagggattctcaccaacagtgcttcattctgcacaaagattctatgcagcaggcagcattttctgcacctgaaacgagaacttgaagaacaatacaagaaatgtgataaaccccacaatgggtatatgaccatctttgatcaattttacaactgctactgctcacccctcaatgcccatcagtctctcacaggaatgcaccaagagaagagaatctccagcaggaggcccagaggtggaagaggcagggatgcgaagaagcagaggaggctggaaggaaccgggcgagaagtggggacagcgggagtttttcttgtttttgatgacactgataaatttgaggagtaacggtcatacttgatactttaaaatttctcttttgatttcttatttgagccattgatttcaggagtatgctgtttaatttgtacatatttgtgaatttcccaaaatcttttgtgttattgatttctaatttcatacaactgtggtcagaaaagatacttgatatgatttcaacactcttaaatttgctaagaa

SEQ ID NO: 470231 - DNA, 646 bp, Homo sapiens
gcacacctctacaaccctttcagggacaatggaagatgctggtgagagcccctccaagccacccgacttcagagctaaagtctggtttaacttcagagatccagaagttgtggctgttccctatcagttccagacatcagtttttcttcccaaaagcgttgttctggattgcaggcctaggtcagatctccctttgaaaaccccagtcacctttgtcttatttggaattaaactgattcatactggagcctctctgccctactgcagtagtctgagtgaaatctgtcttgctgcctctaacagtgtccagtgctctttctctgacaaggggaggtgcctcaccaaccctgagatatctgttaggaaaatgctgctctggcattatgctccaagtgaaccaattccaagatattctgcagaaactatggcccaaagacactgagaacacacagaaatatgcttgtgctttctataagttttccactttgtattaagtgaaaaaaattctataataaaacaaacagtgaatttgtgtcacatgtcaggtatatatgagtgagggccacatggcctcacagtacattacacgaatgatgacgccatgataacctgaatgatgaaaggactgagccttccagggaacatt

SEQ ID NO: 470232 - DNA, 623 bp, Homo sapiens
tgaatttcgccatgaggtccgggttcctggggcttcgctgttgttctgtttattttacccgaaccctcctataccatctgtatgagaaaatattctcaaatattgaatcatctggtgctggaagacccgtggcttacagaagagagaagggacctctgaagttctgcacagttgttgaaaagccagatgcaaaatctgtacctaagactggtgcgctgaagaaaatggctgctgacttcacaacctgtttcagccaaattgcaaagccccaaagggtcagtaaaattcttgctgggcttcatcagacattacatttcataggggcacgggaggagtgtgctcttctgtctaatgaaatgtgggccttcagcctcacttccactgtgattcttgaaaaacatttatttcctcactaacggttcagtgttcagcaacctgggaggtttgccctagtactattctacaaggtcacaggtatactttgcaaggttctgcctctctttctctcggagagcttattctctcttgtggcctaaacctcacctctgtctgcacatgacactcaaatcagtttttttctgctttatgcttgtgtctccagagctgtttcaatgactgtattc

SEQ ID NO: 470233 - DNA, 724 bp, Homo sapiens
acttcttccagaaatgaagagatgtaagagccagggagagccaggcagaagttacaggtccactagacaacctacaagattagaaattaaaacaacaggatgtctgctcttaccattgttattcaacatgatactggaggtgctagtctgtgcactgaggcaagagatagccagaaaagcgtgtatcattttcaagtgccagaataatgaaaatgctcaaaaaagcaaaaaggatggggcatatcagagagatataaaagatgtggatcaaaatgcaaatctgctacacaaaattagtagccagagggttcttggtgagtctggaagcaaagcacagcattgctttttattactcagccgtcatggcccagttgcctttggcagagcttccctgaaagtccgaggaggcctggagcatgcagggagaggacaagcagcctcggagagaaagaggggaggtacaagtgacctggatgcaacacggcctggcccaggaggaattggatactcttaagggatatttcacacaagtcatatgaatctggaagactaccccagatccatataggtatctccagggtctttctttaactatttttgctcaagtaaaagtgaatagcaaaaatggagtattttaaacctgaaaaaaaaaaaaaaaacagaaaggaagtgaggtggcttgacttcctcctaagtttataggtacatgtgcacattgtgcagg

SEQ ID NO: 470234 - DNA, 559 bp, Homo sapiens
cgcccaggttggagtgaaacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtaggaagacccatcgctgagcttcccgtcagcccccagctattgtatgaaattggaaaactagctgccaaattggataagacactgcagggatcactgtttttcattgcctaacgtctaataacttgaaaaccagtgtttaacgtattttgtccactgtttttgctttttctggcaggagggtaagccccgcgttacacccc

SEQ ID NO: 470235 - DNA, 2101 bp, Homo sapiens
gtgcacacaccctgcgatgagatggtgtcctgtccaggctggcaccagggaatgtggcagcacccggaagtttggagatgccaggaaccacagggcctcaaggagggagtcacagccctggctgacggaccaggtctggactccctgaagggccacagctctttgcccacaacgtggcaagcaagggctggtagtccagtcatccctgtgtcctcagctctgctctgctccggctgagcccacggcttttatgggcctcagagggaaggaagtgagcaccaattggtccgtgggcagacacaggcgggccagaaaagacacaagtctccactctggtccataggattggcagcccagtccccagccttcagaccttccttggcctgaaagtggagcctcaccagggacctgcccccctccacccaggagcccatctgcctgctgtgctgaccaaggcacccaggctgcttgtaccaatgggcacctgcaggccagcaccaagccaccctcagcccctcactccccgacccctcattgtccaaagtccagaggggaaaaaggcagcagggcgcaagcatgtgcacaccctgcctgggctcagtcccaaccccactctggggttggagcaggtgccagcagtggggagagaccaggcagtggaaagaggcacttccgagcctgcaagggcagtgcagggccttcccaggcccccaagagcacacggaagtctgggtccacaaacccaacttgggcggctgcagctgcacccaggagggctgggctgctgcctgttgcccgctcctcctggctctgtggagcatgcagccccggcggtatcccctcacagcctgagggaggggctccacgtcctctctgggccccgggtgagcatccagggcagaggttacatcaccacaagctccccgatgttccccgggtgctcaggggcggccgggccgtcaggagtgtcaggctcagcggtcaccctgaccccagggtggcagcgccgctcccacttccagccccggcggggctgtggtggcaaaacggggccccagctctgtgctccctccccagttcctgcattccttgtacaagtgcagcgccaccccgggcccagctccgcgtccaggctctctctgccagacggcgctgctcccccaccagctggtgactcgacctggccccatcacccaccagggcagcaggctgcagtggtggtgggggttggtgggggtggctgtctgcctcctccccataccctccctgcagtggctggcatgatggcagtggctgctcctgacgacccgccaccgccatcggggcaccaggcagctgtcagggccctggcatgcaaggctgtgcccaagggaagcggacatcatggagctaattaaaccaacgtggacccaagtgcctggaattcaggaggctgtcctctcccacccaccccaacagagccccgcagacgctggaggtaggttctggaccctcctcaatccctgctcttggtgaatgctgaaaacaaggacatagttcctccaaccctaggccacgcttccgtgatcccgtctccatcgcggaattcctaagcccttgacttctaaaccgtgctgttatggtgtctgtgtttttcctctttctcatccaagagctgcttcctgacatcttgttgtaccattccttccttaatgccttccataaagagggactgaacacctcctacaacccagaacagttaccaggaagtggacaaagaagcagcaaaggggcagttcctccatgtcgtctgcacatcccagaagtgatggccgcggtcattactgacaaagatgtacccatgttggtgggtctggacaggaggaagtggaaaacgtcaaagtgctccatgtgcacattaacatttgagaagagtttctctggagcacagccaagaacaaaggagcagcaagtaaaaaataacaagaagaagaagaaaaaaaaagtctggtggattggagaacagctatcacaaattctctgtacctttctcatataattccctccacactcatttagggtatactaatgcttactttggacacaattgcaacatctttgg

SEQ ID NO: 470236 - DNA, 679 bp, Homo sapiens
ggtttgtagaggcaagcccagagagagggcatagaaggagaaagagagctccaaggaaaagcgttggggagcgcctgtctttaggaagtggaaggagcaacagccatcggagaagcaagaggagaacccagaaagcagagaggaccaaaatcatgcaaggccagagcagcgaggggaccgaggaacagctgaatcaataagggaatcatgggtccctgtacagtggagagaaagaatgccccatgttcacctgctgcaggcctcacagagcaggccatcaggaccagctgggactgggtgacaggtgtccccaccttgggtggtccagcatccaggaagaaacagtcaatcctcctacacacccaggaaccagagggcagacctggggagccaggcctgggacagagcagccgcctcaccctgcgatccctccccaacccccactctctgggcctcatgggcaggggcaggcctgaggccccccttggtgagctacagttccagcattctgctgaatttctgcaaaaatcatataacccacatatacaccctcccaattcatggatagaggaaactgagacccaaaaaggggccacaacttgcccagtgtgcacagcatcataatctaggcacgttaaggctggaacctgggccttctaactctaagccaatgcctcct

SEQ ID NO: 470237 - DNA, 1642 bp, Homo sapiens
cttcaaagagcataggaatcacctggaaatcttgttaaatgcaaatttgcttcagctgggctgggtgagattgccagtccgtatgtctaacaaactcccagccacagcctatcattggcagagccaggaagccttccagatacagcagccctgcacctgcccccggtcacaccctgggcctgggcacatgctaggtcctctgtctggacaccctcaccccctggtggcctccatgtcagtacccaccagcacctcctgtgggcgagggccgcccctgcatccagccctggaggactggaatgcaaaacaagtgccccctgccttctggctgcgggacatcctctgcttccaagcccagacatacacctgctgccacaagcccctgaggctcttcagaggaccaatgggcagccacacccatgctgggccagcctgctgggcccacctgcaccctggtgattccagcctcatttctccatgggccaaatatcctaaacaaaggcctggacagggggtctttatccgagtgcccaaaaagcacatgcagaaaggctctgcatgccccctgtggcctgccagagccaggagtcatccacgggcccccgtgggcgtgctgacagtggtcgtgttgatgttcaccgatgttgctgggtgcctccgtcagcacgtggcgcttgcgcagcatctcgccgccccactgtgccttctctgccaactcctccatcagcgtgttctggtccccatgcgagtacagatgcggcttctacactgcttcaacttgaagatctgcgtccccactgccttttctcactcagatggggacactgaagtccagaggaaaagccacctgtccaaggaaccctccctggccacacggtcattgcctgttctgggccaccctcatccgtatatcccctggaccgcagctgttggctgctctgaccctgagagccgatttggacaatgggagctgaggtgctggctgaggccatgccaggcttcctggaggcgctgccaggaggagccgaggcgagtgggcgtggctctggcgagtgcccgccccttccctggcaccgcaggccgacctggcccctcccacactgctgggccttgcatggtcctgcagcgcctccttgtgagcggctcgcgcctctggatgagagttaagcatgtccaggtagtagtgggtgttttgaaacataaaaggttgcaccctcgtgtgtgcctgtgttaaaaggagcccacgcagccgacagcagcaggagcaaatggcctgctctgatggggacaggcaggaagtccttcggggcatttctgtttcatcacagcttttcctggggctggaagctgatcagtatctcctttggggacctgaaccctttccccgtacgccagatccggaaccgacgtgcctaccacttggagaaagtccggctggagctgaccgagctggaggccatccgtgaggacttcctgcatgagcgggacaccagccctgacaagggtgagctggtcagtgacgaggaggaggatacctgagtgggctccgggacgctgctcttcctgccttcacaaccaaagtgtgcccaaagggtgaaagtgcacttaaaagccagaatgtaacgtgtgtggcctctgggga

SEQ ID NO: 470238 - DNA, 581 bp, Homo sapiens
cctgggaactcttggaggaaaatgaagcatgactgagtgcaatttgtctgataaacaaaatctgtcaggacgtgggaccttattggtcctgggtagtgaagaccttttagctgaagttggttatgagagaggatggggagggggaaaagggttggggcgagcactcttggagcttgcactgtttcttgccggtgcccaggcacaatgcgaatatgtcagtctaaatggagagctccatgcatgttcctctctaatccgtttgtcaccaataccagttcccaaggcagagccccaggagggctggactgaaggacctggaggtaatagaaaacaacttggctttgggtttcaggtcaagctgtgccatgacttgctgtgtaacatcagacaatataattgataaataaaaattgtgtatgtttacagtgttcaatgtgatgttttgatatgtgcatacattatgaaatgattaaatcaagttaacattttcatcacctcacatacttttattattatttttgtggtaagaatatttaagatctatttgcttagagtagtgtttactagaggtgaggaagggt

SEQ ID NO: 470239 - DNA, 942 bp, Homo sapiens
cacaggaatgttcagaggcacagggaccagggacatcaacagatactttcttgtaattctgacagctgctataaggagaggagtctggggcatctggccgcgtttccaaatctgctcggcccttttcttccaaggatgatctggttctgctctttgatccagggcactgctttaaagagcctgtttgtttgtggcaggcaccagactagtattgtcactggttcatggactctgaaagcacctagaagatccactgttcctgtggcagtggatgatggcagctggtacaccctgggtgcagctggtgtctttgatttagtacaagcacctttcaaagatttcattacacttgaaagcctcacctccggaaggcagtggccctccaaactgttctaccctctgcctgatacccagtttcaaagttacttccacatttttgggtatcttttcagcaacaccccactatactcataccaacttactgtattagtctgctttcacatggctgataaagacatacccaagcctgggaagaaaaagaggtttaattggactttcagttccacatggctgcagaggcctcagaatcatggagaatatccatattgcccaggaaaagataaaaattcaaaatttgaagtacagtttctactgaatgcatattgctttcacaccatcattaaggttgaaaaatcagagaagtcagggaccatctgtataaataaaccataaatgaaaataaaaccataagctccttgagggcaggtgtttaagcttgttcaatagtatatttagtgccttgcacagtgcctgacttatgataggcattccacaaagacctgttaaatgaatgaatgaataatcatacctcacatttaaatagtgctacaaatatggttacaaagtactttcttatgttatttgactcccatgatactctcc

SEQ ID NO: 470240 - DNA, 961 bp, Homo sapiens
gggctcctgctgtatgcttggcactgttctagatgctgggttggaacagagcaggacagacacagaccctgtcctaaaggggtccacgttctctaagccctgggaaaccaggactccatcatgcccatatctcctcctggccctcttctcatccagaagcccttgggaagcacagggccaggcagtgggcagaggggggcctttgaggatgcacaatcctttgaggatgactttgaggaccagcagccagaagccaggcacccatgcgcctcccagacaggggcccagtccctgtggcctctgctagcagacgactgcggcccccagcagtggtttaaacacaggagaaagcatcacgttgatgctggaggctctcagcgaggggcctctcagctggctgtcttcctcccacccctccgagagggcctgctgggagaggatattcctgttcctaaggagcccgagctgggagcgcacctgtggatattcagcttgcccatagatgagctgcttcccctggccacgtgagatatggatgaggaccgacacagccagtcctggaggtcgatgttgggtccgctggggccagccccacccagcctgtggacacagtgccatgttactctttgtcctggtctgcattcactggccatccacacacatttttctgagggatgcttggtaactaaggccaccaggtggcgctgcaagggctgggaccttgactgctggatctaaggctcagtaggttcttagcgatcttccatgacaggccaggattcccctgagagattcctaggaaacttttaaaaaaatatatgggcccagagtgtctggtttgatattttggattggattctgggaaactgttattattttaaaatagtgttaattttctgcattggtaaaatattcacatggctcaaaaaatttaaagtataaaaaggtatataagcctagg

SEQ ID NO: 470241 - DNA, 869 bp, Homo sapiens
aggcagcagaaacttctgcagacttaaacgtccctgcctgacagctttgaagagagcagtggctctcccaggacggagtttgagatctgagaacagacagactgactcctcaagtgggtccctgacccccgagtagcctaactgggagacacctcccagtaggagctaactgacacctcatacagccgggtgcccctctgagacaaagctttggggatcaggcagcaacatttgctgttctgcaatatttgctgttctgcagcctccggtggtgatactcaggcaaaaagagtctggagtggacctccagaaaactccaacagacctgcagctaagggtcctgactgttagaaggaaaactaacaaacagaaaggaatagcgtcaacatcaacaaaaaggacatccacaccaaaaccccatctgtaggtcaccaacatcaaacaccaaaggtagataaaaccacaaagatggggagaaaccagagcagaaaagctgaaatttccaaaaaacagagcacctcttctcctccaaaggatcgcagctcctcaccagcaacggaacaaagctggatggagaatgactttgatgagttgtcagaagtaggcttcagaagatcggtaataacaaacttctctgagctaaaggaggatgttcaaacccatcgcaaggaagctaaaaactttgaaaaaagattagaagaatggctaactagaataaacagcgtacagaagaccttaaatgaccagatggaactgaaaaccatggcaggagaactacgtgaggcatgcataagcttcagtagccaattcgatcaactggaagaaagggtatcagtgagtggagatcaaatgaatgaaatgaagtgaga

SEQ ID NO: 470242 - DNA, 1414 bp, Homo sapiens
cagaacattttatggcatcatgaacaggattcgaaaacaaaagtatgccgctttttggctggaaggacaggaatggaagctcagggacttcccatatcccaggatgggaactcccccagttttcccccttggcaattgaatggtccaggggaactggcctttgtgagaactgggaatctaaattagtgcaatttgaacctttggctgtgcgtgaagtgctgcaggggattccagtgggcaaaggagattccaaggagatctggcatggatggtgcttgcttactgcttataagttaatgtgtcaagataggatccctatcttggttgctacaataaaaaagctggctttggcccaatgccaggcctatgtcctgactgatcaagcccaaagctaccaggctattgctgacaaaacagctgtctgggtggcctggtacaagtataagaacaggcaaggcaaggtggataggcagaaggtacagatggtctggagagacgctgtagaagactttacccagcaggaaataacagacattttacaaacctttcgacaaaagggaggggaaagtgtaattacttggttggttcgaattaatgaacagggtgccaatggcattagagtggactcagggaatgttttaaagtttgttaccctctcatgggtacccaaaattcagctggctcttcgaaattgggctactgcaccccaccctactaatgatgagggaaatgttttagatgaaatatctttgtggcaattggccatcaatgtggccagacagaaatattccacagaggatgcctggccagatgggggaaagccctggcatacacttaaggagtatgctatgcggttaaaggaggaggccatggaaacagctgtggtactgggaatggctgataacatagaggcaacacctttaagtcctacaatccgcaataagattttaaagattgctccacctgcttatagaatggtgttaacatctttattattttcccatacagatactcccacacgggaggtactggaacaactaggtcagctacaggacttgggggatcggatgccctgtggggaggagaggattaaggagtggggcagacaaacccgggaccaatctcaggttagtcagaaggatatgtttgcagatttattgaaggcaggggttcccagagaacaaattgatggcaaggaagctaaagagttatggaaactataccaacaaaaagtgaggaatgtgcgccaaataacaacaggtgggccctctagtttggggccgggagtcacccctggcgtgcctccattgagtacccctgtaacccagccatcgggaggctcttaccaagaattattggattctttagcaggactatgacaggaaggctaggcccctttgcaaataaagtgcat

SEQ ID NO: 470243 - DNA, 531 bp, Homo sapiens
gaaaccaatagagcttccagaatgagaaagttcagtcgtcttgaaaagcaaagaacccatgtcctcagctgttcggatcttcaggctgttcgccggtttcgaggagtggtgtcagagggcagttttgaaatgggagaaaaggtttataaaaggaaagacatgttccagggacgttccatgctcaaaaaaagaattcagcgatatttctcccatttgcttttgaaagaagagaaatatgactctgttctgcgcggctcaccggcgccacaacagctgggaatgtgctgggtcacatctcaagccaacctgtctctgagtcttacccaaggcccacaaaggaactatgaaagtagacgtgggaaggaggaagcaacagaatcccaggaacagtgcccagcaacccagagaggaaagagaatacagaggttcggcaggacccaggtcctggtgggaattatagccatagcaggcttttataatactgattagggccagtgtttttgccaatttccagttaagaagctgacttga

SEQ ID NO: 470244 - DNA, 799 bp, Homo sapiens
ggcgggaagggagggaggatgtggtttcaggtctcttaccctgtttgaattttcatttttctctctcggcaccagtcttctccaatctacgtagccctcaagggtagggaccacatcctattgttcatcacgagtggtccatggtaatgcaggggtctcaggcttggcagtgcaacagaatcactgggaagctccagaaatctgcagagatctgggcctcatccaagaatcactgggagggccagagaaaagaacttgaggctaagcttctaggaaaaatgccccaaaccacactgcaggcctggctggatgaactaaactccaccctgctcctgcgccatgaaacatcagtgccaggagcctgccctcactttagccgctgctgccgtcagcacggggcccactatgccactgggagctcgaccctgcaaccactacccccaaagccagccacttctgccactgacacttcaacattctcatggggacaatggcatccagctccatccaccattcctgttggtcaatctgagctcagtcctaccacctctgccgcacccagtgctaggtcaaggatgggcaggatgtagcaaacagctgtcgtacctgtagcctatctgtattgagatgtccatgctgcaaaggacatgatctcattctttttcatggctgcatagtattccatggtgtataggcacttttccgtatgcttcacatatattaagttggttaattttccctactcatgttcttatgttagatgagaacactgaggcactggccacccggaggagaacat

SEQ ID NO: 470245 - DNA, 1128 bp, Homo sapiens
tgaagagcaggtcctattcacatgactctggtgttgtccattgggttttactgtgagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccgaaggcatgggagtcactggatggccaacttaggggccttggatttggtgatgttatttcagttgccatttgcaaattatgctgctgttgctgctgctgctgctattgctactgccagtgatagtgatgacaatgttaatgaagcagcagcagcagagggaggaggaggaagaggaagagaagaagtaggagaaggagaagacagttactttgaactcttactattaatacatcccttggctgtcttagcaatttatgcagactctccaatattgataatttcaaaagcttttgagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaagaggattttgaagatgatggcgatgatgaagtggacaaagactctgatactgaagatgggaaagtggaagtaggtacaccagcccatgcttctaatgatgtccatagtcacatcatgcacagaaaaatattacttcctgtgtttgcccaagcccagtgtaaattttaagaactgactttagtactgccactccagtggtcgtgatgcgcagtaaatgatagctactgttattgatttccaagttgtcattttcatcttggtaggtccggtacaatgtctcattataaagtcagaggctatcctatacattattatgacaccaatactttattcagatgacctttaggcacacatttaacacttggagttggtatatttgataagaccatttaagaccctagaaagattttccaggaagctttctgcctttgtgctttattgggtatgatccgtatgcaacatgct

SEQ ID NO: 470246 - DNA, 978 bp, Homo sapiens
tgtagacagactgggtgcagatggctggtgtagacagacggtgcagatggctggtgtagacagactgggtgcagatggctggtgtagacagactgggtgcagatggctgggtgtagacagactgggtgcagatggctggtgtagacagactgggtgcagatggctggtgtagacagactgggtgcagatggctgggtgtagacagactgggtgcagatggctggtgtagactgagtgcagatggctggtgtagacagactgggtgcagatggctgggtgtagacagactgggtgcagatggctggtgtagacagactgggtgcagatggctggtgtagacagaccgacctgcacaccaagccctgtttgggacgaggcttcctagacaggttttgattcaatggtggtttctgactgcacagacaggaaaccagagatgggcacgggtacctgggccagacgccaggagccatcactgggtcctgatgggcctgaatggctgtgaccaggtggcagcccagagcgagcctcctgggggtgtgggtttcacacctggctttctcattcaccaccctgctgtgctaagaaagtggccattgatgggaactggggcagagcagggacagtgtgggtcccccgctgtccccagggccctgcttgaaggagccacgggtgtctgctgcccacggatgtcttgctttttgcagggaaatcaggaggtgccacaccctgggctacagcattgtgggtatcaccatgtgttggtgccagagggacacgctaacccacgggtgacacagaagctgggctgggctgggctgtgtcccctgtgggcgtggagctgcgagccagggagtgcagatagggtgagaaacaagcatcttaactttaaaatgttaccctcgtttcaataaaattttaaagttaattgggaaaataaatccttcattgaagagtgaagctttaaaatgggttttc

SEQ ID NO: 470247 - DNA, 4241 bp, Homo sapiens
agtggcacccccaaaggtgctccccagaatcgggatgctgcagacacatcaggccaggagacagcacacactccgccctcaaaggacacaggactcaggagcattcgaaggctgctatgaataaacctggttcatggctcacttgggttactcagcacctcaacctacccaattgtcagtatgcaggcagcttccctggggcagctctggcctggcccaggccctgagtggccccagtgggagtcatcctggggaggtggtgcaggtgggacccactgagtggagcatggggcctgccccagtcaccatggaatcaggcagagtgtcggcatttcagctcctgcagaatacgtctctcccggggatggcccagtgtcggcatttcatctcctgcagaacaggcctcttccggagatggcccagtgtcgacatttcagctcgtgcagaacaggccattcgagatgcctctcctagatcatgttcctcttccttcctgcccatttctcctgtgtcaattgagcatttgccccaaatcctaaagcacagccatcctggtgcccgatgtgcaggggatgaaacttaccctaaatctaggcttggttgtgcctcagtgacagggccacgggtctgcctaatgcacctgcccctctgctgtgtgacagcacaaggagaaccaccaggagctcgccctgcaccatggattcgcctgcacattttgtctttctcagttaactcacatcatgccagacacaggacaagggacttccgtgtggatccttcagatctggaatctcttgatgcctgtatccagaggacgctctctgccttgtacccaccgtttgaagccacggcagccacggtgctctggcagctgttcagcgtggccgagaggtgccacggtggggacgggctgcactgcctcaccagcttcctcctcccagccaagagggccctgcagcacctgcagcaggaagcctgttgtacatgtagcttactaggattgaccattgtccgtaaagtgtcaacaaataccaaagaatttatatctaaaggccacagtgcaataaaactagaaatcaacaacaagaaacccttacatttggaaaatgtttttacccatttatgtttaatgttccattattggaacactaagcttgtgggagttatttatatcctactgctgaatgtcatcgccaagagccaaagaacagatgtgtccagttacaatgtggaggaacatgaagacctttaccaccaaaacaataagaaacccctagaggagcctacacaattgcatcgtccttcaaagccacccaagaggtatggatatggaagacacctaaaaggaccaaactgtggagagacagaagctcgtcatcacctgacagaggaaggaggcaaactgcatgcatcagggaacagtaagaatgaccgatgacttcctcagaagcactgggcttcagaagacaatggaaaaacatcttttaagtgttgaaagaaaaaaattctatatccagcaaaaataaatgtctacatccagcaaaaatatctttcaaacatgaaggcaaaataatgacacttttaggttaataaaagagtagaccagcagaggtgaataaaagaaatgccaaagggtggtctttaggttgaagggaaatgatactagataggtgaagggtacaagaaaggctaaatacgtgagtaaatatgaatgtctttaaaagattattaactacttagatcagtgtatcatggggtttttaatcaatgtaaaagtaaaatatatgacaacaaaagcacaaaatgttggggaaagtaaatgaaattatactactgaaaggttattacattgtttcgaattttaaaatattaattgaagttaggctgtacaattcatagaacaattggaaaaaaaatcgttaagaatatcaaaaacctgaacaacgttaataataaacttgacctatttgacatttatagaacattgcacacaacaaatgcagaatacacattcttttgaaggaattaatctagattatccaatttattgatgtacagctaataataatttttcataatcctttttatttctgtagaatcagtactttgggtttagtttttttcttctttttctagttccttaagttgtaaagttaggttgttgatttgcgatctttactttttaaaaatgtaagcatttatagctataaatttcccccttaatgctgcttttgctgcctcccgtaagttgtaatatgttgtgtttttgttttcatttcacttcaaacattttctcatttttcttgtgatttcctttttgatccattgttgattaatttccacaattttgtgaatttttcagtcttatttctgttattgacttccaacttcatccctttgtgatcggcgaagataatttgtatgatatctatctttttaagtttaccgagacttaatttgtggcctaacatatgttctaccctggaagttgtctcatgtgtgcacttgagaagcatgtgtatgtccagcaaaaatacctttcaaacatgaaggcagaataatgacactgctggctagagtgttctgcatatgtctgttagatggagttgatttatggtgttgttaaagtcctccatttttaaaaatacatcttctgtctggttcttctgtccattgacagtgaaacagtgaggtattgaagtctccaacaattattgtagagctgtctgtgtctgtcttcagttctgttagtttttgctgcatacattttgatggtctgtcatttggtctgtaaatgtctataattgttatatcttcttgctgtatttaaccttttcttaatatataaggttcttcatggtatctggtaacattttatgatttaatgtctattttatctgacattagtatagtcattcctgctgtctcttggttactatttgtgtggatatatttttccgtcttttcagtttggatctgtttatgtctttgaatctcaatgtttagttgattttttgtagtaaaagtcttaaattctttccttgtttccttttgtgtacattctatagctattttccttttgattaccatggggattacacttattatcctaaagttataacactaatttgaatttatacaagtttaacattaataacataaaaaaattctgttcctttacagctctgtctcaccccttttggttgctgatgtcagaaaattacatctttatactttattagtatgaagtattactaattattactagtagtatgaagtattaaacataatctaataattcttataaatatattagtgtcttaaatcatgtagaaaacaaaaaggcagttacaagccattgttacaataatactagctttcataatttgcatatatttacctgtattgaaatctttatttcttcatagtccttcaagttactgtctaatgttctttgagttcaccttgctggactccgttgtttctgcagggtgggtctagtggtaacaaatccccccagcttttgtttatctgggaatgtcttaatttcactctcacttttgaagcatagttttgctagatatgagtccttgtcaacaggatttttttcttttatcattttgaatgttttgtcccactgccttctggacttgaaagattctgatgcaaaatatgccgacaatcttattaaggttgttgcatgtgatgagtcacttctatcttgctgctttcaggattctttgtctttgtcattcaaaagctggattataatgtgttttggtgtgggtctctttgacttcctcttacttggagcttatcaggcttcttggatgtttgtattcatgtctttcctcaaatttgggaagttttcacacattatttcttcaaatattctatgcctttttactctccttctggaactcccattttacatatgctggctgctcgatggtatcccacaggtcttttaggctttgttcacttttctttcttctgcctgctcaaatccacctttgaacccctttagtgaatttttcatttcagttattatacttttcagctccagaatttgtttggcttctttttaggatttttaatatctttgttgatattttcactttttcatacatcactttattttcttcacatctttctttagttttttgagcatctttaagactgttgttttaaagtcttttcctagtaggtctactatcaagtcttttccagggacagtttct

SEQ ID NO: 470248 - DNA, 678 bp, Homo sapiens
ttaccctcacctctacctagaaaactcctcctcatgcttcaagaatgagctcaaatatcccccagacagcacagaaagccctctgcctctgtggccttggaggaagctcctctacaggaggagggaataaagtccatgagaaaccagaagaggtgacagctgggcagcagaagcgccaacagcaccaggcctccagctcctttctagaagtttccattctagagcttccattctgtgaacttcccacacaacatcctggacaggatactctaactaccttaggtattctttgccaaaatgaggtaggtgttcattgccaaaaggtaggtattctttgccaaaatgagaataaggaacaaaatggtagagaaattgcccaaggtcaaacagagaaaaagaagcattttagaaaagtatatgtgtcctccctggagccgaaaacagcatggggcagcagaagtgactgcttttccatgccaaacctcacactgatgagaaagatttgcatgtccgatgacgcaccaaagaagctttctgagggctccccagaagcagatgccactatgcttcctggacagcctgcagaactgtgagccaattaaacatttttaatataaattacatagtctcaggtatttctctataacaacgcaagaatggcctaataaaaatgggttt

SEQ ID NO: 470249 - DNA, 701 bp, Homo sapiens
actgataacacctggtaccgtggcatgcctgggcatctaacaaagatctttatctcagaggtggcaccaccacctgctctcagccaagccagggacccagaagtctcctgggtcagcacaatgcttcacttcccaccttcctcccctgttgttgacttctttctgcttgctggctctatatcttcacagcctgtaaaagcagggaatggaatgagcctctatgtgtccggcatgaagatgaaggctattggacttccaagtgagtgtgggggccattatggtgcttttcatccagggacagaaaggaattgggatgtgatcaccaggctacctgggaagcaactgggatgtgatcgggtggccaccacagccacccgagccacggaaggagtttcagcaagtggtaggaatctgaggcttcaagataaagccaaaagcttcaagatggctccttcaaagaggttctttggcctggacctagggaactttgagaagatgtgtttgattggaaggcatgtgaatattcctggagcttctaatcaaagaccatgaaataccattgcaatgacatgaagtcagaatacatacagtacggtctaaccaccaggaagtaggaagggaaatttacctttctggttctgaaggtgttcttcctgttaatttagccgtcaaacacatcagtttactatggcagtgctggc

SEQ ID NO: 470250 - DNA, 567 bp, Homo sapiens
cacagcacacgtttcagagagcatggggttgggggtgaaggctgttggaaggcaaagagtattttcaacagacattcttggtaaaatatctcatcttcttcctgaaaactccagagagcccaccagagcatataatagtcgctgctccaagaaggctgagattctaggatgcacgcacagcccactctcaactcatgacctcctctgtgcccagggagcagaacctgctaatgagaggaacagaaaaacccacacagagagaatgcacattttttctacccacggtaaaattgacaacggaaacactgtcttctccaattcccaatgcactgcaccactgctgcagacaaacagtgagtctgaagtgaagcgggagggagttggtagaaataaggccccacccagcgtgaagcttccagatgatctgggggccacgcgatgcaggtgctatcagcaagtagcaggctgcatggctggcttgtgagttattgctgtggtcacaagatctccttgctgtagcattctgcgtgtgtaggtgataaatcttagggacacgagggaacacat

SEQ ID NO: 470251 - DNA, 844 bp, Homo sapiens
gtatctgctacctactgggtacaatgtacactattcagatcatggatacacgaaaagccagacttcaccactgtgcagtatatccaaaattgatgtgttcccagaaaatatctttgggtaaatccattctctcatcaacttccactaagaaattgaagaggaattcccaaatggagatggagaaaccttcaaaagacaaagttgaaaactttcataaaggaggggtttctaataatgggcaactttgtggcacggagctccttcctttactccaggatggttctgagctggctccaccatgtgaagatgtgctggcttccccttcaccttctgccatgattacttattcactatcacaagaacagcatgggaaagacccacacccccatgattcaattacctcccgctgggtccctaccatgacatgtgggaattacgggagctgcaattcaagatgagatttggatgcagtgcctctgagggtcatatttaatgatcatacatccctgtgtgaggtgaccccaggagaacaagaaaaggctttataaattgtactctaactaatttgctcataagctggcatttcctcttcaccttgcactttatatcaagagccgttcataaagtttcctatatttatacaatattttgtactaatcaaaatgtttctcagctacataatatctattctttgttaatggaaattcgggttgcttataattttttaacatttattttaagttcaagggtacatgtgcaggcttcttatgtagtcttcccccacactagttcctgaataaccaacacaatgatctttctgcaacgcgagacctgatcatagaac

SEQ ID NO: 470252 - DNA, 582 bp, Homo sapiens
ttcctgttgtaatgcagggcaggcaagcccccacatggggcgtagccgacgaaggttcttcgctttgccaggaaagaattcaagggtgctcaaatcctattgaaacaagagagttccctgaccccactgaaggatgtgtgacaggggtgtggcttgtcttttcgctcactgctgatgctcaaatcccttacgggagaaagagcacacagacggacagatgtaggagcccaagtgggcgtgtgttacagcgcggccttttagccttgctgtccgtggatggcttaagtgttaaccagctcagtggaccctccaactttctgaaaggacagagggccagtctgcaggtatccaggcttgagagtgaggcctttgctggggaactgccctcttctacccagtattttcctgtctcctgtccatatcactatggtagaaagtcttgtttatccccattctttgattttcccatgtgttggctgtgggctcctgagtgatattcatggaccctgattggctgggtttgagtcatgtgcctactcttaaaccaatcatcatgtgggagggaatgcagtggtgacactc

SEQ ID NO: 470253 - DNA, 721 bp, Homo sapiens
ttgcctgtgctgtggatgagtcaccactgccttcgcggcaccgttgagaaatgcaagaaactgacggtcagacattagcaccaggtcttataaggacaaacctaaggcccgttggaggagggacaaagggacttttcctgggtgctctgactttgcataccttagcacagacacaacgtgaggcagaaccacttcatgtaaggttcacagagaagcatggaagagcacggggcctgggcaggctgttgccaggatcttccccgcactctgcagtcagtcagcctcctgagaggccaaatcataatgagaatgttgctgtggttggtgaagataaaaatcaccaaggattgagtgggtcttatgaagatgttcaggggctggaggtggagggctgtgaattaaagcaacatcggacaggtgaacagaagaaaaggcctactaacttattactgctaaattttatgtgcataggggcatcatggaaagaagtgaatacgcaaaggagaggaggacagatgggccatgtggtggcttgtgacgatgtctgggtgtggcgctgacttctctgctctcttgtgataacagtcaatcttccctggttataaaatgcctggagatgggatttatgacagttgaggtctttttgaagggtcccttttctgggcaaaaatgagaatttagagaaagtttcttcctgcgttccttgattctcaaatgtctt

SEQ ID NO: 470254 - DNA, 627 bp, Homo sapiens
tcccacaggtcctgctgcaaatccatagagccagaaagtggcttaggggttgcttggggtgatggagtgtgaagggagagtcactgcaaatgggcactgggttcatttctggggctatggacaaatcatcaggaaggccctgttgttcggcagcttaaatttctccccaacacagccatgtctgactgtcactgtcaccactcctcatgggctgcagcagtgtatccgtctgctagggctgccatggcaatgtaccacagaccgtggtcttcaacaacagaagttcattccctcacagttccggaggctggaagccccagatcaaggtgccagcaggatgggacagatgggaaagacttgtgagatggtgaaaacagaggagggccgtgtgaggagagtagcagggaagccccgagggactgagacagactggcaataccggtgtagtagcgaaatcaacccccaagctgtggactgagtccatgacatatttcttttataaacttggtgaggcaaatgtaatgaataaattaatagaaaatgatgaatggataaacacaataactgagttcataaataaatgaattcatttaataaatgttcatctgttgagtgataatctttctc

SEQ ID NO: 470255 - DNA, 733 bp, Homo sapiens
tgctctgcaaggggccaggggatcccacagcgggatgtggggcaatgcggggtggttcagggtgatgtcgcacactcggtgggtctgtgccacagctaaaataccaggcaggacaaataccttaggaaaaccacaccagggaatattgtcatatgaaaaccagagaaaagcaaagagaaaagtcttgaaagatgccacggggaaaaaaaatcacttacatatagaagaacaagaattagaattacaacaaatgtatcatcagaaaccaagcaaacaagaggaaagtggagtgaaacttgatattgaaggaataaaaagaccaatttataactatatccagagaaatggttcttcagaagtgaaggagaaacaggcttttttaatacaaaacctaagggaattcatcaccagcagacctcctcttgtctggtcacaggttgtttttaagctcctggaaactttagggctcaaagttttttttgttgagggatctgtgaatggcttgaggtgatttttttaagccattaccacactgtgctttgattttccagagtgggtacaagatagtgcctgtgcacactcttatggcccctcaaggatgagggagtctccaggatgagtcttcttggctgtccctttccttgttttcttctaataaacctcaaactcagtgtttgccaacaggggtttttagacttccttaagggctctttgtctgtttgtatactggtct

SEQ ID NO: 470256 - DNA, 849 bp, Homo sapiens
gaccaattattattttggagaaacagcttaataactgcctgcccatcacctgattgttgcctgacattcctgaatgttgatattgacccccaatctcttctggcttgtggggtttctgctgagagtttgtgaatccactgcactagggggccgaggtgcttctggaccattggtcactactctggtgggtggtgtcagccaaaatgtttatagtggggagacagctggatctgtccttgtttgcatgtgccagcagcaacagcagtggcaacacggcagggtgcacactcattaactgcagcagggtgctagcgtgggccggggtgcctgcctccatgtgggtgttcaccacagtggtggaagaagcacagctccggggtgaggggcccctgatggtgactgcacatgtggtcatgttggtagtggtactagcagcaggggactggctgtgggtccatgggaagcttcagtgtggggagggggcatgcaggatagtgtgtggccataagggctgccccgatggagctctccactggatgggcatagtctaccagggcgcaggaggcatgatgcgggtccgcagggtatccaaggctgctctgccagtacagctaggagagccacattcaaaaccaagaagagaaaggagtcatagagccacagccagaatgtttaggatccaagtacacccaatgccaaccgaaagtttgggcatgaaaggaagtgtggactcccaacccagttaaatgaagatttctttaattttgagctcaaatatagacatataggagtggaggatatgatatataacaccttttaagatttgaatttttgttactaaaacaccag

SEQ ID NO: 470257 - DNA, 644 bp, Homo sapiens
ggacatcgccccctcagtatgagtggtctattggacatggaaatctttgggggctgctattctgccaaacacaagtgtcttctgggaataaacagagagaaatccagaaaagaagctgtcccaatgtcccttggaagctcctggatttgcaacccagaccttaggggcaggccccattcagaaggctcaggtggtggggaagactccctcttcccagctcacttcacatccaagcagaccagactgctgggtgagacctcatggacgtctgccagagacactgggttgtgcgaaaagagagcccctttagcagaaatatctgacaacactgttcctgattctgaggagtggggaatgatgtcatgtcttttactattaagcatgatgttagatgaagaaaagaacagcctcaggaagtgtgagagtccactgtgggcaagcggctgtccaggtccactgtacctgccagctagctgtgttatttctatcatcaccagattagaacttcagagtcaggatttgtctgtgtgtgtcctggagggaatcccagggatgatctaatttactcccataatttttcagatgagaaaattgagaccccaaaagtttaggccatttttattgtactttgtacctttctaagc

SEQ ID NO: 470258 - DNA, 697 bp, Homo sapiens
gtgaagaccacagggtttggaggcagaccaccggcacagcccagaccgcaggggcctgtgagcggacgaacctctgaagttatgtggctgctgtcccgagtggtgtacacgtttctcaccgcattcatccctaagaatatctcatggagacaatctttcctgggagacaggtcacgcagcggttgcaataggtgtgacaagcttccaagctataatctgatgggctttgtggttctatggaccaatgaaaggcaccaggctgcagagaacaggttccagcttgaatggtgcatggacgtttctcctgtctgtatctctcaccaagtgaactcacatgacagctgcaatggctgtgggaggagatccaagaatgccataaatgtaccgtctgttgaccaaggcagggaagccgtcactcaagtggatttcaatctattctcatttgtcccttcccaaactgctctccataagcttgcagcagttgctgtgtagccttagaagtatctcctcatctgtaaaatggcagtaaaaatgcctacttcacagggttgttgatagctattatcatgacatgagagagaatatttaacatggaagggcagggcagggatagagagaggatgaaagctggatctacctctggaagtgatgatttttgaagaacggcattgccactcagtaaagcactttgcctagt

SEQ ID NO: 470259 - DNA, 540 bp, Homo sapiens
cagccagtcgcatttgcacatggcgctaagccatgccctgggtagtgcttttcagctggtgtgggctgtatggtattcctctgacagacaggacattcgttcagagcccacgaagcagcacacctttcagagaggatagcaacctaaatcttctgccttcctcaaggcacacgaaaagatgtgccagcaagattgtttgcacaaacaatgtgatttatgccgaacacctgcttagttctgggaatctagaagagcggtacttgctagtcagagggtgcttctgtgaccataccccaataaaaaccctggatgctgactccataatgggatccccaggcagagacattgcacacagtactgtactttcagttgctggagaaaggaacatgctcagttgtgtcccatcacaggagggaatgggtataaggaagcctggcattgatttctctgcctgtgtctttcccttatgatccagctgtgtattcttactatgtggctataataaactccagctttgagtacaactgtttgctgagtccc

SEQ ID NO: 470260 - DNA, 1128 bp, Homo sapiens
tttttttttttttctttttgagatggaattctctgcagatgcagatctcccccacaaaagacagctttgcaggctttctgaacagtcatctcaaaatacatcaaattcagaatgaaaatttttggtgctcttcaagagcaataaatactatgaaaacccaactacagggcccctcaccaaactattatgatggcctttctgcaggcagtctgagaaggggcaacccagttgtaaagaataacgttgagaaattgatcatctctggtagcatctgtcactcccttgaaaatatccaccaggctagacaggtttctcctccacctgacccctgtatctgtatcagtcaccattacctgggagtactggagacaatgacatatcaatggaattctggattattggataccattaatcttctgttggaagggggaaccagacagaagccagaagttacttctgtctagactccctcccaacctcccatgttttatagcctcaaagaaggcagtcagcattctcagcattcttttcttctttttcttcttctcttcctccttcacctcctcctccccttcttcctcctcctttcccttctcctcctccccttccccctccctcttcttccttcttccttctttcttctcctcctcctcttcatcccctccctcctcctttccccctcctccttttcctcctcttctcctcatcctccctctcctcccctcctctccttcctcacttcccttctcctcctccccctccccctccctcctcttcttccttcttccgtcttttcttcttctcctcctcctcctctccatcccctctctcctttctctcctcctccttttcctcctcttctcctcctcatcctccctctcctcccctcctcctcttcctcctcctcatcctccctctcctcccctcctcccctcctcctcttcctcttctccccttcccttcctcctccttctcttcccccacttcctacctctcctactcctcttcccccatctcctcttccttctccttctccccctctcctccccctcccatctccttctcctccccccacctccttctcctcctccttcttcttttaaatagaggcagggtcttgctttgttc

SEQ ID NO: 470261 - DNA, 1096 bp, Homo sapiens
ggcgagtttagaccctgtgggaaaggcctctacccatccagtcaaagtgtctacccagaccaaaaggtattttagtttcctgactcagggcatggggcttccaaggcaattgggcagcgtcagtcttcagctgctaagccgagaagatctgggaaggagtcagtcagagagccttatgccagagttccaggggctctgggagtggctgccagcacagaccctcacgctcgacactcctccaccagtccaaacttggtgccagctccccatgaatgatgatatcttcacacttgcagtgacaatgccccccagggacgacatggagatctggaaccacaccttctacaacaagctgcacatggctcctgaggaacatcccatgctgctgactgaggctcttctgaaccccaaggccaactgcgagaagatgacccagatcattgccatcctatgtctggacctggctggctgggacctgactgactacttcacgaagatcctcaccgagcgtggctacagcttcaccaccacggcccagcaggaaatcatgcgtgacatcaagaagaagctgcgctacattgccctggacttcaaagccaggtcatcgccatctgcaacaagtagttccactgccctggcctctcctccagccttccttcctgggcatggaacccgtgacatccatgaaactaccttcaactccatcatgaagtgtgacgtggacatccataaaggcctgtacgccaatgcagtgctgtccagcggcaccaccatgtaccctggcatcgcccaacaggatgcaaaaggagatcactgccctggctcccagcatgatgaagatcaagattattgctcctgctgagtgcaaatactccatgtgtatcattggctccatcctggcctcgctgtccaccttccagcagatgtggatcagcaggcaggaatacgagtcccacttctctcgcccccatcttctactgcaaatgcttctaagcagactgttacttagttgtgttataccctttcttaacaaaaacctaacttgcatagaaaacaagatgagattggcatggctttatttgttttttggggagtg

SEQ ID NO: 470262 - DNA, 638 bp, Homo sapiens
tgggaaagccacttgcatcacgagactgaatcaggggagtctggggtcctgagaggcagaggcctgaaaccgtctagagccatgtggggagctgggtgtgtattcaggccagttgcttttctctgtgcctcaatgttccaggacagcaaggccgaggagaatggctccgacagcttcatgcactccatggacccacagctggagcggcaaatggaaaccacgcagaacctggtggactcctacgcggccattgtcaacaagaccgtgtgggacctcatggttggtgtcacgcccaagaccatcatgcactgtccctatctgagtgagaaaagggcggtggggcggcagatctttgagtctaagcggtgtagaagccgcgtgtgcaaagccatactcagggctccaagtccagcacactgtcccagcacaggcatcaggccagcacatgcatcaggtcccaacctccttccctctttgccccctctcagaccaaggagttcatattatcagagttgctgtccaacctgtacttgcatgggaaccagaacacgctgatggaggagttggcagagcaggcacagtggcgagatgagatgctgcgcatgtaccacgtgctgaaggaggtgctcagcatcatc

SEQ ID NO: 470263 - DNA, 1559 bp, Homo sapiens
cagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggctctgaagctttccatttaaatgcaaatttcggaacaaagatctgtgtctctgcactgaccaaatagaagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcac

SEQ ID NO: 470264 - DNA, 489 bp, Homo sapiens
ccgtaacagtcatggcaagggtccgcagcttcattcttgaagtcagtgagaccaagaacacaccaattccggacacaatggtacaaaggatacagatgaagagatgcataggacaagctgtccagaaggtttctgaacccagtcctcttgggttctcacggaagctctattatgtacgcatgggtgatgaaatcattggccattgtggagatggtggtaacttggattatcgtggtgctggtggggataatgacaagtggtcactaccagaccattcgaggtatgatttggatttagaacccacagaactttctgatggattcacagctcagtggagcaccttccccacaacagtagaggtctatctagccgtaattatcagcagcaacactacttttctggccgtttgctaaaaggaaggaatttaccttttaccctgaactacttgtcctatctttctgtaatttttaacatctcttgtaaggttga

SEQ ID NO: 470265 - DNA, 681 bp, Homo sapiens
tctcacattggttaccctttcctatgtcttcaggcatcatcttctccacaatgacatcaccagtcctcaaagcctgctcagagaccctttcctgcccagtggcgtggcttgagactggatccacaaaacggattagagattgcaaagtgagcagagtggttagcagaaggcaggttgtcatcatggagcttcaccaggaccaagctggggtccagaaacatcctagtactgacttggtcatgatagacagtgcatctagacaagctctggctcccagcgccaggcaggatcccaagtgttgggcgaagccaggaggaccccctcctcctgaacaccagagctgtcttcaagtgcagttcttctctggggaagagccttgggctccccctggaggtcacgaagcgcaacaggccttgtgttgggcagagcatcgctgtccttcacctcctacggagaaagaggggtttcagggagtaatgaccagcacccccacccccgccctgcaatgactgctaaagaggtctccaaatagtccaagtgagaaaacagccagggtggggcagggcgagcatgggttgtttacggccgtttccacgctgactggtcatcgctttgtggatactcgtgctcatgtccctggttaaattgttatatactacccctggttataaaagctcgcgc

SEQ ID NO: 470266 - DNA, 581 bp, Homo sapiens
tcccagagggctacacatgggggaccacactcatgtcccctctgcactgagagccattccaccatttaataaaattattctctgccctcctcacccttcagttgtcagcgtaacctcattcttcttgaatgctggcaagaactcaggacccactgaacgtgaacgccggtaccagctcaagtgtggggtccacactggcacacaagtcaggctgcagaagtccctggctgacaaaaactctgactgccttggccgccttgcgctcccaattccatcatctcaactcagggagaccacaggatgtggtctgggcttccctgccctgcactgccacctgcaagcattctccaggcagcatgctgagaagttaaatccactccagttactccaccttgatcagaaatggaagccaataattcatttaatgtagaaaataatgtgtgtattttaataatacatttaacattgataattaactgggatttaaaataggccaaatgtccagaaataataaccagttagtgccatcctataccgagattttattcctaggcatctaagataatttctaggtgattttt

SEQ ID NO: 470267 - DNA, 713 bp, Homo sapiens
attatgtggcttttgtttgtgtcactccaatcttcaagaaaggcagatcttctttccccactatgggaccttgggttgatgtgtctgtggttcccatgacaactctcagatttgatgatttactggaaggactcacaggactcaggagagttatagtttgtgactgtgaaaggacacagattaaaatcagcaaagagaaaaggcacacagggaaagttgcagtgagcgagactgtgaacccaccaggaggaaccgactctgaactcgatgttacagacacctctaccgtggtcagatgggatggtgtcgtgaaaaatcaggacttccatcactgcccaagggtaataatcacagaacatctcctgctccatggtgccactggctgccacgtgggtagcagtaaaggcactcttgggtccagccagggtgctatcagcagcctactctacccaaccattagtaacaaggatggtgtgcttccatcaaaaaccaatgaaggttgagtaaagaggaaggtgctgaaaaatgttgcaaaaagcaattactgacgatatcttcagttaagcaaaaactataaacactataatttctcctatattcccccaaatatcataatctagcaacctgctagattcaagtcagaaatttcatttctggagtttttcaaaggtccatagaatttcaaaatgctgtatttgtattcatttctaagt

SEQ ID NO: 470268 - DNA, 556 bp, Homo sapiens
aaatcgggagaagatggttagaacgcaggcaaaagtggcatcatcatcacaccaaccactttgggttactggctttgaggaagccaggatctctgaaactgggaaagagtattaccgaggagcactcctatgcccctataaactcatgtgctgcaaattggtcaccagtgaagatgcgggtgaggggtgtctgcggctgcttcagccccctcctctaccattagacacaagcagcctcgtccatccagcccagcgtgctgcacaaatgcatctcctgctggacgtaagagggttccatgtgcaaataagttacggaacctttggcagaatgctgcacgctacatcttctgttcacctttggggatttataatgcagcagcttaccagtgactcagaagaggccctcaatcctactgtggcttgtgtctctttttcctggatgtgtcctcaacctcggcaaagtaaacctctaaattgattgagacctgtttccgatactttttttttggtttactgccgctacactggaaaatagtttcatcaacgaaatagcatc

SEQ ID NO: 470269 - DNA, 589 bp, Homo sapiens
agagctgacacttgcgctgccctataatgccctggacaaggatggattctttaaggagacccagctttaaggagaagactggatggcttaaacagcaaaatttatttcttgcagttcaggagtctggaattccaagatcaaggtgccagcagattcggtgtctggggatgaggaaaagcttcatggaagaggtttgcttggtgcaggattcaaagactgagaagggttctggcagcctgaaaagagaaggtaggaaatcccagaaaaagagtgtatcaatgaaaacacagatgcgagaaggaccaggctcctgggaggatattaaaggtccacctactcagatctgccagcttgagaaatgcttcctagggacagctaagctgacactcaaggatgtcaggaaacaggtggagttcatagcaattggtctgggcatgagagggaaaaaacaattaaaaccaggtgcaaagggtcctgcctttgcaatgggataaatggcaatgctgtggcccgacttaggggccaaggcaaaggtatgtttatctgggggcatgtgatctgtttagctcttggcacacagagcttgaag

SEQ ID NO: 470270 - DNA, 959 bp, Homo sapiens
ccgtgcttaggcctggatactcttaaccataatgtaagcctgtacattccctgatggctgccagcaactatgcaatccagtggcactgaacattctgacagggattgtcatcagctaagagccactagcagtggcagtagtgggcagccgtgggctccacgagccaggaagcttcagcagagcataagtggatttgacagtggtgtggtcccagtggcaatggtgtgcccagcagaggtcttgcatggcaaactcctacctgcagtagaccaagtctccccttcctccagtggaactttggactgtgagctgactcagttcttggtactggatgacacaaaacatctccattccaagtctgcagataatactactggaactacccaggctgctgatgttgcagtcaatcagctgcttgtgatggccaccgtgagagcaggccactcactacacaccatctcagcttctggaaatgctgaatctcataggcagctctggcaaattctgctggaaatgccaaagttaccagaacctggagtcaatcactactctagaaaagagaaggaaaaaaattgtctcttcctcctaccttccaacctcccatcaatgatcccaaaggcgaaattgacagtgcctgcaattgacaaggtccagatagatggtgagaatctcagtgaacatgttctgttctctcagtttaatatacccagagatgattatcaattacaatggagctaaatgttcacagtaatgcttattgtaggtaagaccaagagctcatccaagaagcatggaatgactgtattctaattgttcagcactatcagtatgtgaacagcccaaagaaatgacccaattcttactctccaggatgtttttgcaaagtgtagttattagaggaaagaaaagttaaaatattaataatgcatacattcattttgtatttcacccacacccac

SEQ ID NO: 470271 - DNA, 638 bp, Homo sapiens
cgggagtgcaaaatgcccggagaatttagagctcctctgatcaatctctggggacaaatgtcctcaggcgaatttcatgctcatccaggatcccacagttctgcctcaccggcaccacactgcaggtccgggagttccgcagccctctggatgggcacgagaggacagcaagcgtgttcctgcactgcctggagaaatgcaatactgaggctaagagccaaggtcctggaaagcctcgcagcccagaccagaccaggggctgaccaggccctgcagaagggcttagcaaacacccaggtgaggtggagaggctctcaggctgtaacactcaccgtgaagctccacggcttcattcttgaaggcagggagaccgagagcccactggaaggaaccaattctggacctaatgtgatgtatttgttggcacacgccctggtcagttgtgttccaaattgtattaccaatcagaaaaatgcataggcatattttattgtggtaaaaccagataaaaattagtgtattttacttttaacttgaaagagcaatatatgaatcttaagttaactatagtttgctgtttttttttttaagcaacttccagaacattattgaggttaatagaaactcaaactagtgtg

SEQ ID NO: 470272 - DNA, 746 bp, Homo sapiens
cccatatgatccagcaattctacacagcagcagtactcatcatagctcaaagataggcaatgtgccgacatggtaacaaggctggagggaggcgcacgtcacatgtgtgcgtcaacatccgggcatcagacttacacactacagagtatcagttatggaaaatcccaataaactgccacctcttccagcgatacactctgggatacgtgaaacactcaaattcttggggatctaaggaactccttcctgtgtgttatgtcggtgaactcgtacccatggtgggcttatgggaattaaaaggaagctcccagtatgtctacccctgtgcagtaacaggttataaaagtcagccaggggcatctattgctacgaccaactctgtaacttttgagaacacattttcacctcttgtagcctattttcttcctcataaagctgttaatgaatctataatcatactgatcagtatgcacactcaccaattgggaactgacaggtcttaagaatcttaatcttttataattgagaatcttaatatatatgtaatattcctgaagaatttcagaaatttcagtttatttaactataataatgctgggatcttagtagatgccaataaaaatttttaatcatcccaagctgaaagtctacacccattaaacattaactccccttcccccttcccccacataccctgataaccattccactttctgtttctatgaatgttactactttaaatacct

SEQ ID NO: 470273 - DNA, 1273 bp, Homo sapiens
gaccaaaaacgtctcaagacattgccaaatgtcccctgtggggtggagggcaaaatggcccctagtggagaaccactggggtaaactaaatctgcaatttgggcagggcttagtagggacagctgtctctcttccacttgacatcaactggggcagcttaaggcctaggggctggaatcatgagaaggctccctcactcccgtgtctggtggctgatgctggctggaccctagctggagctgtcagctggaccacctccatgtgtcctctctacatggctctatacttcctcacaattgatggctggactccaaagggaaacattcagaaccttgaccttccattttcctccctttcctggttgttctgcctgtgccctcctggcacatcagcagtcactgcaggcacatcgacaaaagacaccccaccgccacctgccttgattcacaaggagcacaacctcgtctgaaggactccaatccacagagttaggaaccctcatgggaccctgctcatcctgagcccccaactagcatgtgagttccctggggctctttatggcacttccctcaagtggttccatctacttaatgagcctcatgtcaccttatgaaccactgcctttaatataccctaccctacacacacacacacaaactccatatcttccatctctccctacccctaccacaacccctttccttccttgcagaattctgctgataatttactagatgccatccttggggcttggctcaattcaatccacatgaagttcacaaacatgtattaagacaatctatttttgaggtatagaaggtaccccaggtgactaacacaaagttcttgtagccaaggagctcagagaacctgaagataccttcactgtccttcacagttatctcaaccttcagcattcccccagagaaatgctgccctctaggaagttctctccaaggaatcccacccctgtcctgagtatttctttaatctacaactttcctgaggctgtgtattgcacagggggcgtgccaatgggttctgcacttgtgtccaacacccttggtaaatcgacctttccagaggactttggagcccttcgaggattctcagcatctgcatctcccaggagctcccagcatgcagttggcacttgatgactgtttgtagctaaggtacttaggctgattttatttaatctttagtatcaggctgatattttaaaaattccaatttaaataaaacagttttaattctagtttttcattttatg

SEQ ID NO: 470274 - DNA, 637 bp, Homo sapiens
ttgtttgaaagtgtgtggcacttccccccttgctcactctctcctgctccaccgtggtaagacgtgcttccttccccttccgccatgattgcctctgttctgttccattggtctatgtatctgttttggtaccagtaccacgctgtttttgttactacgacttatgtctatggccataccaccgtgaacatgccagatctcatcttcgatcatatttttaattctgaacagatggaagtatgtgggcctgaagaggtggatacaccagagttgggtgtgaggctgagaagtggggtctcttacctaaaaccatcctgtctaaatcagcccaattctacagtgccatcatattataacgcaggtcctggaattgggggtcatgtcgagttagaggtcattcttgaagatagttgcagagctgaactgtcagtgctcttatccaaagcccagtcatccctctttacttgtgctacatcctattcctgctgcttatgcaagaattctgctccacgaatctcttctattggacaattcctataaatgtgctattgttttttctcatcttaagaaaaccttctctggacctcacttcccctcccctgtttcattgttccccttgtcaaaaaattccttatac

SEQ ID NO: 470275 - DNA, 676 bp, Homo sapiens
tcaagtcgtttccttcattagtcccaatgttaggacccagtggcagcaggttgagtctgcctgaattggtgggagagtttctggaggcaggggcagctgaaatttctgtggtttcattgactcagtataccagcctgctggttctggggagtccaggcagtccagaaaaggagggtcctcccccaacacagaacacctgctttgccagatttggcccagacttatttttaaagtgggtccccagacaattcctcctcactgggtggggcctccctgcagggggccttcagtcactccggccaggcttacatggacagaacttgccctgggaagcagctcctgggggagggatggctgccatctctgtggttcagttgactcgactgttccagccttctggctctggagaatctgggctgtccagacaaggaagggttcccccaaatgcagcacacatgttctaccaaaaaacagccagacagcttctgtaagtgggtccctgatcccgttccttcagactgggtgacatatcccaacaggggtgtttccagacaccacccaaaggagtgttcagaccagcaacaggtcagtatccactggaacagagcttccagaggaaggagtagactgtcatctttgctgtttcacagccttcactggtgatacctccaggtac

SEQ ID NO: 470276 - DNA, 954 bp, Homo sapiens
caaattcacaacagaaactttgtaggtatgttattttctggggaacacgattataaagcttgggaccttcgtaaaagtgaactttataagccagaacgaacttaccacccccctactgtgaaatttggaaattcaactacattccaggatgactttgttcctcaggagataaagcctaggcaaagctttaaacccttctctgtggtcaaacgttctacagccccttttaatggtattacaagtaatcgccttgattatatacctcatcagcttgaactcaagtttgaaaggccaaaagaagtttacaaaccaactgaccaacgctttgaggatttcacaactcaccgagtgacccagaatgctcggtttgaaggaagcactgaattccgtgaaagttttcaaccatgggaaatcccacgaccggaggtcaagaaagtaccagagtatgtgcctcctacaggtagcatgctgttaaacagcacaagccatcttgactatgttccgtatcaggccaaccgtgttgttcccatcaggccagtttctcgtagaagaagtaacagttttcctttccaaggaaaaagcaccatgaaagattttccagcatgggaaagttgtcgtcaaggacttattaagaagcagcagcagattcccaacccatctggaaaatttgatgaggaagaaccagccccagcagggggcataatcacctggttcacctcttccggtgtgaagataagtgataaggtaaagaatgatgccagacatcagtcacattgtattaaggcccatcctgataacctcaccttaacttgatcttttgcaatgaccccattttccaataagattatattcataggtagtgagggttagaatttcatttttggaggagacacaattcaaccagaaaagacagtgaagaagcacatgaaaagatgcttaacatcaatagtcatt

SEQ ID NO: 470277 - DNA, 1329 bp, Homo sapiens
tagccagacagtgtccacctggatctttttaaataaaaatgatacttacacggcgtgtgctacaacaaggaggacctgtaactggggtcccccaagaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaagatcgttaagagacacaaataacacagcagatgtgaaactgttttgcatatcacaaggtactttcaaaatgcaagttttacttttatcatgtcctttgtgcattgagcctcgtatgtgaaacatcagaaaaaacttagattgaaatgagtttatttaagt

SEQ ID NO: 470278 - DNA, 598 bp, Homo sapiens
attggttttgaaatgtgaaatgcacatgagatttgcgagaggggatgaaatgatatggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagcttctaaatatttccacaagatcaggctggaactactatggagcgagatggtgagagatttcatcacactactcagaacgtcatgcaaactaaaacttacaaattgtttatttctggaatgttctatttaatatttttggaccacagttaactgtggaaagcgaaacc

SEQ ID NO: 470279 - DNA, 1118 bp, Homo sapiens
ggaggtggagccaagatggccgaataggaatagctccagtctacagctcccagcatgagtgacgtagaagacgggtgatttctgcatttccaactgaggtaccgggttcctctctctggggagtgtcggagagtgggtgcaggacagtaggtgcagcacactgagcctgagccaaagcagggcaaggcatcgcgtcacccgggaagcgcaatgggtcagggaattccctttcctagtcaaagaaaggggtgacagacggcacctggaaaatcgggtcactcccaccctaatactgtgcttttccaatggtcttagcaaatggcacaccaggagattatatcccacgtctggctcagagggtcctatgcccacggagccttgctcattgctagcacagcagtctgagatcaaactgcaaggtggcagcgaggctgggggaggggcacccaccattgctgaggcttgcctctgtagactccacctactccacctaggggtgcctgcctgcctctgtagactccacttctgggggcagggcacagccaaacaaaaggcagcagaatcctctgcagacttaaatgtccctgtctgacagctttgaagagagtagtggttctcccagcacgcagcttgagatctgagaatggacagactgcctcctcaagaacacagctcctcaccagcaacggaacaaagctggatggagaatgactttgacgagttgagagaagaaggcttcagacaatcaaactactccgagctaaaggaggaagtccgaacccatggcaaagaagttaaaaaccttgaaaacaaattagacgaatggctaactagaataaccaatgcagagaagtccttaaagaacctgatggagctgaaaaccaaggcacgagaacgtgacgaatgcacaagcctcagtagccaattcgatcaactggaagaaaggaaactctacaagccagaagagagtgggggccaatattcaaaattcttaaagaaaagaattttcaacctagaatttcatatccagccaaactaagcttcataagtgaaggagaaataaaatcctttacagataagcaaatgctgagagattttgtcaccaccaggcctgccct

SEQ ID NO: 470280 - DNA, 595 bp, Homo sapiens
acagactaaaaatagcagaagaagaggacgcaacaaaaggatgcgtgattcagagaagcaacgtaagacagaggaacgcggacaaaggacaccagtgaaacaaataaatggtgctcctttaattcaggtgtcaactctgcagggcaaagtccaggagacagtgtctcagccacacccaggtccctgggaaagtgacaaatcacccttagcttatgccacagacaaagacagtgagccattggttgagagcaggacttgccatactggccagccagcggagacaattcaggcaaagaaaagagactgtgcaatggagcagacacaaaaacgccagctgcggtttctcttcaacagaatgaatattcacggaggttctccaaagggcaagaaggtgttctgggagcagcatgacattgcaaagatgcaaagtctcatttttgccctgacaaaggtgcaatggaaaacaactttcatccataatggcctcagtttccctttactctctcattcagccaacctgcaaggcatcgtcagaataacttttcctatttcctaacccccatatcactcataactccattctgagaagtttttc

SEQ ID NO: 470281 - DNA, 565 bp, Homo sapiens
agacatccctaggaaacagctctgattctagggctatcatatggtattgggaataatttcacgttctttcagaaatgcagagccatcattacctagggttgacattaccaccaagcagttccagagctggatctgtgccctggtccagaaggggagccaggccaccatgccgagcaccttagttacagtcagtgttggaggggaaaagcccacagaacaagtagatcctgaaaatccactaatcacttggaatgaaatggacaggcgcaaggatcacggctgttccccaggtgaggagacccatgaggaggacatccgagtcctgccctctgacctcaatcctgccactgaagaccctgaaggaggattttcccttggaccagtgtggaaggcagtgctgcgtgctggccccaagctgggttccacttttgcctatgcccgctgatcttgaaaaacattctgggctttgctggcccgaggtattcactctctaaactaacatggttgggtgagagctgctcccacgttgcttgtagcgtctgtgctgtgacttgcatgctcttcc

SEQ ID NO: 470282 - DNA, 1611 bp, Homo sapiens
tgggaggtggaggacagagccgaggctggggcctggggacaagccactcctgctgtgacatgtccttggcatgtaccagctggcagtctcctcccaggtgtgtctccaggcccctgtgctgtgctggtccttgcaggggcctctccctgagcagtggcctctgcctttccggagatccagcagaggggacaggctctggctctgcccacgggcctggttccggttctcccctcctccaccatcccccgtggctgtccaggctatgcttctccaccagggcccaagggagagaaaggacgcaggtggcagcagccctccctggcgggtggctcgtggtgtgggatggctgtggcaccaggaggacagcgtattcacttatactccctgtctgatgagcctcctgtccaagcctgtgattcccaatgcccgaacttcccgatccatctcctgtttgcgcttgtggttttctgtgaagacggagccatcgcatttgaggggcaggaagcagcagcaacacccatgtccccagcagtgcccagcagtcggtgacggggctctttgtgcccccaagagtgaggtggtcccagcctggcctccaccggcaggaactggaatggaccagagccaccatgtgtgggaggtgggggtctctagcctggattctctccagcatgtgtgggaggaagagaccttcacggtcacctttcttcagacttaaagagcagggcctttctcttcctttcactggagcggaacatcaacccgtgccttcatcatgttaataaattagcgccaaagaggaggacgatggatatttacatctttatatcaatcatgtgaccttttcagaatcagttttctcagcaagaatccatcccaaagacccagcatgtgcattgcgatgccaaatctgagctcgttttctttggaaaacaagtttcactaagtctgtcagagactccccatgcagaggtccctcgttactcctgccacgcctgagcctctggggcctaggatccagccatgagcatggctgactttggggagagttgttaatgcagccatcattgccagtttgtggcaaccagttgaatactgggcctgtaacttaaaacgcttcatacctgagttttaccacttttatgtaattggcagttctcaataatttgaatgtattaagtattcaataaaggagaaataaatgaaaatgagacattatgcattttaagattggaaactggtaatccaagatttactttatgagaaacaaaatgtttatggaagtgacagtcaccttgggcctccgatgagcccaaggagaatccccatactgcgggtcattatcttagggattttcttctgttcatggaatgtttggcacacctgaaagcaacagtttctgtgaaaatttttttgacttgtgtgaattccttgggggcatcaaatttgagtgaaataatacaccaggtccagtctacaagacagtgctctgttgctctgatgacgctgaagtcggcacccaagctgcatgcaacgggatagagaaggacctcctgagaacgctggcatttgctgccctgcggccactgcccttggcacccaaagacactg

SEQ ID NO: 470283 - DNA, 560 bp, Homo sapiens
agtgggttttctgtccctgacaatgtatgcgatcctgttgggtgctgagttggaagaaaagacacatgactgtgaatattcctcagcatggcccccaggagcccggaggctgcaggcgcagcggccctgccacggaccagtcctgctgaacatgggctgcaaagaggtagagagggcaggacgggggaagaggaagaaggaagagcagatggaaccagcagctgccatgttctgcatccacagctacaccgctgcccaccctcatctgtctaatacctacccacccgtgctgttcagacaaggaaaccgctacctcggtggagtaacttaccaagatccattgcacagagagcagcactgggctcaatgtaggcaggtctatttccatgccccatccatgatattccacctgcagggagaacgaggatggagcttgcttaaatttgtcatgaaatggacagtttaagtgaaaccatttgactgtttttgctgcataagccttagtgtttcttttcagtctgcaagatgagcaccattggagaaaaaataacttccagaca

SEQ ID NO: 470284 - DNA, 550 bp, Homo sapiens
cttcctctgtggtggcggcgatggtggctgcagtggcggcggtgatggtggttaataggcatgccagttgcaatgatatgcagagagagcaatggagagctcagagaaatatggaagggcagcccctgcagtcatgccccctcctgggtatgatgctcctgaagcacgaggggctgctgccgatggccccagagccttgggcacatgggaggtcacggtggcaattggagagaagacctcctccccggatccgaggacctcagtggaaagaggccacctccttcctgccctgcaggcctgaaggtgtggaccttcaggttgaagcccctcaagcccagaggcccgggaatggtgcaaggtgctcagccgagaactgttccccctgggaggactgtgcaggtgtccaccaggtggagtcatgtccctgtgaagaagcgggccctttataagtgggcagtgtttctatggtggtagatcccttgccaggtgggttcttgtccctataaaggtggtgaagatgagggcccttgctgggtggggtcgtgtgcct

SEQ ID NO: 470285 - DNA, 860 bp, Homo sapiens
ctcttcctggagggaggtgcctctgtggactgacggaagcatccctgtgcactcgctgcttctaccctgtcctgcttctgtaaccacccaatgggttcacttttcctgctgcctaatgatggcaacggtttactgctacttgaattaagcatctgcccactgtggataaagacacaccacatccactttctatcagcttccatgggctggaagagtggagttgggctgtgttcttggtggggctggcttgctgagcaccatgcctcagccctcggctgcagagatggcagcagccattgtggccctgtggctcctgaggactcatttaccctcaaggattctcttcactgcccacactggggacagctgtggctaaacccaccaaagtcagttcaggtgaaggctctagaggacgaagaggccaatgtggataatgtcatttctaatgttcctactacttccaacatccaatgtgatgtgagaacatggcatatgtttaatggctacattccattaaaggtaacagaaggtaataaaagttgaaggaaacatgtactgttttatccctgtggctgaatattttttccttgtactcagttactcttgtcacatgaatggtccatcatgtctgtgataatatttgtgggtttaaaagcgctctcagtgaggtcagagcaagaagcagaagcagtgcattggcacagaacccttaaaaggaaaatacaaaagaaacattccctttgtatcttggtgttttactagtgagttatttcccctaagtacttccagtagatgtaactgtaactctgccatacagtccagcagttaatataagcttatctttttcaatgcacagggat

SEQ ID NO: 470286 - DNA, 688 bp, Homo sapiens
cagtaaaataaagggataaagcatgaagtcactggtttgggtggtcagagaatgcatctttgaaagggagacatttgagctcatacctgcatattgtgacacagcccccgttaaatgtatggggataaaacttttcaagaaaagggaacagcagcaagtatttgagccctttgctaggtaccaagaagaggaggaaagctggtgctggtgttgctacccaaacaactttagatgtgaaaggaaagaagtgatagattttaggattacaccttcaagaacagaaattcttctgaagattactgggcgccttcatgaccacctccttttccgagtgtttgaaggcttaaaagcctcagtaactgtctacagatttgacttacagatgaaatttagttctttactggggagctatgactatttgatttacctgacatggaaattgactctagatagaggtgtctattttatctaatataaaactgtaacgtttcaggaagttagatgattattttctcctttatctctggagaaggtgctgtctctgtgccaaggataagcctgaagtataagcataagttcttctcagtacttttctgagcctacatctttccctaggtatgcatggtcatttttattgttttccagtagatgcaactactttcgactatcctagtctttaatgtctctc

SEQ ID NO: 470287 - DNA, 718 bp, Homo sapiens
ctgtgggcacagcttcagcagacttaaacattactgcctgccggctcttaagagagcagcggatctcccagcacagcgcttgagctctgctaagggacagactgcctcctcaattgggtccctgaccactttgcctcctgactgggagatacctcccagcaaggggcgacagacaccttatgcaacaggagagctccggctggcatctgatgggtgcccgtctgggacgaagcttccagaggaaggcaaacagggtctggagaggacctccagcagacctgcaccggaggggcctgactgttagaaggaaaactaacaaacagaaaggaatggcatcaacatcaacaaaaaaggacatccatgcaaaaaccccatctgaagagcactggcgtcaaagaccaaaggtagcaagggaacaaaactggatggagaatgagtttgacaaattgacagaagtaggcttcagaaggtggataataacgaactcctccaagctaaaggagcatgttctaacccaatgcaaggaagctaagaaccttgaaaaaaggttagaggaattgctagccagaataaccagtttagagaagaacataaatgacctgatggagctgaaaaacagcatgagaacttcgtgaagcatacacaagtatcaatagtcaaatctatcaagcagaagaaaggatatcagagattgaagatcaacttaatgaaataaagc

SEQ ID NO: 470288 - DNA, 848 bp, Homo sapiens
ggactgtcaaaatctacacaagatggtctctcttccttccctgccattaggcagaagaggcacaggagcctcaccctgtggccatcaccaccacaggcccacgaggagtactgccagactactgcgggtattctcttatggtacaagggctcttcagtcatcttgtggtgaaaactacctggcctggggctcatcattcagagcagaggtagaataccctcagccccaacctttcaagttgaaaggatcctctcttcacttcctggttgataaaggagcaaatagaattggttattcctatccaggacttggagccatcaaggagaaaaaatatcaaccccccaggcacaggaatggtggtgctgacagccatgcagaaacagtgtctattgcacagtgtgtacagcaccagcagcagtgccctgtccagtctcactgtgatatcactgtggctatgacttcctgcccagccttccttagagtctgcccatattccgagtttagtagtttaaccttcataccttctgtaagctacttgataaaccaccactaccaccaccaccaccaccaccaccaccaccaacaaaacctttctgcttaagttagctagaattgcttcatatgccttggagccaaaaatattgactgatacacacagaactcaggattataactcaagacattctttaccaggtaatgtactaatgaggagacggacatacagggagaaaacaaactaatgctagattcattactactgcctagaactgggatttatattaaattaccaactaacataaaataagtctatatagtgtggtagctcatgtttccaaatagggctgcaa

SEQ ID NO: 470289 - DNA, 593 bp, Homo sapiens
atctgctcgagaatcaacagcttagttatgggttcaggaaaagtaaaagaatccctggagggaaaggagataggttgttcccactgggtgtttttgaaagataattttgctggatatagaatcctaggtggacatttttgtttccttcacaacttaattatcacttcattgtctttcacttctatagtttctgatgagaagtttgctatcgtttttatctttgttcttctaactttcagcttttttttccctgacagcttcctcccccaaccccctgactttattgatgacttgcagcaatttgattatgatgtgtcttcctgtgattttcttcataattcatctgcatgggatttgttgagattctgggaactgcgggtttatcactttcatcaaatttggctattctccaaatttatttttctgttcatcctaccccttatcttggattcctactacatggtagtcacagcagcatttaatgggataatttatctccactactgaggcattacctttctgaggacattgctcactgcctcttggattaggtttttatattctgactgctgattggaacatgaactatttat

SEQ ID NO: 470290 - DNA, 492 bp, Homo sapiens
tggatgacatattgagatgccaaaaacacatcttcctgcagtttacacaggtgtctggctccttggaccagtgtggtctgtttcccccagtcctcgcaggcgcctctggcatgcatcgcctcctccagcccatgcattttgtgtctgtcttccctctatcccacaggacaggaatgccaaaggctgggccagacagattatttggagtcctgataatgggtgtacccatggggagaaacctagaagagtccatggcactttccactataggggcaggcagaggaaacctaaaggagttagagaaggaagatctctcaatggaaatgctaagaagagacacaaggaaagacacatcactaaggagagacccaaggaaaatggctctatgactacagtccatttaaagaatgagggcgttccttctaccaaggagcaataggctataccgtatggcctaggtgtgtaataggcaacactaaatttgtgattgct

SEQ ID NO: 470291 - DNA, 582 bp, Homo sapiens
agttccctggagaagccagctgctttctgcctcagagactatgcccttttctttggaactttccttctcatcctgtgaatggctggctcagccgctcagccccgcaatgggaacacaaggtgagacatacatgcgtgcaaacactggagagcaagtgaagacagacacaatcagagaaatgacaaagctagcttatgacaaaaacagtcaagaactttcctcgcttcctctccttcttccccctgtttgggccctacatagcaatctgaaagagaaggagaaatactacacagccagactaataaaaaagcagaagatccaaataaacacaatcagaaatgacaaaggggacactaccacggacccgaaagaaatacaaaaacccctcagagactactgtgaacagctgtatgcacacaagctagaaaacctaaaagaaatggataaattcctgcaaacatacagtcttccaagactgaaccacaaagaaattgaatcctcaaacagaccaataatgagttctaaaactgaaccagtaataaaaagcctaccaaccagtggttcaggcctccaatcctagca

SEQ ID NO: 470292 - DNA, 706 bp, Homo sapiens
gaaaggttcctggaacgcaagttaaggaaaaaagaaccacagcaacatttcaggaaagaaagtagttaatgggatcaaatgttgagacaggtcaaataagatcaggactaacaattactagtggatttggctacaaggaagtcattggagtggactcaaaaggaacaagaggaagtaaattggaaatagaccttcgatgtaggatctgggtatcactgctggttattcagggcccaagggcttttcatttagcaggtgatgaatgctgccaggattgggtcctttccttcaagagcctccttcagcaatatgaaattaaaaccagatggtttaaactcaaacaatacactagtagaactgactgtgtctggcaatggagatgctgtaaacgtcaagccaaatcagaagttggtggtggaaatagaaacatcctgagtattttcagaaagcacacatcacaatcagtaacaataagaacaataaaacagccatgtcattaattgagcatgtgctaagcaatcacattgtttcattattttatttaatcctcacaataatcacgtgtgaagtaggtgccatttttctcatttttgtaaatacaaaagttaaagcattgtaagccaccatgcccagtcaaattatttaatatgcttttaaaattattttcaaaggatattaaattatttaaaagcatattaaataattt

SEQ ID NO: 470293 - DNA, 548 bp, Homo sapiens
tgcccagcagctcactgagaacgggccatgatgacaatggcggttttgtggagtagaaaggggggaaaggtggggaaaggattgagaaatcggatggttgccatgtctgtgcggagagagagagcatgtggggatcaacccggagaatccagtccaacccaagatcaaggggctggctccaagccaagaacaggaaaagcagccaggagagtgaaagaaggaaaggaggaaagactggcccaaagtcagagagttagagagcttattgtatacaagatcaggtgcctgaagggctctcatattgggctccagccacacagagagtctggagactactggagcttttccatgtgtccctgtgaggatcacagcattgccatccctccgcaggcttcctctgcagtctgtgcctctgacctctgtgctcatctgtttcccatgattcctactgggccccagggtggagcagtataacatagtaccgcataattcactttcctagagcatccttcatgcaagctatcacagggagctaatcaaacgctgac

SEQ ID NO: 470294 - DNA, 1811 bp, Homo sapiens
cgttggcatgctagctttatctgttcgggcaatacgatgcccattgtacttgttgactggtctgatattcagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgattagggtcattctctaagacaaatttacttttctgcacactctaaatctgtttagtcactttaaaggtgtcaattattggaacaggctaagactatgaatttcttagtaatagctttaataacattttgaaatgaaaagcagataccttgaagtcagcctactttgaaaggacatatgagcagctctggttttaatttgtgtagcattctacatctggaatcccttataattaaaactaaaaactgaactactacttccacctgtcaaatgatgaaaagatgaatgcactaataagttactaaatagcccaacatgatagagtttacattctcattctatacagtaaaacagaattttggacaggaggctaaaggtctttggtcattactaataacactctttcagtattaacctgtatgtcctgctgcaactactgacggggtcttttttacattaagagctaattttggctaagtctttgttttaaaagcaaatatagattttggaaagaatatgtaaagcacataaactgagacgtacttttcatcccacactttgttttcatcgttttcaaaacccttctaatggcttccaataacaattgcatagagttgttaagtgcagtatttacaaatatttaccaagcacccacagtatgcaagcatgtgtttagcactgcggatacagttctgatcacgataaatctttgtaggtaatttaaagttgggaaaatttgtaattttttcccattccttcagaataacaaaaatcacatttttgcctagattctgataagaaaaaagagttttctaaagcttttgctttcactccaattaaaacaacaatggtcattaaaatgctctcagactgtcactggtgatcagaaggttaattattttaaaatgtaaa

SEQ ID NO: 470295 - DNA, 1007 bp, Homo sapiens
tttggcttcccctcatgatactctctcagagggtttgagttcaagacatcgggaaagagaatgagtagaagaacagcagcagaatggaagacagacacaggaaaaacgagcagaaagcacaagggaaagagagtagagggatttctcactgatgccagagtgagaaagtggatccaggtgatgagagaagcagccgagatcagcagaatcatctgggtgagcagctcccactgccggcctaggatcagggaccctgatggaggcagagcacagcaagtggcagggaaggtgaagagcatctcagtcccactggaagctgtggtacttgtccaggaactccaaaagcaggactgcaaggagcccaagcaacacacagcacacacacatttccaacgctccagccctggaaaatgtcactcacttcagagtcctggccccaggattgagttgaatctcaggccaagacgaagcaagcaatttagactgaagaatttgttctctaaggcctcactactgagagtgagggctacgggcccgcagtatgggcatcactggatgcctgttggaagtgcaggatctcagccccgcccaagacctagtgaatctgcatctggattttacaagactcacaggtgatacacatggacttacacttctaagatgctctgctcttatgagtcctggagggctttggaacaaaggatggtggtaggggagaaaagaagggccagacagtccctgattttaccctctgtccaaacctgactggccagtatatttttcagccttgtgtttaatgatctcaggatgtatccatctctgcactgtggggttggtatttttgaatgcccatttaacaataaaagcaggaattattttttttccttatgaattgctttattgaacctcctatatgtgtctcatcttttcttcttggctgcattgtgtgtttttatgtgtggaaaaaagcagggcttaaatgtcagaaggaagggatcagattccct

SEQ ID NO: 470296 - DNA, 684 bp, Homo sapiens
acacatactattagtttcttatttttccttctagagatatttatgcatagatacacaaataagtatatatcctccctcttcccgatttctacacagctgtcagcatattggacccactgtgctcattgcacttattttaaaaaacggattattgaaacccagaagtatgggaactgctgctttttaaaactggcatgtggtcctgttatttcttcctattttgatggctacacttactcaaggtcattgtgggctcatttggaccctgagtatctccagaagggtcagattggaagccaactgcatgctggtttcttcaccactcagagttttaggaaaccaggctcctgtttggacatctcgcccttgtctgaaaccactcacacgtgctatatttcacatttgggtattcagactgacactgagagaagaaaatacttggaatccaatagcattgccaattgtgagaagttagttgtggccttttgtgtcaaaattatgtgcctgtgtaagccctgggtactatggtgatgggtcctgtgtaaacaccaagacaaataacgctttacattagtctgccacctgtgcctgtcaggttacccaatcgccagttcataagctgacttctccttgaatgaatgtagcagacagtataattagttgtttcccctttgagcattggga

SEQ ID NO: 470297 - DNA, 961 bp, Homo sapiens
atgccacatactcagaagagaagcctttcccaggattctcttttttttttttttttttttgagaaaaggttatgaaggcttgccaaactcatagcgtcttctgaggaaaaccgaccatgcaaccatcctgtgacagctgattggacccaggctatgcctgggcctgccaatcaagccaccagctcccccaggagcaaggacacagcagcagtggtggaggccacctccgtgatgctctgcctcagcagatgcatctgccatacaacaccccagagccgaacacacagatcctttgtctcttggggagtttgactggggcggtacgctgtggccccaatagccagaagccattaccactcaggcctaaaagtattaaagagaatttatattccaagaaaggcaatgaggcaggaggactaaaatggactgtgagtgaagggaaagcagcgccggcccatgaaagcagccgggagggtgctgtatcctgcaaggccacaggggtggagctgcccaagaccatgggagcccaccctttgcatcgtcctgacctggatgtgagacatggagtcaaaggagactattttggagctttaagattgaatgactgccctgttggattttgggcttgcacagaacctgtggcccctttgttttggccaatttctcccttttggaataagagcatttactcaatgcctgtacccccattgtaacttggcaaacaagttagaaattgttcaccccagacattaggcaatgacaattttccgaggtaaattaggatgactaacatccttgaataacaggcttaaaaaaacagtctaagatcggaaaatatgatgggtgggtaaagtatcaccttaatgttgagggatctgacatattaccagaaatcaatactggatttaaaaaagcaacatctggctgggcatggtgctcccacgtgtaatcccaacatttc

SEQ ID NO: 470298 - DNA, 580 bp, Homo sapiens
acctggagaggtttgcattgccacccagagtatgccagcgtctcagaagatggaacacggagcaaggccagcagaaatgattttgagcacaggttttgctatgaaattaacccaaaaacctactgtcataagtcaaatgctttcacttatctgtgtccttgctgacccattagcacagctagtgggcaatctcctagcactgcccagctttgatgttgaatcacatcaggacggaaacatatcctctcttccatcttgcacctgctcctttagtaatgttcccacattggctgacctgggaggtctgatttggaatgtcaatttcagggagcccagtgctcaacagcaggcctgctctgtgctctctgctccctacttttgcataacggcaccaaattgcctaaaatatccacaatggagatttgtcctaagaagtgaggactggtcagctgtatgactatctggctaggttggtgtttaaactgtgataatcatggaaagacactttgtcccaagtctacagcactaagaggatgaagcatattcacttgcttattgattggtttttattatttaatga

SEQ ID NO: 470299 - DNA, 799 bp, Homo sapiens
gcagcaacatttgctgttctgcaatatttgctgttctgcagcctccgctggtgataccccagcagacagggtctggagtggacctccagcaaattccagcagacctgcagctgagggtcctgactgttagaaggaaaactaacaaagagcaaggacatccacaccaaaaccccatctgtacgtcaccatcatcaaagaccaaagcctccaaaggaaggcagctcctcgccagcaatggaacaaagctggatggagaatgactttgacgagctaaaggaggatgttcaaacccatcacaaagaagctaaaaaccttgaaaaaagattagatgaatggctaactagaataaacagcatagagaacaccttaaaggacctgatggagctgaaaaccagggcacgagaactacgtgacgcatgcagaagcttcagtagccaattcgatcaagtggaagaaagagtatcagtgattgaagatcaaatgaatgaaatgaagaaagaagagaagtttagagaaaaaagagtaaaaagaaatgaacaaagcctccaagaaatatgggactatgtgaaaagaccaaatctgcatctgattggtgtacctgaaagtgacggggagaatggcatcaagttggaaaacactctttaggatattatccaggagaacttccccaacctagcaaggcaggccaacattcaaattcaggatatacagataataccacaaagatactcctcgagaaaagcaactccaagatataattgtcagattcaccaaagttgaaatgaaggaaaaaaatatt

SEQ ID NO: 470300 - DNA, 1087 bp, Homo sapiens
tgctgttttggtccttcttggtggagggtctggtgcctgtctgtatataatcatgtgctcccatcgggtgactttgacaacttcccactccattagcccaccccctagtctaagctaccaccatctctcacctggactgcaacagcttcccacctgttctacccaaatccactctcttccctgtagcaagacatgttcccatgcctcctctccaccccctccctaccccacaaccaccatcgtcacagggcctttactcatggtctactgtatgcccagagactccccacctccaatccacacacatacacagccatctagttacctcctactcatccttcagacctacatcactttcccagacccaggtcatgttccttcattagaaacttgtctccagtcatgttctggacatgtgtatctcagatttgtaattacactccttcactcacttaacagctctttactaagcacctactttgtgccaggtactgtcctaggcaactgaataattagtcaagcaattgaaaaataaatgcttgagtattttctgttactctcaagtactaggaaactgaaaaaatacaatataattaccacaggtaattacattctatgaataattaattacaagttcatttctttatttatctttttaatatcattcccactctaggccctatgttcaatgagagctggaactgtgtatattctggtcgacaagtatcatcagctctcagtgtagtgctaatgcctagcaggtactaaaacatttgggaaattaatgaatatttacatttgtaaattaacaagtgaatgaataaatataatttgaatattataacctggcttacattgaacttgtgatattttaatgtttaataaatattgtgatatacaattcgaaaacaatttcatgtgtaggcggcaagacaacctttccccaacttgcccattaacctgtaaaagatgtgaatagttactcccttctcccctcacttttgagaagtggtttccgaagagctagctgaactttgctgccatcttttgaccaaagttaatactgcagagataaaagctacattcc

SEQ ID NO: 470301 - DNA, 627 bp, Homo sapiens
agatcaggttcatttccagaaccgccgctgcctgcattgaggtgatattagaagccaccatgacagcaaagtagttttatgcatagcggcttagtggacactttgagaactacaccatgggatgcaatccagagtcaaaaaggaggaaaaaagtctctttgcttagagacattactacgttgcaagatctgggtagctgaagcctttagccccagtgaggaatgtttgtggaaggaagatgttttctggctgactggcctcatcactccttctgtctccgaaaggacctgcccaagcacctttgatgaccttttgtccattgactcaggccaccgtgagctcctgctgttgctgcagcagcctcctgtgcagttggagcctgacatcccttcctcggctgtccttcctttctcctgcccccactcccaggcttctgtctccacagccctggtgcatgcacacaaaacccaggaaataaaaaagaagaatgacaaatccagttacctgtgttagatcttacctaaacacactaccactctccacctgaaaagtcccttctgcctaaacaatttgaatttggagacacaagtgtttcatacaatttcagggttcattttatttgcacat

SEQ ID NO: 470302 - DNA, 595 bp, Homo sapiens
gagctgtgatttacacccccagtaactggacaagacaggagtcccagggcagctctggagcctgaccgtcggagcagctgcgtgggtcctgctcgctctccacgggccatctaagaaactgatgtctctaggagccctggtcaactggaattggggacttggtgctgctggtttggttgagctgccgctgctaggccatctgaacccacagcaagctgatgatagactgcaggaaaagctccattcagatagcaagggtccttcaccagccccattccatgacgcactcaacgaccctgcctccaaggctttgaggaagtaccctgaagaaggaccaccctttggaatttataccagcagccctgacagctgttttgtatttatttctacggttgggccatttcaatttggggcttttattcattatataagcaaatatttgttaaaggatcaggcacgggatgagaacttggaagtctccttctccagtccggcccatgcgcctggctctgattctattttacctctagctctttctagatgtctgtgcctggaaaaagcctcatctccttaagttccatatggccccaaataa

SEQ ID NO: 470303 - DNA, 771 bp, Homo sapiens
ctactttcctcctcctccttctcctcctcctgctcctcctcccccctattttcctttcccctcttttttttcttctcttttttcttataaacgtgactgatgttctggcgtctgggagcatgtttactggctataacagtgttccagaggctgctgctgagcaactgctacaagccttgccactgagaaagcaagcaggcctttcaggccccacccttccctgcctgctgcagctcctgtgcttgtatctacttcccattctttcctgggcagaatctccccccaccccagaattctgcccagggaagactgtgtttggttccccagtgaggatgtgtgtttggaggcagaccttcccccctcacgctgtgggccctcagttttttgtctgtctcgtggagcttgcaggagcaagccacttttttcaaagggtctgtggattcttttggttttcttggtatgttcctgtggtagttcttggagcagaagttcatgatatgagcctccacacactattccatctgtctgagtgggagctacaagttagtagctgcctcctagtaaccattttccttggaaatcctcaactttcttgtatgtgcattagtcagggaattgggcagcatggcccacatattcaaaaggggtgactaaagacagtgtgatgaagggactgttcacacaggggtgggcagggttaaccactctaacaacagcaggaagccattactaattctaggcctgaagggtcagaggaaagacctctcctat

SEQ ID NO: 470304 - DNA, 664 bp, Homo sapiens
cggaatcccgccagtttggattaactcctgatgcaccacattctgccactccattatgttcaccatacactggttttgccaactttgacctctctgagccttgtttttctcatcaccactcaggacaagactccagttactgccccctctgcttttcattgttctgtagacagtgagctcctcttgagagctggatccactgctaatgcagctttactctccaagtcctacctcgacgttgcctcacccagaaagccttctcctgcttctccagagcagactcaggcatccttctgctctactagcaccctacagccatcctttgccaattacaggatgatatcacaccttggtgcttctaccccagctctttctagagcctttgcacagattgcaaggcacaatgcagtgggaactgaggagaagaagccagagggtgtttgggagcaagcatctgttgattcaacttctgccacctccagcagctacagtctgaattctcgttcttctgccctgtacccatactcttcatccagaacagtggggcttcagcgtattgtagaccttgtcatcacttaatagtagaaagcaaccttctcacctgccataatcaggctttccaattccatagacgtagatctgaaataaaaactatcactcattc

SEQ ID NO: 470305 - DNA, 1436 bp, Homo sapiens
agcagcacccatctccctgtgttgctatagtgtgcttgcatactaagggtatggagtccagctgggaggacctgcctttagccctcgccactggtgtgtattcaggcactggatgtggtaggcaggggcagggcagtctgcaggtcactggtgaaatgcttaggggttgggttgaagttgcctgtggcagctcagccttcatcctggcagtggcagcagttggcagtggtagcagcatggttgagttgcttttgcctctgggcattcctgtgttcaactggggcttttgccaaaaaagccagaacgcccttaatctcctctttcctcatgaaactcacagctttggttcgtcacagatcttgcagatcttggcggtgctctcctactccccagttttgtctcagcaccatatggcttttgacaaagtcaggccacagcttcaacctaaacagcttaacattatcgaaagcccagcccactgaggaaataacagttctcgtttatttctaaatatcaagtggactattttcacccagaaatagagtctgaaattgaattatgaaggaaggtatattcacatgtggccacttctcatctgttatctctatacatgacccagaaaatcagctccatccaatgatttccatatttaattgatcaagtcccattgattatatctctaggtgacccttatattaatctttcgtttccattaacaggacaactaccccagttctcacttatgaagaaaattaaactgaaacataggcctagagtttatgtgttcttgaacattgcaccagtggtattttgggaaattggaattggctctttcatatagtaaagctcagaaaccttcatcctccctgaatgatacctgtttatcacactgcttttggaaggagatgaaagagttgtggacttagcaaaatgtagagtcattaaggattttccagacatatttaagcatgctaatattctaagaatgatattttagcagaaacatctaatgttttgccactaggttatttacaatactagatgaagttcaaggagtctttggctttgcttttcatttccctacaaattattttccagcctctgtggattttctgaattttgtctcctagaattgaccacaagagaagactccctttcaaactcttcattctctggttcagaggtttgatgtaatggttgtctcatcgtacatggtcagccacaggatatacttcatccatttcagagctgtactgtgagttccagaataatcaatctttgaatctttgaaccagggtcttctgttgtcccatatatgtgaacattctaagagtacaattatatccagacacatttttaaaactttgatttttgtttagattacaccaatagacaaaaggctagaaaatatgatcaagaaaatgtgctaatctttt

SEQ ID NO: 470306 - DNA, 1501 bp, Homo sapiens
aatatctgaggttcgtcgtctcatggccatggaaaactaggacgcagacacaccagagtgaggttaagagtggaagtttaataagtgaaagaaagaagagctctctgtgcagaaaggggtcctggagaaaaaatgggttgccaggaaaatgtggccgtcactgccaggacagcaagtccaaaggaagctagctcattcatcaaggggactcaggcaacgctgggaagggagaagagtcttcactgtgcagatgagtcatctggactccagcaatgcagcagaaatgagagcaaagggacggtgcatgagctggagaagagtagaactgtagaactcagcaccgccaaacagctgggaagtgtcctggacgtgcatgcagaactggaaactggcctgagggagaatagttgtggcgataaagaggttgctattttggctttctcacagcaacaattcactgatggcccagagagagcatttatgtccactcccattgcagatacattccagctgttttctgctgaactgcccttattccccacccttggatagcacaaatatttctccaaggtatatcttttctccttgaaaaggagaagaaaagaagaaggaaaggaaaggtgcttttattctagttacctcccaaaaagcacatgagaaataattcaccagtcattcacatttccattttctctctttttctctccctatacctcaaagctctggaagacatgtggcaaatgtaccctgatagccatagacttgtcccatagccatttttccttgtgacacttcacaaaaatgctgcacaatagttcctgtgtgaatatgagacaatgtcaagaaaaccaagaaaaaggcagctggctccacgggtgggtctgcaatggatcccactggacagagcttttgctctatcaactatagagattgatgataccatagaaaagaagtcagttgctattattgtggttttcttgtacatgaatcacctttttctcactgttttcatgattttatctttgtctttggcctttaatagtctgtctaggatataactagcactgagaccaatgtctgttagactctgcaaacactttttaattgataacaaatgattgaaagcctgattagatcacaggccagaaaaccttttctgtaaaggtccccagtagtaaatattttaggctttgcggaccacaaaaatcccattataagtatttcacttctgctattaaagtataaatgcagccatagaaaatatgtaaatgaataagcatggctttgttccagtaagactttatttataaaagccaacatctggcctgcaggctgtagtctgcaaatacctggattaaatgaatgaaggaaacaatgataggtgattttaaaatgtttgaattaattgaaataaactctggcttgtagttcttctgtaaataatgaaaacctattttctttacctttggtctaatcaagaaaaaagtcattagcattttct

SEQ ID NO: 470307 - DNA, 963 bp, Homo sapiens
gcattctctctctcttctctctctctcttctctctctctcttctctctctcttctctctctctctctctctctctctctctctcctctctctctctctctctctctctctctctctctctctctctctaggcttatggtttggtactgtgtgctgctgaacatgctggcacagaatgttccaacgcatattcatttgtcgtacaaaagcagcccacacagactgcagcttgtctctccatcaaatgcagcactgagaagagctggagtctgcattaacatcagcctccgcatttgccagttccaattacatcgaatcgtgtgcttacaggggccctgtcaacattgcttagatttgaagatcaagtccaaggaaggtacgagtatgcagttgatccacaaggcaggccttaacttcaggcaaagtagttacccagtgttactggctgaattgaagctcccctccaaaatttgtgttaaagtcctcaccttcagtaccccagaatgtgactgtgtttttgtggaaaccggtcctttaaagagatacttaagattaaatgagatgactggggtcactgctaactagcatagctcctcatctcatggtaatcctggatatcattttgaattgcttttgaaaaatagcaactttattaagatatagttcccatcccatctaatttactcatttaaaatgtacaattcgatggcttttagtacattcacaaaactgtgccaccatcaccacaatcaattttagagcatttgcatcaactccaaaaagaatacccattagcagtcactcctcaatttccccattccccttccctccagccctagacaaccaccaatctacttctgtgtctatggatttgtctattctggacacttcatgtaaatgaaataatatgtcatttttttgtgactagcttctttcccttagcatgttttcacagtgtaccgac

SEQ ID NO: 470308 - DNA, 934 bp, Homo sapiens
aagtcacttaagcttaagtgtgtgcaacttctccaggccatggtcctgcagcatccagcagtccacagtgcccagcagcttccaccagtaccccttgagtagcttcagccaccaatgaggcacctctgcatgaagagcttctctggcacccccttgggtagttttgtagtgagttctgaagcatggcacctctctgtgggcagatggacaccgcccgcaatggatgtgtgaggttaatgactcctattgagctcagagttggctacagctgggagaaggagctgtgcttctcactctgtgagcaattctttcctcccagggagaagcaggaagagctagcaaggaagcatgcaaggtttgtcctgtcactcaaccaaactatggagaaaaaagccaccaccactgtttacataaatgagacttataccaaaataaacttgaagagagaagacatagcattgcaaaaaaaatgtattcaagaggcagaggagctaatggaaaaagaaagggcagaatatctaataagaaaacaagagttgactgcacagctgatgatcaagagaaaaaattaaagatgctgtcagcttggggaaaggaaaggactctttggaatgtctatattattctcatttcagttccgaactccctataaacaaaaatgcccatgagggacggcattagtgggacatatcataggctacaacccatctacccatgctgttagagttgttcttactcaaaggatacttgccaaacttcctaagaaaatacagggaagcctcagggcaaaaactgctacacgtgggactggaaccagaaactgaaggaggtcttccatccatccaaagcctcagtctgtgcttcattttgtggaagtgttttactcctctctttatctgcacacagtattctcttcttggtgagcacatggcaa

SEQ ID NO: 470309 - DNA, 585 bp, Homo sapiens
gcggtaatgctgttaggaacacgacatggcagacaatgtgaatgttgaatgcatcctggctcttgatctggtcgttgctaccacagagccctggattgtgtgtagaaggctaaacgtcctctgcaccttcactccccactccagtttctaccctatcaatgactcaggaataaatcctgagaactatgttggaaaccctgaaggagcaaacgctgctccttgtaaaaccagacccacagcagaagaatctgagaaatctacccaattcctgacaacatcaactcaccttgattgcaaggtgagtaaggcagtctgctgccctccaggagtttacagtacattgtcgacagctgtgatgaaagacaatgaacaaaagatacaggaaggagaaagtgctgtgagaatacaagtgagggagtgtcttttcttacttgtgggacaaggaagaatttcccagaggaactggtgttttatggatggatagaatggcaaaaggagataaggaaccctacctttcccaggcagagaacatggaatgagcaaagccatgggaagtctgactctgaagaaaaccaggactgtcac

SEQ ID NO: 470310 - DNA, 831 bp, Homo sapiens
tgggcctgaaaatagtggagaaaggtgggcgcagacggtaccgcacacactgtgagactgtgggactcttggccaccatgcgcatcttgaggatttcatacctgtccattggtatattcaaaggccaacttcaggaccattcagacttgaagtcagcacagtactgtctcttgcccaaggcccgcagttaccaccacttggctaccaccaatgttcactcaaggaccaatggctctacaatcagcaggtggcaaatccagccaggcttgtgtccttcccttcagggcagtgagttcccccagccctgggaaggtccagagatgtcatctgagagccagggcctggagttgggatccttaggaatctacccagtgctctactctactgcatataagatggctcccaagctgcaagaaaaagccctttccactcttccttcgcctttcctcaatcagaggcttggtgtcatatctaaaaaaaatgcctaatctcaccaatgtttaggatttacactaacgttttcttctaagagttttgtagttttagatctacatttaggcctttgatccattttaaattaatttgtgtatatcatgtgggtaatttgtctttctctttttgcgagttgccttttgtgttctgtgcttattgtcccaaacaagtgttatttttctcttatattttaaaggttctttgtattgaatattgtcatttatgttgcaaatatttttcatcttttattgctcagggataagaaaacctagattcttatcagaaaaattcagagacttctccaaagtcacatgcttaatatacctgttactaaagtct

SEQ ID NO: 470311 - DNA, 603 bp, Homo sapiens
cctgacactgctcatctagagagtgtagggggtttatttggaccatcagtgggagaggaaacagcccatgccaaagtacagaaacatccattcagttccagagaactatagttgtggcctgaacctagggtcctctgtggaggttgtggctgatgagcatatggttggacaagaaggatcagatacatcaaagttggagatgtttttcttagggtatcctcgtatagttggattatcattatttcctaatttaacgagtcttaccattgttgctcaagatataaaagaaatttcagggttagagccttgtttacaacttaaagaactttggattgctgagtgctgcatagaggacttaaatgtaaaacccaatataaaaaccctggaacaccacctaggcaatatcattctggacataagaacaggcaaagatttcatgacgaagacaccaaaagcaattgcaacaaaagcaaaaatggacaaatgggatctaattaaactaaagagcttctgcagagcaaaagaaactatcaacagggtaaacagacaatctacagaatgggagaaaatttttgcaaactatgctctgacaaaggtctaata

SEQ ID NO: 470312 - DNA, 812 bp, Homo sapiens
ggtagtagatcaggaattaccttcgcgatactttcattcccacctcctgggcctgggcactcagatgtgacaatctaagattgtgtgtcttttgctagtcatgccgagaaactggaagacaacagaactctttctggctgcagcagcaacatccagtttccaggagctgccagggcagagctgccagcgtggtgtatggtgtccagtgtccaataaccaggcccagtgccagcagtggcaggctctcattaggcctcagtggcaatggcagaggaaagatttagaagtacaagtggtttttggttacatggatgaattgtatcgtggtgaagtctgggcttttagtagctctcatgaaactacagtcaaggtgttggccatggcttgcagtcatctcaaagctcgactggggatgggtccatttccaagctcattcaggtggttgttggcaggcttccgtttctcccatgttgttgcaccaagggcctcagttcctcattggctgttagccagaagcaacccttagttcttgccaaatggacctctccataggacagttcacaccatgctggcttgtttcatcagtgcaaacaagctagagggtagagagtttcagcaacacagaaaccacaatcttttggctattctgggtttaccttgaagatgaccaatatagactgtgatggttaatactgtcaacttgattggattgaaggatacaaagtattgatcctgggtgtgtctgtgagggtgttgccaaaggagattaacatttgagtcagtgggctgtgaaaggcagacccatccttaat

SEQ ID NO: 470313 - DNA, 1088 bp, Homo sapiens
actaggaaacggaaggatgttatagagcaaagacttgttgaattgttatgactgaaatgctggtagtgatatggacaatgaagcccaggctgaggaggcttcagatgcagatgaagaacttattgggaactacagtaaagatcacttttgttatgcattagcaaagaacttggaggcattgtgcccctggcctaaggatctgtggaactttggacttgtgagtcgtgatttagggtacctggctaaagaaatgtctaaccagcaaagcattcaagatgtagccttgctgcttttaacagcctatgctgtcatatgtccatggctaaaaggggcccaggtacagctcaggccactgcttcagagggtgcaagccataagccttggtggcttccacatggtgttaaccctgcaggtgcacagaatgcaagagttgaggcttgagagcctccacctagatttcagaggatgtatgggaaagccttgatatcagcttcttccacatgggagggaaaatggctgctgacggctcccaagcctcaatcccttcacccttgccactggcaaactgcggtttaggttgctgccttggcagtcctggctgtcctcacggaagagcatgtgaaccacggacctggctgtctttttcattgggttggctctgcggtgcaggctggcagatgagcatgtgatgagcccgcccttgctggccgtgcaattcggctcctgtcatgctcttggccattgaatcggcctaatgcagcccctcagcagccagcctggtgttccctggggctgaggatctaatgtcagcagggcatgattcgattcacattaaagatggatattaagtctttttactcggggtcttgtcattgtaactaatgcacaaggtgagaacttgtgctcaagagacattctttcttcttcctccacttatttctacaattgcttttctcttaaagtaaaaatctcaagctacagtcaaagttcatttcatgtccattttatagataatgccacacaatgtgaagattcattctgaatttaaaaaataacctttacaaatatcttctgaacctttgccaagg

SEQ ID NO: 470314 - DNA, 790 bp, Homo sapiens
gcttgccctgtggtttgctctgcctggaacgccgccccctacctcaactgctaccctgtcattccacaaagcctaccccacctccactaagttttccgtgtaaatcgacctccacacttggtgcctgcatgcatcccttcctgcctttttctgtagcagcacacttggagaactgctctttcccaattcagtgtgttttggttgaggctgtcaaacagtacctcccactccctcaacccacagcaagggatgaagccgacttgattgtggtggataagctttttgatatgctgctggatttgtcaggcccctcagctgcagatctgttggaggtttctggaggtccactccagaccctgtttgcctgggtatcaccagcggaggctgcagaacaacaaatattgctgcctgatccttcctctggaagctttgtcccagaggggcacccacctgtttgcggtgtctgtcggcccctactgagaggtgtttcccagtcaggctacatgggggtcagggacccgcttaaggaggcagtgtgtccgttcttagagctcgaacgccgtgctgaaagaaccactgctctcttcagcactgtcagacagggatgtttaagtctgcagaagctgtctggtgcagtccgcagaagctgtctgctgccttttgttctactatgccctgcccccagaggtggaatctattgaggcagtaggccttgctgagctgtggtgggctctgccaagttcatgcttcccagactctgtttacgctgtgagctactcaagcctcagca

SEQ ID NO: 470315 - DNA, 703 bp, Homo sapiens
ggaactgagaacttcagccaacaagaaccaaggcccctcaaggatgaccccgcctctaggacctgaaacggacccccagtcaattgccagcaaaaagtcagtgccctcagtcatacagtcacaaggaaatgaagtctaccaacaactggaagagctgggaaatggattcttccccaaaaatgctgctattatgacacaactctttctggaaaagcaccatcaggaaccacatgcattcccagcctggtttttgttaccagatctgctttccacgtatgcttctcacaggaaatcagtgacggtgaacatgatgaagtcagtgacggggaacatgatgaagaagagatcttccttgcctcactgtgagtccttcaccaacaagcggccatccatttctgtctggttcctgccctgggtgattgaacaaaaggaggtttttttgaaagcatgcactggcccataaagatggagttgttatgaacacagttggaaatctgggtttgagtcctgagttatgtgtgagcctttttgcgtaatgtacttaagctttcttaatctcagtttctttacctgtgaaggtgagcctcagacattctcttcattctgaaatattctctccacttggcttgtgtgataccatacctttcagatttttctccttttcctccagctatttattctctcctttccatagttccttttc

SEQ ID NO: 470316 - DNA, 725 bp, Homo sapiens
tctgaaaaagtgattaagtgacacagaaagactagaggaggttggaggtggagaatttcccttccctcacgtcagataaggctctggtacccttttctgttgctgagtaggcctctgttatggggaacactctgggtgtatttcagcatgtttgcttttcccttctgcctgccagaaacatgaagaatttgcttggctttttactgtctgcagtaaaagataaaaagcaggagaaagagaactggagggctcagaagaaggcaggaagatgtgggaaagtttggaacttcctagagacttgtgaatggcttgaccaaagtgctgatagtgatatggacaataaagtccagactgaggtggtctcagatgtaaatgaggaacttgttgggaactggagtaagggtcactcttgcaatgcaaagagactagtggcattttgcccctgctccagagatctgtggaactttgaacttgagagagatgatttaaggtatctggcagaagaaatttctaagtggcaaagggttcaagaggaagcagagcataaaagtttggagaatctgcagcctgatgatgtgataaaaaagaaaaacccatttctggagagaaatttaagctggcttcagaaatttgcataagtaatgaggagccaaatgttaacaccaagacaatgaggaaaatgtctctccagagcatgtcagagaccttcacagcagcccctccca

SEQ ID NO: 470317 - DNA, 1347 bp, Homo sapiens
cttacatcagttctcttgagtggattgtggaggggctgctatggaccagagtgcccacagcgatgtgaaacctatttgtcctggaggaggagggaggagggaaagggaaaaaaaacaactggctcactctggctccataaatcactggaagggagagcccttgcctggtgaagttggagattctacctggaagctccctgatggtgcactgagccggggtgtcgtaaatcaccagggctccgccaatggcagccctgcccactggcccattgaaaaggggctggttgttttgctggcagctgatgcagtgcactgtcccagaaagccggggacagggcagggctgcgtcgcatcctgtgtgcatccttgcccattcgatgagtcacaagtagacaagctgcctattgggccctgaatacctgagtaggtttcatacctgcctggcctatcccctctccctcccttccaaagactaattatagtatcagccccctaccttacctaagctgatctgactccatttccagacccctcattgtcctgttaccctcctttgaattgactctaaattttacgtaatgaggaggcatacagatagcttctgtatgaactctacagtcagggataaccggagtatgtggattcagttccacttgctgcatccccaaaggcactgatggaggcagaggtgactccaggataccttagcgggtgggagagatgggagctacctggggaagggtttggagctggcaagatgtaattcagaggagcagataatgagaaaaggatggagagaaaggcgtaaaggcattcaggacttgcctttcataggattccaataaagacaaaggaagggtctgctttgctttcaagcctgtggtcctcacccagactcccctgcaggggctcccctttgtctctttcatgaaagccagtaggtctccttcaccctttttctctgctctgattacaacacagagccttctctttgggagcaatagccatctggattatcttctcttcgtctggccacctcatcaactcatcatctttttaataatctcatctgaaaacatatcctttctcatttgcttcttaatttccccattgtccagtgacttttctctctctccctttctctgaaaccttattcttattactttatagaacactgggggatagattgcccagaaaatatgtactataaagtaaatgcatatggtgatatctatgaattgcccagatccagtccatctgtgcaatgtcacaggcccagctgtttacttgtgcacagtgcaattgcaatggctttatgacatgggcactggcttacaagctactctg

SEQ ID NO: 470318 - DNA, 1517 bp, Homo sapiens
cccagggcagaactccccaacacccttgggccacacaccctctctggccatctgcctgctgtcttgaccctaccttctggaccacccttcaaggctctgtcctcccaactgacctcccaggaactgctacacagcaattcatccaggacagcagtaaggacgcctttagcagtaagtgtacctggtaagtgctcagtgagtggcatcatgattatgaggcaagcactgacccctgctccaatcctgctggcgttcaaggctttgactcaagtcacctctctgctggttgtggtggtgatgttattggtagtggttggtgttggtggtggtagtggtgaaggtagtgatgatagtggtggtagtggtggtggtggtggaggtagtggtgatagtggcagtagtggtggtggtggtggtggtgacattgagcatacagtagaggcctgcaaaccgaggaaggctggcccgcggctctcaggcagttctggctccggctctggctccggctccggctccggcactgggatcgaaagacgatctgctccttcggaagaaaacacagggtgcggcggtgactcgcagagctcccagcgccccagcgcccccgcgaggcccgggcagcgtccgcgctccctacagggggaagcccgccggtgtttgggaatcccagcggggtccccagcttgccgatctcccagccctgaccttactgagatttctcactagcacaaggacttgttcaatttcatcttcatcaattgctagctttgtgaccttggataaatcatttagccattctatgcctccacttctttatctgcaaaacagagttaataatgtccaacctatagggtcattgggctgataaaatatattacatatcataatgtactctccacatagaatacactcaatggggactgttataataataagttatggtgctgctcttctgaataaaacaatttttctcatcctcaccacccacctctgcccccaaccctttaagaaaagtttggttaatgggttccaggctctgggatcttaggttagtcaggtcttcacagtccttcgacttaaatattcatatcattgtccccaaaagagagaccagtagttgcttcccacccgaacatctgtatcaaccttctagtctctctgcctctactcatgccctatttagtccattctctaaacagcagtcagtatggtcttttaaaagcaaaaattcaagagaaaacaagcaaacaaaaaccccaggaattccagattatgtcattccctttctggaaatccttcagtggtttttctcttgtacttaatgtgaaatctaaaccgtgttctccaagacgaaggcttgcccgtgtggtcccactccagcctgtctcccaccaccctgcctcttgctgtgtttccactctaggaccactctcccacctttctattctcttgaaggcaggacgctccccgctctgaggctctgcactcactgttcctggcctgaaactctcttcccc

SEQ ID NO: 470319 - DNA, 571 bp, Homo sapiens
agccagaagagccagcagcagcagtaaggacgcctttagcagtaagtgtacctggtaagtgctcagtgagtggcatcatgattatgaggcaagcactgacccctgctccaatcctgctggcgttcaaggctttgactcaagtcacctctcagaaattatgtttccttatttggggtggtggtagtggtggtaacggtagtaatggtagtactggtgatagtagaaatggtagtgatgatggaggtagtggtggtggtaataacggcaataataatggtagtgatgttgctggtgttggtggcagtggtgtttttgttggtagtgctggttgtggtggtgatgttattggtagtggagagcatctgatagcttctcttcttttttttctccttctccacccccacttccttctcctctttgtcatcctcctctttttccttcttcttccctgtctccaaattaatcttagcagggagtcctgaagcaaattatcatgttacaagcctaaatgtgatagcttgtcatctttcattatttttgacataaacaaaactgtcagaattctctgaga

SEQ ID NO: 470320 - DNA, 726 bp, Homo sapiens
tttgaccttttttttttcctctctcatcactcgcactctgccaaaatgattaactaatttctaaaatcaaaacaatgaaaaagattattattaataagaaatctgattctgtggcctgtggtcaggacttgggtgaatataattctgcacaaaagagagaaaatctgacttctctcagcctgaagaaggtggaaaaattttctccaagcagcttccgtgaaagtcagggtgatagcactctcatgagtgggattaacgctcttataaaagagacccctggagagatcctgcacccgttctaccatgtgaagacacagcaagaaggtatcatctataagccagaaagcaggccctcaccagacaccaaatttgccttcatcttggacatcccaatctctagaactgagttgttgaagacccacgtgtcagttaagagtttggtgaggggttgcttcctggcttgtagatggccaccttcttactatgttgtcacatggacttccctcagtggacatggaggagagagagagagcaaacttctggtgtctcttcttataaggacactaatcctataggatcaaggccccacccttacgaccatatttaatcttaattacttctgtagaagcaccctgggggttagggcttcggcatataaattttggggggcatggaaacattcagtcctttatagatagatgggttttatgaaaaagacagaaaagc

SEQ ID NO: 470321 - DNA, 641 bp, Homo sapiens
ttcagacacagtaaggctgggatgagatcctcgaagctgtgttttaacaaactccactggagagtcccatattccctcaaatttgggaatcacgaccctgaaccaggtggactactgcccagtgcactccattttagtggaaagttcaaaagaacacaggagcccctgcagaaacacactcccagaccatacaaggaagtcttacagctgcaccactgtgaaatgacactggatgattacatctccaagttgatggagtatcctgtatttgaaagccattttagaattatagaaaataaggcccatggggacatggaggtcagcctaccaatgccagtatttccagatgatctctactgttgtcttcaggaaaaggttgactaccagatgcccgttactgtggctccagagtccactaaacctctgagttattccaggaccagcggtgtgttttggcagttacctctgccattcaaatcacctggaggtcaggacatgcccagttgatttaggagcactagagaggggcatttgctggaaacctctcatctgttatttagcagccacatggctaattacttctgatacagtgatttcctaagatgatagagcaggaagccttcccaaaatcgggtctaggt

SEQ ID NO: 470322 - DNA, 1478 bp, Homo sapiens
tctgaaggactcctctgttttctagttctagagctatgccagttggagatcctattcccagagctctgccagaaaaagttaacgacccctctctgctaactttatagagctagttgcgatggtgaggactagaatgcaagtaagaccaaatactccaggccctcaccaaacatacgctgctgccttgatcttggacttcccagcctcaagaactgtgaaaaatgtctgtcattcacaagttactcagtctaaggtgttttgttatagcagcccaaatggactaagaaaaataccagacacaacccaaggtgtggcagctaacaaagaccaaagccacctacaagagtatgatgaggcttggcagatgagcacccatgtttgtgcacccctgcagctgttcctgcaccaaaccttctgggctccgagctgctcaggaccaggaattagttctggtgctcagcaagcccatgcagaaatcccagcttcttctcaggatctgagtcctcctcctgtccactctcagtaccttctttccaagatctctttgaagtgtgctggtttacttgatgtggacattattgcctgatcttagaaaacattcagtatttcaccattgagaatgatgttagctctaggtttttgcagatgccttttatgccttgtttaaaggttcttaatcataaatggatgttgaattttgtcaaatgctctttttttctacaccagttgatagaatcattctatgtttatttagaatttaatgtaatggattatattaattgagtttgtacattgaaccagccttgtatttctagaataaataccacttgatcctgtatattattccctttatatattgctagagtaaaattacttctttttttgagaatttttacatgtatgtttatgaggggtctactgttttctttctgtaacattgtctttgtcagtttcagtagcaggaataacttggcctcataatattcattggaaagtattactttctttatattatttggaagagtatatgcagaatttgtgttaattctttcttaaatgtttggtaaattcttaagtaaaatcatagggcatggaggtgactgttttggggagattttaaattatagattcaatttatttaatagttgtagaacttttcagattatgtttagcttgaataagttttggtagtttgtggttcttgaggaattgtcaattgcaaattctcttattgaccttttaatatctctgggctttgtaatgatatctcttttattcctgatattggttgtgccttttctctcactctttaaaatctgttagtcttgctaaaggtttattaagaaataaaagtcatctgtataggaaaggatgaagtaaaagtttctctgctgatgacatgatcacatatatagacaactctgaagacttcaccaaaaattattagaatgggtaaacaaattaaagttgctggttac

SEQ ID NO: 470323 - DNA, 620 bp, Homo sapiens
tgcctgtagccctattgtatctaggaaaatcacccatggcacctcactgacatcagatttagcaaataaaaattcaggatgccagttaaacttgaatttcagagggtgcaaagcctgaagccttggcatcttccacgtggtgttgaacctctgggtgcacagaaatcaagaattgaggtttgggaacttccacctagatttcagaagatgtatggaaaggcctggaggcccaagcagaagtttactgcaggggcagggcccacatggagaacctctgctagtgcagtatggaagggaaatgtggggtcaaagcccccacacagagtccctactggggcaccacctagtggagttgtgagaagaaggccaccgtcctccagatcccagaatggtagatccactgacagcttgcactgtgcacctggaaaagccagggacactcaacaacagcccatgaaagcagccaggagtaggactataccctgcaaagccacaggggaggagctgcccaaggctgtaggaacccacctcttgcatcagtatgacctggatgtgagacatggagtcaaagacatcattttggagctttaagattgactgccccactggatttcaaactt

SEQ ID NO: 470324 - DNA, 1170 bp, Homo sapiens
agtggttccctgagggtctgtggcatcatgtgggtgttcatgggcagcagcatcacaccacatccctctgacatgcactcttctttgtaccactgtgagctcctcatctcatctactcttcatggctatcatatctggcgtctgttgctaggaagtgatttggcttctggaaatggcaaggatgatgcagcagagggaggcagctctggagggtggaagtccaagatcaaggtgtcagaaggtttggtttcttctgaggcctctcttgttggcttgcggatggcaaacgtgcatgtgtgcatatcaccctggtgtctcttcctcatttatgaggacaccagtcatgctggagtagaccccctccatctaatgaccgcatttagctttaattatcttcttgaaagacctatttccaaatacagtcacatcctaagatgattcagtgcttattgcaaaaaacataattgagaggataccagatttatttcagcaattctatggataaagtcctttcgaactctagatagtagtctctaagttgcatatgtatagtaagataatgtaagcaatatacttgaatcttagtattgaggctttgctattcatgaaatatataacctgaatttttttaaaaaatcaatgaatttgatcatatcttggaacctcatttcactctctctggtgttgtcatggcaacaggaaagccagggtgctatggggagctgtgatttgagacttctgctacagttattcctgtgtgtggtccagagagaaaaaaataaagtgatggtgcttgatttttaaaaattatatttaatatgcattatgctaatatagcagtcatggaggattcacactcttaaaaatgcccagttttgtcttttgtctttttacccattaagttggatgggaagggaaaaaaagcatatcccagatgctttatttgggatatttattgcattaaatgtacttgctgctctgtactgtccagctgcaggctgcttttactcttctaaggtctgctatttttactgtttctatatccccttgagtctttcataattttatatataaagtgctaagcattttttaagtaccatttcagtaagttcctgaaagataagtacagattactttcttaactacttactgtgtgacctttctaggatc

SEQ ID NO: 470325 - DNA, 1174 bp, Homo sapiens
atatacccccctcagagctgctgcctatattttcccctgaagctggcttcctgttgcaaaatgccaatgatttgtcttgtcttcctagtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacgggactttgaagagaaaacgattgctctgaaaaccctgcatgccacatttgaatctgagcagagtgtagatataactctcattacctcaattgatcatcaggactgcaaattcactccaacctactggccctgctggcagtagctctgcttacatgttatggtttgtagaaatttcacttccaaagtgatgctactcatcacttcacagtttacacgccacaggcgtgatggcgtttgagcttgaaatcaacactgtaagacaagtgagttaagggaggatgggagagaggagctaaaagccgagatgcataggtttatttcaggactctcagttgtattccactgatatttatgtctattcttatgccagtaccaaatcctttaattactgtagttttgttataaattttaaaagtgttaagtgcatccctgatgttttatctttttatttgttatatttgtacattcttttaaacttaaaataaaacaaagaactatcatactttgcgtacaagatatggatcagctggtggtagcaccttgtgaattagtgtttaaagtccataagcatgattaaatcaccttttcattttcatttgtttttaatgaagctttccatttcaaaatcagtgcctata

SEQ ID NO: 470326 - DNA, 962 bp, Homo sapiens
accccctcagagacacttctcctaactatccccaaccctgaaaaaaaacaggactaacaggacatgatggacatgaaaatggaaatggagatggagatatggagatggagatatggaaatggaggtgcagatggagatggatacagggatggggatggaaatggagatggggatgctgatggagatggagatgcagatgcagatggagatggagatggagatgcagatagagatggagatggagatgcagatggagatgcagatgcagatgcaaatgcagaaggagatggagatggagatgatgcagatggagatggagatggagatggagatgcagatggagatgcagatggagttacagatggagacggagatgcagatagagatgcagatgcagatggagatgcagatggagatggagatgcagatgcagatgcagatggagacggagatggagagcagatagagatggaaatggagatggagatggacgtgcagatggagatggatacagggacagggatggagatgaagatggagatggagatgagaaggcacccagccatcctgaatcttctatgaaaatgaaaatgttgaggttgtatttttaccttcaaatacaacctccttgtttcagccctttgaccaggacatcatttggtttatcagtgccacacgcacctgcctgatatttgattgcatttgatcagcaattaatgcagaccctaatccagatataaaaaaatgctggaaatcattcactatctctgatgcaacagcgttcatcaaaactgcaatggattaattaaaaccagaaattgcaaatacctgctggaagaacttatggattgaagtcatgaatgattttaaaggcttcctggggatcaatggagaagctaagaaaataattcacacagcaagacaagttagtgaagaagaatatgccaacatacttgatgaag

SEQ ID NO: 470327 - DNA, 622 bp, Homo sapiens
ggggtggcaatgagatggtgggggaaagttagttgcatccccttcctaccagacagactcaccccctcccacctgtccagagcccagaactggaggaaagaaaggggttggatagggtatcaatttgcagaaaatagaacactttttgatgtggaacaaaagaccaagaaagaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagtagtttctggttaacatcaaatagcgagaggataatttttacagtgtgcaaaccattcaaagtatgacagcaatttatttgtgctttgaagatcgaataaagtattcaatttggacccatattccctgttcctttacacatagactcagtgcctgggaaatttaagataactataaatactacttttaaattgaacagtcttctaataatatttaggg

SEQ ID NO: 470328 - DNA, 606 bp, Homo sapiens
atacaccatttctcctaccctttcaatgtggatttttactcacttctatggaacatgcaggtgacttaggcttatttctatgtttcaggattttcaccaaggtgccccacggcccaggcattctatctccagagtccatggttttaactaccacattcctctgtcttttaataggaggtggaactgatgggattaataagaaaccaggcatgagaagccatgcagatgtaaatttggaaatcaacatattgatagttggagtcactggagtagaagatgctactggagagaaggagaacactcagagagagtgggcttcacaagccgagggaggagtttcacaaacaaggacagtggacagtgtcaaggctagcagaagcctcaaggtaagtgcaaagcaaaaacctatgatagatataacaagaataaaaagcaatggattcaaacatactatgggagaaaaatcatgtaaccacaaaggaagacagtaagaaaagaagaaaggagttacaaaacacatagaaaacaagtaacaaaatagcagtaataagtccatacctatcaataatattgagtgtaaatagatcacaccctataactaaaaga

SEQ ID NO: 470329 - DNA, 616 bp, Homo sapiens
cactcctccatccctgcaacatatctactttaaattcttggttatgttaatttgtaggtctcaaggcattacatcaagacatcataaattacattgggagctaagtagacacccattggctacatctcagggctactgctcctactcttctccccactacctccaagtgaagaatcatccagcccaaaatgtcaagctccttctcctctttttctcctccaatgcacatggaaacagcagaaagcctccaacactcattttgtgcagtgagtctcatatcctgaccacatttgattggaccaggaactttgaattaacactaacggatcctcgcctatgttctggctgctctattaaatggagacaatgcaaaaatgagagcttgacctgccattttgcccaacctagcctgcccctcagaaaaagtgagaggagaatgaccgaagcacaatcacagcaaggacagagacagaaaggcctgagtgcttttccatcctacggctagtccctgcttgctgaggctaagtgcatccctgcccaaaatcctaatagcaattatcctcctttgcgcgtgccaactccagactcatagagtcatttgtctgttttatgaggg

SEQ ID NO: 470330 - DNA, 448 bp, Homo sapiens
tcagagagtgaaggctagtgatgttatctataggagcaattggggaagtcacaaatcttgtgacctctggccacgtgactcctgagcagcagggggttggaaactacgcctacattttagcagagttcaagcatagcagagttcaagcccctcccatgatcctattcttgtggcctttcattagtcttacaaagaaggggccgccgggcagaggggcccccccacctcccggacggggcggcggccgggcagaggcgggccccccacctccctcccggacggggcggctggccgggcggggactgacccccacctccctcccggacggggcggctggccgggcgggggctgaccccccacctccctcccggacggagcggctggccgggcggggcctgaccccccacctccctcccggacggggcggctggccgggcgggggctgacc

SEQ ID NO: 470331 - DNA, 1519 bp, Homo sapiens
atttgaatcagtcttaaataaatacgcaaaacacacaaatgttccaaaggaaaaaaaaaaaaaaagaagaagaagaagaagaaaatacatgtatgtaaaaaatgcttaaagaaaaataacttttgtcgacttacaaaatggccgcccggagcgtgttccgcgcggttccccccagcggtctccggctgaaccggcgctctcgcctccccgccgaacacagcgtgaggagccccctggggacatggtgtttgagtctctgggcttgccgagcaccaagtcctctgaggaccgcagggcagcaccggaagcggccgagcgcgctcagcccggcgaccaccagccgctccagacccctgcgccgcctcgcgccaggtttcgccgcacccaagacccagcgagtgcagcggcggccgccgaggaggttcgaaaacatggccaaaagaaatgccgagaaggaactgacagataggaattgggatcaagaagatgaagctgaagaggtgggaacattctccgtggccagtgaggaagtcttgaagaatagagccataaagaaagcaaagcgcagaaatggtggattcgaatctgacagtagaggagactttaaaggttttaaaggtttggtggtaccttttggaggaggacggtttcctggatttggtagtggcgctggagggaagcctttggaaggactgtcgaatggaaacaacataaccagtgcccctcccttcaccagtgcaaaggcagtggcagagcccaaggtagcctttggttctcttgctgcaaatggccctaccgccttggttgataaaaatgtttcaaatcccaaaactaatggggacagtcagcagccctcctcctctggccttgcttccagtaaagcttgtgtcggaaatgcctatcacaagcagttggccgccttggactgctccgtgcgggattggatggtgaagcacgcgaatacaaactccctctgtgatctgacacctatctttaaagactatgagaaatatttagcaaacattgaacagcaacaagggaacaatggcaggaattctgaaagtgaatctaacaaagcggcggctgaaacacagtctccttccctttttagctcaacaaaattacagcaagagtcaacgtttttgtttcatggcagcaaaactgaagatacacctgacaagaaggtggaggtggcatctgaaaagaaaacggacccatcatcactaggagcgacaagtgcctcatttaatttcggcgagaaagttgatagctctgttttgggctcattaagctctgtcccccgactggattttcattctcccctggaaactctagtttatttggcaaagatattatccagagtaaaccagtctcttcaccatttcccactaaaccattggagggccaagcggaaggtgacagtggtgaatgcaaaggtggagattaagaagagaatgatgagccacccaaagtagtagttaccgaagtaaaagaagatgctttttactccaaaaagtgt

SEQ ID NO: 470332 - DNA, 616 bp, Homo sapiens
ttctgtattttctctccttcttttttttttttcttttttgagacggaaaaacatcccaggagaacagcaaggatatgggatctggggagtcggaggtcttggttctggtcccggttctgccatatattagcagtgtgaccttgggcaagtcattcatctggcaaacatttattgagggctttatccatgagaatcatggaaatgaaagcaaagtccctctcaagttgacctatgaaaaggaagaggtaccaggggtccctcctcagatgattgatggtgcatccagctgcaccccaaaaagcccaactgtctacaggatccagggagagaagaggacctggatacctgcacctttcttgagttttacctgccaacaccaattagcttttgtgattaatctgaggtttcctaaccacgtggatttcaacaaaccaccagatcctacctgcgatgggagcaaaaattcctcccagtttctccctaggcatccgggctgacagcttgagaaaaaccaaattggtggttggctggttgggttttttttcaacctaacaacaagcctggcttagagctattcattcttcagctcctgatactgtgtgtctatagataaacc

SEQ ID NO: 470333 - DNA, 480 bp, Homo sapiens
cctcttttttggagagggtagtaaacagaagagcagaaaaccagaacagagatgggaccaacagaggaggaagaaaaaagtaacatggtagtggaaatgatggcaccagcggcccatctggagccactgctgcaaagactctggctgcagggggcaaggtgtgtgtgtgcttgggacagcactgtcacaccagccttctgccacctcagccccctctggactttgggtgctgatgagcatgggagggaggccgaggtggagccgaagatagcccagtgcaggcctgcaggcacccctcagcacaaacatcctcggtactgtggaaggcatgttgatggtggcaggaggaagtcatgctcctggacagaaaagggcaggtccctggtgaaacccctaccttcaagccagggatggcctgaagcctgggggccaggctgccagttctggggtgagtccgtggcccagagtgagaactgatga

SEQ ID NO: 470334 - DNA, 600 bp, Homo sapiens
ttgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaaaataagtgccatgagcactgagaagaatgtacattctgttgatttggggtagagagttctgtagacgtctaccagtaaggtggtcttcaaactctgatatcctttcttctacttggtcaattcagctgttgttacttgtgtatgcttcac

SEQ ID NO: 470335 - DNA, 1242 bp, Homo sapiens
tttctgttgctggctttgctttccgaggagacctgtggtctggttcttggacttccttagccacatggcccccaaacacctgtctccactcccacctcaagtgaagaaaccaagaccacctcctgccctgagaccagagaagacattgacttctgcaggcttactgaagaagggagaagaagagcaagaagcaattgaacacattgataaagtacgaaatgaaatagacagacttaatgaacaagccagagaggtcatcaaagatgatatttggccaaacctattacagtactacttggtttccgatatggatgatgaagaaggagaaggagaagatgatgatgaagatgaagaaggagaaggagaagatgatgatgaagatgaagaaggagaaggagaagatgatgatgaagaagaggagaaaggattagaaggtattgatgaagaaggggatgaggatgaaggtgaagaagaagaagatgatgatgaaggggagggagaggaggatgaaggagaagatgactaacagaacactgatggattccaaccttcttttttaaattattatacttaagttctgggatacatgtgcacaacgtgcaagtttgttacatagtaggtacgtcagtctttattctgagccttttctttcttaattcatgtaaaactctgtcaaggttggctttgggtttttagttcagaagagagtaatactgcatcagactattaggaaggcaggtccacagttttaaattccatcccttgatgaataattttaaagtaatttagtgaatgtccatcatgtagccactagtactccagaccttgtgaatattggcaatgatcaataagaaatggtctttgccctcaaggtactcttgtgcatcactagtgaagtttacagtgcagtgaaataaaacctgtgattggggtgagggcaggtactttgccaaatcctgaccatattaaaatgattagggtgcagtcatttaaggggaagactgaagctcttttccttggagaagacagacataggaagaaatgagagttgacatcttggagaggagatccatcatgacgacctaggctgtgagcctctaggtcctgggagagcttgggcaggatggggatgggctttggtcacagatgttgtacaggaaattccacaatggctgtgaggaagtactgaatgacctcaaagattcttggagacttcaatactttataatactctgtcccgat

SEQ ID NO: 470336 - DNA, 629 bp, Homo sapiens
cgtcttcattcttgaagtcagagccagatgccaaggaagagattttgggaggatcccaaggacccctcagttgcagccatgttgagactgatgcaggaggaccccaactgtcacaagcaacacctgtcaaacacagccacctacttggggacagatcaagaagctgtcacagatggcagaagaaaacctgaggaaagcgggacaaccagtcacaatgacatttatcataatgaatctgctcctacaattaaggcaaactgccctcaaaaacctatttgtaaacaggattggacctggccagaaaaaatgaatgtacttgttaaggaagattgcattgcagaacaggcagaggtgctgcgcaatgattcctatggaatcattattgattggccccctaaggggatgtttagcttgaattgcacctctcagtcggcatgccacagccacaccgtgttcagctggtctgaacaaaatggtcagatggtagaaatggctagaccttcacctgacactgaaaatgctgtcctcaaggccacctgaatgctggctctgtggagtactctatggtactccagactctagtgctccctctgttctacaatcagagcatgcagggctgaaagtatata

SEQ ID NO: 470337 - DNA, 813 bp, Homo sapiens
agccacttccccgacagcttcaacagaaagtctctctgaaggattcgattggcttggcgtgggtccagtgcccagccctggggtattcaccatgccaatggactcccaatactggatcttacctgttaccttcccattctactcagcccttcctcgggcagggcttgctgcggctgctgtcggggatgggggtgtggtgcccagtccaataagagttatattcccgggagaatatggcgcctctgctgagtcatacaagtcgccagggaagtggaggaaagccagcagtcacaggcctcaccccactcacacacagcccacagtccgaaagtctgctctcactactaccgtgctccccatcaacagcaccgagtctatttccagagagctgcatttcagggaacctgcagcagtgacccagttccttcaaagggtctttggattctctcggcttttctggtatgttcctgtggtggttcttggagcaaaagttcacaatggagatgcagattggtgctgtgaaaaatggatcctaagatcaagtaattttgaatagacttgcatactatgaggcctcttttaggaattaatgataaccactaatggtctaataaggaataaggaactgcaattacctttgacttagggctttacaaatgtatttaagcatgaaacactctttgtgacacaactagtaaatgcaaatatttattgcatgcctgctaaatagggatttaaagttaagatatagtagtccttatcctcaaaagctgacaaccaaaagggaattatagtctaataaggaccatttta

SEQ ID NO: 470338 - DNA, 587 bp, Homo sapiens
agccgcgtagccagctcacttggtgggagacactcaagagagcaagatgttcttgtgctgcatccccacatctccaggctctggcttcaggaatggcagaagctcatacctcaccccagatgcctctggccatttggcagaagccccccccccccaggtaccacaggacaggagtcaccagggagccatcaggcctcagatagacaccaaggtcccagatgtacagcaggccccaactgaaccccagactcatgtggacatcaggccacaggtggacacccagtccccaggtggacaatcaggccccaggcacacatcaggccttaagtggacacccaggccccaagttgatatctggctcccaggtgatcaccaagccccaggtagacaccaggccataggtgagcaacaggatgcagtagatcaaaaggccacagctggataccagtccctggtgatcacaaggccccagtgggacatagatctaaggcaggcatcaggccccaggtggacgtacaggcctgaggtggaattcaccctgagggggacattcggccccaggtgcgcatcaggcctcaggtgaataa

SEQ ID NO: 470339 - DNA, 674 bp, Homo sapiens
tgaggtttaagatttaacgactgccctggtagatttcaaactcatgtggggcatgtaacctctttcttttggccaagttacccctttggggatgggaatgcctggccagggcaccactgccctgtaccacccccaggagggagttccttgcatcctggcccttctagctccagccttggttcaaagggctccagatgagctcaggccatggcctcagagggtgcaaactataagccttggtggcttccatgtggtgttaagcctgcaggacagtgccaagtggaaatgtggggttggaggccccacacggggtcctgactgggggggcgggggctgcctagtggagctgtgggaggggggctgctgccctccagatcccagaatgatagagccaccagcagctcatgtcttcagtgtagaaaagctgtgggagcagagctgcccaaggccttgggagcccaccctgtgcatcctgggaatgctctatgttcccaggatgtgggacatggtttcaaaggagattattttggaacttcgagatttaatgactgccttgctgggatttgaacttgtgtggggcctgtagcccctttcttttggccaatttctctcttttgtagtgggaatgtttacccaatgcctgtacccaaattttatcttagaagtaaataact

SEQ ID NO: 470340 - DNA, 530 bp, Homo sapiens
gctgctccatgcatgatgtttcctgcacaagcttcctttagagggaagcttccagaagaatggatccatccagaagagcaaggcgggaggggaaatgagcccattgccagaattttgcgtcttttgaagacatttgccagaattctacttttgaaggctgccccttttgacagtcagttactgaagaagctgtgggacattttcaaagccttttatattaaaaaaagacacaacatactgctgtgggtctgtgtgcagggaccaggaagggcacagctgccacggttctgtgcagaagtgacaaagtgccaaaagcaccctgtccccatgtgtactagtcttcagcaggggcagagctgctggagaaacctaagaagcagcctctttcagcccacgttccttgggccccaacaggatgaccactgctgggctttggtgtgcccctttcagcagctgatgtcatgatcatgtttcctttgactcaagggctgtgactggtcctcaccaaagtttaggtctcctggggaaac

SEQ ID NO: 470341 - DNA, 705 bp, Homo sapiens
ggcagaagccccccccgaccccccccaccaggtaccacaggacaggagtcaccaggtagacatcaggccccagatggagctagcaggccaggcctcaccagtgatcccaccagggccacatctgcacattgtccttttccagccggagcctctggagctcattgagacacaggcacatgctgctgcttcaggtgcagaaatacagctatttccagtgccagctgttgagccagtgccagcaccaggggcagattcccctccagggacagcgctggagctagaggaagctccagagccctccttctgctgccctgggactgcccaggaccagcccagtgaggagctgcctgacttcatggcacctcctgtagagccacgggcctcagccctggagctgaaagtgtggctggagctagaggtggtagagaggggtgaccagcacagctccagccagaagctcccacactgctcccagtcctgggcacaagcagcagccctgctgctgaagagcctgctgctactgctgctgggggtatttgcatgcctgcaggaggtgctggagagcaagaaaaggagcctctttgcggaaagagggatcatgtaggttcatttctcaggcagatcagtcaccttttgccatcaaagttttagcatccatttccaaaatttggtgtacaagttggtattttggtgtttttagctaat

SEQ ID NO: 470342 - DNA, 587 bp, Homo sapiens
agtgggggtcctctggtgccagagtccatggagccatggaacggggagaggcggagatcctcctttgccctagtccaaggcattgtgaggccccgctcctgcacagaggcggtctgttcctctaccgccgtggggaaaaactgcaccatctctggcaagcctaacccagcagctgtccttaaaagattcccagttgaatccccacagggtggactccctctcatcctcacaatctcagctcaggccttattcatcaccgcattcctggcaccaggcctggcccatgagaaatgggtcagattaagagctaaatgtgttttcatggtcacttgttttcttcaggcctcctttctttgtgccaacatctttgggtttctggttaaagttttcagcagctgcatgcggttccatttttcttaccagatgtttgtaatattttacctgtggtttaaagagttaccagcccttcctcgatgacccatggtaagacccatgagcctttgaatataattatagaaaacatttgaagagggatagagaaagacgagatcatggctcctttgataacgtcaaattttcagtgcact

SEQ ID NO: 470343 - DNA, 1249 bp, Homo sapiens
gaaagcaggaatgtgaccatgctggtgagagggcaggcacagctaagctcatggggtgctcccctctagaagtcagggagaagaggagcttcacttaaaagcactgtggtttatgaggattacaaggcacttcaaaagagcgctgatcttccgtcgcagggtttcaccatggcctggggccctaaggagcacttgaagcgtgctgcagtgccgaagcattggatgctcgacaaactaaagggtatatttgcacctcgtccatcgacaggtccccacaagctgagggaatgtcttccgctgatcgtcttcctcaggaatagactcaagtatgcattgaccggagatgacgtaaaggagatatgtatgcaatgcttcattaaaattgatggcaaggttcgagtggctatcacataccctgctggattcacggatgtcatcggcatcaagacagtcgaagaggcaaagtacaacctgtgcaaagtgaggaaggtgactatggggatgaagggaatccaacgcctggtgactcatgatactggaactatccactacccagatcctgtcatcaaggtgaacaatactgtgcagattgatttagggactggcaagataatcaactttatcaaattccacacaggcaatgcgtgtatggtgattggcggagccagcctccgtcatgttggtgtgaccaacagggaaggacatcctggttctttaaatgtggggcatgtgagggatgccaatggcaacagctttgccctgaggctttccaacatttttgtcactggcaatggcagtaaaccttggatttccctgcccagggaaaagggcacccgacttactattgctgaaaagagagagaagaggctggccaccaaacagcagaactggttccaggacctcctgcagataccaaaatccaaaagctaaagtccctgatataaaatggtatagtatttgtgatctatgcacaccctctagtataccttaaatcatccctactgcttacaatacctaatacaatttaaatgctctatagtcattatatttagggaataatgacaaaaggtctatgtgtgttcaatacacatgcaaccatccatttttttctttgttccctgaatattcaacccaaggttggctgaatcctcagatgcagaatccatggatacagaaagccaactgtctgtgtgtgtatacatacatttttggcaacttgcttttaaaactctatcaaacatttttccag

SEQ ID NO: 470344 - DNA, 1493 bp, Homo sapiens
ccatttcttcagattaaaacattttaatgatctatttatgaggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccgcccgcctgcagtgcctttccccgaggcgccatcagcaagcaggacgtgtgcaagacactgtgcgcgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacggtcggggatcggcaagccaatcgaagccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcaggga

SEQ ID NO: 470345 - DNA, 1034 bp, Homo sapiens
gacacaacccccatggagccgccgtagaggccagttggcaatgtctagcaaatttacaagtctgtgtgcccttgatcaatccatttaccctatagggtcagtggtgcccagccgtggctggacatgggaatcaccaaggtcccctgatcccacacccagacattctgatataattggtctgagatatgccctgggaataacgttcatcttgctcatcattgaatgccagttcccggcacagcaccagtcccagacagacacacaacttgttgttgaatggaaggatgcagagcaacagggagtgcagagccaaggaaggtgcaaggtagttgtcattctgaagcaggtgtcttacacgaaatggctatttatagaaaatgatatttatgcaatctgtgctgatctcactgactgtcaaatctctgaaaaggggctcgcaggaacagtggaagatgcagatgtggagcccctgaatgagggagtaccacaaccgtaacccttctgctacaatttcccacttcctattctttacacaaagacactttcaaaatcatatatgtgcagaatcattccagggttcacaattccctccacccagccttccccagtttctgcaattaattcggtatcagttgtcttagttacatcttgaagtcatccaaagtttcatctgagttttatagcgattatattccttctgtttatcctcatgttcccacaacttaagtcacatttaattaaatcaattaatgaccataatcaacacaactgccacgaacagttttgggagcaaacgcggctagttctagataagcacagagcccgggtggttagggaagatgctcaggaggaggcttcagcacactgtgtgcagctgctggcatgtttcacaggagaaatgggacaagtctgttaatctagagactcggacttggaaacacccagcagggaaaattgctgcagcagcaggtagcagttattatgggacctggaccgccccttccaggcccagctgttctctgggaaagcctggc

SEQ ID NO: 470346 - DNA, 2299 bp, Homo sapiens
atccaggcaggggggttaagtactaccccacccctcaactgccctgttagggaaaataaggcagttgcattttcagacacgcaagtgggacccgccgagattaaaaatgcaagaagcagcggttcacaggatgccgaggatgactggacttcctgtccaccccctgggcctggccagagcttctgcaggcacttcaggctcccctgatggtggcggtgatgccgtgggtgctcggggacagtgggaatgcagtgacaccactcgggctagagaaccccccggaggctcttgcattggtcgtcctgggccatgcacagcctggaactggccgctatccaattttgcatctgggaagtgttcatcgattgctagaaaaataatcaggtcgaacgcaggccatttccggtaaagaggctctagggaagcaccttcaggccagatgactcaggactgtgcggagtgtgtgtggtctgggagccggctgcctgccgggcccgggtgctctgcagggaaacagttggctgcctgagggctcattcatggctgtttcccctggaagggcggcgcaggagcccggttctgcagccctgccgacgccgtgtcacagacacagctcttcatggatgcatctggtttcccatggctgcggtaacaagtgaccacaaggttggcggctggaaacagcttaagtatcccatcttacggttctggaggtcagaagtctgagatcggcatcactgggctaaagtcaaggtgtgggcggggctggttgctcctggaacctccaggggagaatctgcctgatgtcttcataagaagaggaaagtttggacacagatgcaccgggaaggtggccatgtgaagaggaagtcggagattggaatggccacagacgggacatcaggcattgccggccaccagaagctgagacatgaagagctggagagtggagagggcacctggaagggtgtcagagtggcgtggctctgcagaacggggcctgtcacagggcaggtgctcaagcccatgtggataagattatgtgaccctggcagggagcatgtcacgcaggctagccagtcacaaggtccctatcccctggccacagccatgggcttggtggactatggagtcagccgccagtgggggcccctggagctcaatcccacaggggactctgggagccactgtggagcacacctcagggtcccccagagaggtgagaaagctgggaccctgccacaagttcccgtgcacagcgaaagtgctcatgccgaggaacacatgtactggcggtaggaggtgagggtgcgaggaccaggatggggcatgatgtcatctgccagagaggtcatgtgacccaagccagccaatcagtgcctttccctgggatttttgtttctcgatttgcagcaaagttgggtggtgccagtcctgctggtcgcagggctggagaggttgagttgatagctgccagagaccatcgtctcttcctcccagagtaacaggagggaatatggccatggctaggtagaaccaggaggagaggggagctgaggagagggcaggagacaatggctgttgtgattgaggtcctgggctgaacctgaagcccatccctccccctggatacttctgtgactgcatttagcccgaaagacagtgtctgccggtcacccagggtccctccatcaaaatctctgtgtcacatctgccttactcatctcttttccctcgtaatgcccggtccaaagaaagtcctccatgaaggtcatcaaaaagaagaaaaaaatgaactcgcatttcacagccctcatcattaatttatttttaaaaatctatttacattttctgcctgtattacttcttgtggggtaacacgagttggataaatttgttgtcggctgttggatgaataatttcctttaatttgccctaaattacctaaacagtaagggggtgcccatcatattctggaatttggtgttcacttttcctacgtgactcatagttttttatagttaactaatactgaccagctaacttgagtggatttctgttacttgcaactccaattgattaagacctcgcccccagagctccccactgtagggtctccactgcccccagagagtggcctgccggtgtaagatgtacaaggtgtcacccttgccccctcctctccaacaaggcagacaagtgggtcccatggagagccttggaagatcatgattggcacctgttaatacagaggtggcaccatttttccaagtcttctggaaaagagttagaaaaatgg

SEQ ID NO: 470347 - DNA, 621 bp, Homo sapiens
ctcatcctccatggagcagcggtttacagctacacacaccctgacctgcagcctggagctgctgaaatcagaaaacgagaccagtgtccacactcgctcctccaggtccccaccagaagattctgtggccataaagagagcaggactccctcagctcaaatctgccgtcttaacagacactgtcttgctgtcactgtgtggacagatctgccagatgcctcagccaagccatcagagtcagcagctgcaggaacaggacaaacagatgcggcttctgatacgagccacggagaaggacacagtgtctcccctgcggtatctgccaaaagttgctacgtgggtgacgcgttttgctgcgctaagaacttggtgtgccccttcttccctggagaatgtggcctcaccccttatcggaccccgtctgcgagctcctgaccctcacgactggacttccatacacatgcaaacctgccagtgggacggaccctttgggagctctggctgtggccggctgcaccctcggcatcttctcccaaagctgggagctccagctgtgacagcactgggaacctaaggaaaaaacatctttgtgtagcaataaactgtgtgatttgtgaaatc

SEQ ID NO: 470348 - DNA, 1167 bp, Homo sapiens
tcgcgagggcgtgaagcatgcacggggcttacaagcagaccataacggaagacagctgctttgtgtctggctgctctgggaattccagggcccgggaagcgaccggagctgacatcccaggaccagctggtggggtgggccgcggggccatctggaagtttccggacctcagggaacacttatgtaactggtttagaggggaggtttggacaatggattcgctgaaggaccaagaacaaactgagcctttcccagggcaggcaggtcctctcccgccaacaggcatcttatctactccccaaggcccctctcagccccagagggtccctgctgtcaaagccagaagagcagacgatgggactgaagctctccaagggcaaggacttcactattactactactacctccactactacggttgctgtcacgactgccattgttatcagtacagttactattattactacgatacttctactgatttggaaggtcagcaccgggatgatgatgagcagaatggtcatgaggatgcccacagtcagggcccagatgttcacatgcttggcggtggaggcataggcctgggccctgttcaggtcgtcaaccatcttcctgtccctagacttcacggagtaggcaaatgctatgaagcccaggcagcaggagttcatgaagagggtgttaaacagggaccagatgacatggtcggtcacagaggtctcgctgtggatgtggatcacgtggacttcatggtgtccagtgaagaccagctgtggctgggttgctgggatggttctcctctgatgaccattatgatcaccactgctgttcctaccattattatcagttccattattactattattaatattactattattactaggattattaccactgatatcggtattactactacaaccaccacttaccactattactgttactgccgctatcgttattactaccgttactattattactactgatgttactactacttctactattgctatctgtttagtcgaggcagaagagcttggccttccatgcatggacagccacctcccatgcctaatgacagctctgggctctgggagcaagaactcaactaaagccctacacttggtggctgagtcccagcctggtgcagttggaggactcaaa

SEQ ID NO: 470349 - DNA, 1166 bp, Homo sapiens
ctgtgtgcacacttgtgtaggctgggtgttggggacccagggctggtgctgaccattggccaaactcaactggaagccacaggcagaagtgtctgggcaccgggctcggggacaggggaggacacttctctgaaggaggcagggattactcggcgtacctgatcctggcttcactggtctcctcttggttcccagcactgtctcttcggtctctcctcctccccttttccctcctactcatgcatcgcggcatggcaggccttcctgctgctactggtgcataccagcctcacctctgtggctgcgtctttgcattcctcgatgtcacctgtcataacctacagaccatatagggactcgtttctttattgtctgtctcccgctgccagaacacgagggccaccaggctggggactttgcctttttcacagccgtttcccggggcccagaacaatgccaggcactgcagttgctcagggagtgattgttaggggctcttctccacggaaacgatgtccagactctcccttgagggataaaaaagctatcaagggaaaaggggaagggtggggagaagaaaaagggtgccatggggaaaatcacggaaatgtaagatttcgtttgagaattgccgctggctacagtcgagtgaaatcaagagcaagaaaagaaagctgccaagaaacttacaaccatggccaaaggggaaacaagtaccttcttcaaatggcagcaggagagacagagaaagcccgggggaaactgccacctttaaaccatcagatctcctgagaactccctcactataacgagaacagcacgggggaaactgcccccatgatccaatcacctcccaccaggttccccccttgacacgtggggatcacagtttgagatgacatttgggtggggtcacagacccaaacaataccaccttaccacagtttctcagactttccttgtttttgatgaccttggtagttttgaggcatactggttgggtattttgtagaatgttctttgttgggctttgtttgatgattttcctcataagactggggttgtgagttttggggtcaaagactttacagaggtaaaatgtccttcttatcacattatatcaagggtgcctccaatgaatggaatgtcattgctgatgttgtcct

SEQ ID NO: 470350 - DNA, 698 bp, Homo sapiens
tcttcccgggagcatggatttgtagacaccttgattttggacttctgccctccagaactatgaaagggtgtgtctgtgcccaggaacacctcaccatcttgtcccaggaacctgcagcccttttcatcctccgactcacctccagattctacttcatgaaagcaccccttaaaatggtcagtccaagccagatcctccttggaagatgggagagcagagaagccaatggcagtgcccgcctctggcagggcagaggtccggccaagggggtggcaccgcagagccaggagggcaatcccagttcacggtcaccaggctcaaccgcaggcaacgggctggttgcattcgtgtggcaggtcctggctcccctgttgtgtagacaggagcgcgcgccctatgaaatgtctgtaattattatccgcacactttacagccgaggaaactgtggcccagagaggaagaacaggaacggatgctgagcaggtcccagtgctgcccctcctctctccactcctccctcctccccttgtgctcttactcctctccctttgccacctccctggggaggtgcttgcataaactgggaaacttaaaatccaataactgctcctctcccacctgcgaccctcatcatccggtctgcccttgaccttcgctttccacttctcagacttccatttgcataataaaatgacttt

SEQ ID NO: 470351 - DNA, 2116 bp, Homo sapiens
tgtgtgtgcggcgtctgcacgctcccgtgtctgcgtgggttttctaggggcactccgctttcctcctacatcaaagatgggatgtgaaggaaatggcacgtctgcgtggtgccagcctgagtggctgtgagtgtgggtgagtgggtgtgggtgtgtgggtgtggtgagtgggtgtgggtgtgggtgagtgggtgtgggtgtgagtggtgtgggagtgggtgagtgggtgtgagtgagtgtatgggtgtgagtgggtgtgggtgagtgggtgtgtgtgggtgtgagtgtgggtgagtgggtgtgggtgtcagtgggggtgtgggtgtggataaatgggcgtgggtgagtggctgtgagtgtgggtgagtgggtgtgggtgagtgggtgtgggtgtggatgaatgggtatgggtgtgggtgagtggatgtgggtgaatgggtatgggtgagtaggtgtgggtgacagtgtgagtggctgtgaatgggtgtgggagtgggtgtgggtgagtggctgtggatgtgggtgagtgggtgtagttcagtgggtgtgagtgggtgtgggtgtgagtgggtaggggtgtgggtgagtgggtgtgagtgggtgtgggtgagtgggcgtgggtgagcgggtgtgggtgtgagtgggtaggggtgtgggtgtgggtgagtgggtgtgggtgagtgggcatgggtgtgagtgggtgtgggctgtgtcttagtgccggagatagacaattaacacataagacagatggtgcgtcagtggacacacctgctccagggaaaaaaggggaaggggagcttcctggaagaggaagaaagtggaaggccccacgggtacaattacactgagcagcagagaaagagcattgaaagtcccacgtcccagacaacccctcagtgccaggcaatctgggacagctggtcaccctacgaggagctgatgtccccagagcagccctccagcaaggaaggtcaagaacagaaacagtggacactggagcacaactccccacacaccaagcagacgggtcctcgaggtgtctgtgagtcacgactcacagctgcagctacctccccgcattcacggcaaaactcaagcctccctccagccagcccagaccctggtccttgctgctgggagctgcaggaaaacctgtcctcgttcagttccaactctaacgagcgcaaagccatcaagaccccgggccgcatgggccagctgcgtcccgtgtccccaaccttaccctcgggcctcagtgctgggcgctcctgccgttgccggccctggtgctgcccgtgcgccgcctgcggtgtcccggagcccacgcatccctgcacctttgagcacagtccttttcctgagcgctccctaaattatcccaactcaagtgtgacttcggggcctgctcttcccaacccccttccccaccctggttccaaaccggagctgcagcagttgctgagcgcggctccttcacgccttcctgccgtgagcgttcctcaccgccgaggcttcctcctcctgctcccaaaccgtgacccggacctctctggatctgcatcctccccctagtaaaatgggagacacaccgctatccagacaactgggattcctggaccagacttttcttttgagaagcttctggagcccattgtgctttagattcatccacccttcctccagacgctgggcatctctctcctctcctctcctgctgaccccaccattcggatggcgcctgtcaccctaactgtctgcacaccccaggttcctccccaccccacccctctgccctcctttttgtctgatttgccaactggtcctcctggttctgccttgtccactgtggtgttttgtttttagggttttaaaactaatttatttagccatgtaaagaaggtgcttgcttctgctttaccttctgccatgattgtaagcttcctgaggcctcccagccatgcttcctattaagcctgcagaaccaactagggtctaagcccgagtcctgaggctctccaccaacctgtgcctctgagaaaggaagcgcgaatcctccaccgcggggcctgcgtatcccttagtttgtatttgatacttgccaaaagagctctgc

SEQ ID NO: 470352 - DNA, 1075 bp, Homo sapiens
tgttcagctctaggcactgaggaatcactagtgtacaaggatggtcatcggagagctcagtgtgctctactgtcccatggatcactccaagctgtcactgacctccaggaaggaagaacgaagggttccatgcggcgtctccatgcaggtcgtgacagtggggcctgtggttgaatggcatccagttgagttcctgatctctcttgggtgggctcctggctctggatggctgcggatcatcaggcagggcagctctgtcactgttctccggaaagcaggttggccaggtcccctcgcctaccaggacccctacccgtcatcaccagggcccgccatggggcatccccagaaacacaggtggagctgcaatcccacatggcagaatgaagcatgggaggccacgctgaccagagcccaggggtcagtttctgggtggtctggccctggatgggttgccctgtgggggcgggagaaggagaagagcaggctttttggagtgcgagaaagcggccgggagtcccctgactgggagaacagtccactgtgtgggaagggggagaggaccataagtgaagaagcctttggcgggcagcagaggtcaaaccccagagcagaggagatgagaggcccggccagttccgaggccttcccagaggaaacctcgcccacagatctgcaggaagttgaactaatgagttggatactctccccatctcaagatctttgctttaatcccttctgcaaagtcccttttgtcagagaaagcttcggagatggacaacgctcagccctgtcctcaaaaatttatggtcaagtgaggacagaggaacatgtacaaccgtcttctacatactactcattcaacactcacgacaaccctgtgagacagagcaggtgtctgtgcccgagcaagctggctgcagagtccgtgttcttcttttattaaatttcaacttttattgtagattaaagggtatatgtgcagatttgtgacacgggtaaattacatgctgctgagccttggggtcccagtgatcccatcacccatgtgataagcatagcacccaacgggtgg

SEQ ID NO: 470353 - DNA, 709 bp, Homo sapiens
aggttgcagtgaactgagatcatgccactgcactccagcctggacttagtcacaggccatacctcaccgcagaggtggctgggaaatgagtctaactgcagctcggtatgtttcattactaacaggacggtgcggggtgttggggaatggtgttggcaggggcctggaaccgtgtctggcacagtgaagactcggagtgaacgaatgcagaatatgtttgggagcaacgccagccggcagttccgggaatgctgcagcccagtggccacagcctggcaccccagccactttctgcagcctcacccatgcccagtatcctcttcccaatctggagtcctcttgccagctagtcctgacactctcccagggaccctggagctggctcattcattttccaaagatcccagggtctccaacacaaacacaggtatccagcacgcaagagtgtgtgtgaggcttcctaggcaggatggagccagtgaccattaaggtccttttagctctaagaatgtgtgaggcaggtcgtgcctaagctggccagggtccggagggacaacggagggtcccctccttgtcacagctggagagagatgatgtatgctctgagccttggggacttgttcatctgcaagggggacatgctgtcatgctgtcctcctcagagatggtctggatggctggcacatacctggcctgctgtcacattcta

SEQ ID NO: 470354 - DNA, 1094 bp, Homo sapiens
gcgtccggtcgcccgggcaacgcgccaccgcgtcgcagccggagtgacgcgtggccgccggcacccggagctcctgggcacacggcattggcaggggccgcttcggcagagtgatgactgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggtacaccttcctgccagcgcagcctgtcctgcccaggctccccacctctaccccactgagaggtatctagagtgggttcatgtgattgttggggctttggaagaaacacaggctgtgaaaagagagaagccggtagtggctcagtccaagtctgaaagcttcaaaaccagggaagccaatggtgcagccttcggtccgtggccgaaggccctagagcccccaggaagctgctggtacaagtccgagggtctaaaggcaaagaacctggagtctgatgcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggagatggaccttgggctgttatgagaaaaaaggagaatttggggggtaaccttcatttccagagatttttacaacacgtcaagctttagatcctggagacaaggtagggttattactaatcctaatatgttaacagtaataaaaattatgtaaactacc

SEQ ID NO: 470355 - DNA, 1389 bp, Homo sapiens
agtggggagtctgctttctcctccgtcctgtgtcttgggctcaggcatgtgcctgctgcccctttgtggccacaagtatgtatcgggcccagggtggcactcgggaccctcccctgttgggcttagagacatggacggcccttgctggctggaagctgcggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgaggtttaacttaattctttcaagctgtacttgtacatatgagaataaccagtgcctcttaagtgcctcctacatgtcgagctgtttatagccgttagctccttgaatttgtatgatagctttgcaaagactaatatattttgggaacagaatatagttcttctcctttaaaagactatatcagtaatacatggacgtggtgaaaagtcaaactccatagcagggcatcaggtgaataggaaaggcctctctgccacccacccaactcttccaatgtggcctctcagcatttcccccgactgttctgagcatgcttaagccaattgtgcgtgtgtgtgtgtgtgtgtgtgtgtgtgagaatatatggtaggcccttcccccatccacaggttctg

SEQ ID NO: 470356 - DNA, 690 bp, Homo sapiens
cctgtctgtaactaagatggggaacccaacggagggaagagaattggtgatgtgtgtggctcgtgcctattcaaatgcttttccagcttcttattgggtcatttggctctatagcagacacatctggggccagcatcactctgatttcagcctccatgtcatggagcctcccactgccagaaagccagtctttccacattctacccagggactcatccaaccatgtgggaaagcctggaatggtggagaaatgccccagcctcctgaccttcatggaaacaaccctggaactctcaggggtcttggaggtcccaaaggaacccagtcttcagtacctacagcagtgaccttgacaatgcccatgaactgggtttctacctccctcccccaccaactctgctgctggcatgaccttctagatatactgcctgtacccaagtccttgtctcaggctcactcttcatttcttccttgtcgatttgtaggagctatttatgtattctgaatagtattcctttgtcagttatattattgtcaatatattctcccattctatgagttttctttttcacttttttttccctgccgtcttttgacaaacagacattctttagtttaatatattctaattgattaaactcttacttctgtatttttaccttattactttaaactttattcttatgcttt

SEQ ID NO: 470357 - DNA, 2686 bp, Homo sapiens
ggacacaatgtcatgctgaggcaggagaaaagggtttagagacagggaaatgtgccctaactgtaaaatagggctggcaacaggacccggcccttgcccttgtgaaaacgaagccagctgatacccaaggcctgccacagaatcagcccccatcctgagcctgcatcagccaagaaggaaaaaggttccacagccaactgcaagtgagtgatgggcgcgcgggggttccttaggctagtctatgtctggctattagaaatgttgcataataataaaaagcttaacgtcctcgcctgcagggaggggctattaaaaaaaaagcagcagcgtgtcccccggcccctaaaggcccacctcgctgcctctctttgtctcccccaagcccagcccccacagcactcttgtccgactaggaggacttgagaggcctggcagtgcccagggcaggtcgggaggagttggagcctgggtaggtgcagcaaggtggtctgcaggggaacagagtcaagtgcaggctgagccagaccctcagggcctgggcactggagggcagggcaggacagaggaggcgggaggcccggctgccctggcaggttggcgagcagacgctggcttcgtagacttcaccagcatagaacacaaggctgcctctgcaggagacctggatccatggaagggatgtggtggagccccctgcaaactcccctgtctaagccccagctccctctctgccccacagccagtgctttgcctacaggatattccatttggagccccaggcccatgtggcccttctgccagagccagggagcccactgcagccctgagggcactcacatggacatgttctggaagcctgtgccattctcccagctgtcgaagacggggattgtgcagggtccgtataccgagctcttgacagagagggaaagcagcaccaggagggctggggcccctgaggggtgggacaaaggctcaggagatgtgggagagggctgaccctcggtccctggggcggtccctggggctgctgacacagaatttcactggtcaagggacaactgagaggagactgttgtgagcccccaacttcagagcaatgagcctggtggtttggaggaagctctcctccaagatgatgttagtgacggctctacgatggaacagtggtggagggaggagtggtcacactgggaaggtggtggtggggagcaaatgggagggaggactggggaactgctgaggaaatagaaataagcaagaaaggggcaaggacggtgatgaaggtaccagtgatggtgctgctggagatagagaaggtggaggaagtgatgatggtggagatggaggtggagtaggtggtgatggtggtgaaggaggtagagaaaatgaaggcggtaatggaggtagaggaggtgatgatggtgctgatggaggtggaggagatggaggtgatgatggtgatagtgcaggtggaggagatgatggtgatgacagaggtggagaagatggaggaggtgacggtgatgatagacgtggaggaggtaatgatgatgatagaggtggaggagatggaggaggtgatggtgatgatggaggtggaggaggtgacgatggtgatgacagaggtggaggagatggaggatgtgatgacgatggtgatagaggtggaggaggtgatgatggtggtgacagaggtggaggagatggaggaggtgatgatggtgatgatgaaggtggaggaggtgatgatggcgatgatagaggtggaggagatggaggaggcgatggtgatgatggaggtagaggagggtgataatggtgatgatagaggtggaggagatggaggcagtgatggtgatgatggaggtggaagaggtgatgatggtggtgatagaggtggaggagatggagcaggtgatgatagtgatgacggaagtggagcaggtgatcatggaggtgatagaggtggaggaggtggtgatggagttgatggaggtggaggaggtggtgatggaggtgatggaggtggaggtggtggtgatggagatgatggaggtggaggtgatgatgatggaggtggaggaggtgatgatggaggtgatggaggtggaggaggtggtggtggaggtgaaggagatgatggtggtggtgaagaaagtggaggaggtggtggaggtggaggaggtgatgatgatggtgatgaaggtggaggaggtggtgatggaggtggaggaggtgatcatggtggtgaagaaggtggtgatgtacgtggaggaggtgatgatggtggtgatgaaggtggaggaggtgatggcgataacggaggtggaggagatggtgatggtggtgatggaggtggaggaggtgatggtgatgatgaaggtggaggaggtgatgatggtggtgatagaggtggaggagatggagcaggtgatgatggtgatgacggaggtggaggaggtgatcacggaggtgatagaggtggaggaggtggtgatggaggtgatgatggtggaggaggtggtgatggaggtgatcccgttgtatgatgtggtgatggaggtgatggagaaggattaggtagagttgtagttgacagaggtttatgtgttgtctattttggtcaggttgacctaaaaaaaataagtataagacgattggcaatcgtatcaaaggggagggc

SEQ ID NO: 470358 - DNA, 682 bp, Homo sapiens
tgagaagtaggagtgggagagacttgtatgctggctcagtccagagcaattccccagggatcctggagtgtatgggggatccaggaggtagaggggatggtaggaaacaagagagctgacccaagcctgctctatctcaaatggcagctgctgcctggacctgcccactgtcaccctgggggaatgcttggaggtcaccctcagcacggcccactgtctatggtgtctgtggatttatctggaattctcactgagtggagttggaaagaggaaaggctttacagtttctctgaaatacgttggtatgtctgtgagggtgttgccaaaggagagcaacagttgactcagtggactggaagaggcagacccaccctcaatctgggtgggcacaatctaatcagctgccagcacggctagaataaaagcaggcagaagaacatggaaagactagactggctttgcctcccagcctacatctttctcccatgctggatgcttcttgccctccaacatcggactccaagttcttcagctttgggactcaggctggcttccttgctccttggcttgcagatggcctgttgtggaatgtcaccttgtgatcatgtcataccatgagggagtgtcttatcatcacacccatttcacagatgagaaaactgaagttcataaaatcgctgtt

SEQ ID NO: 470359 - DNA, 1041 bp, Homo sapiens
attgcccgcggcggcagggctggcagggccggctgcgctgccggctgttccgagtgtggagcccaccaagcccatgcctacctggaactccagctggcccagaagcgccgggtgcagccccggttcccgctcgcgcctctccctccacacctccctgcaagctgagggagccggctctggccttggccagcctagaaaggggctcccacagtgcagtggtgggctgaagggctcctcaagtgctgccaaaatgggagcccaggcagaggaggcgccgagagcaagcgaaggctgtgaggactgccagcacgctgttctgctttcaggggagcccacatcaagacgctggttaatcaccctgccagtcacatcaagatcaaactccatagggcatcttaaaggaacaccaggaaaaagcaaggaggaaataaaggcaactgtgtgtgctccaactttgaaaaatggattttggattgctgagcgggtcatgactgttagtggacacgagggggcagcctcatcccgggctctgagggaagagctacggcttcttttttcctcctgtgcacacactgtcaaagaactgctgtgtgtgagagaaaaaagcacagagctcctcctggaaaggagcggggtggactgttcctttgcaaacattcctcctcttgcccggtgacctcatccaattccatgactttttaataacagctctaaggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaagtaatttggaatttccaatctgagaaagcagcagtgcagatttttagctttttctcctttttttccccccagcatatt

SEQ ID NO: 470360 - DNA, 1977 bp, Homo sapiens
ctcgtcacccccttgaggaggcagatgtgaagcttttggaaatcagaacacatttgctggtatagtttcagaatgtcaagtactgtgtcctactggatcttaaattctacaaggaacagcattgccacattgcaagggggtagacgcttatactccagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatctcgctggaaatccaggcccccctggaagatgaggtgacaaggaacctgtcactccaggttgctttctctggggcaacagcttgcatggcccatgttgatggaattcacttgcacgtggcaaatgctggtgactgccgagccatccttggtgtccaagaggacaatggcatgtggtcttgtctgccccttacacgtgaccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcagcattctggagaggggcttcaataccgaggccctcaacatttaccagttcacacccccacactactacactccaccctacctgactgctgagcctgaggtcacataccacaggctgaggccccaggataagttccttgtgctggcctcagatggcctgtgggacatgctgagcaatgaggacgtggtaaggctggtggtggggcacctggctgaggcagattggcacaagacagacctggcccagagacccgccaacttggggctcatgcagagcctgctgctgcagaggaaagccagcgggctccacgaggctgaccaaaatgcagccacgcggctgatcagacatgccatcgggaacaatgagtatggggagatggaggcagagcggctggcggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctataggaattggcttgggcttgtgtagccccagtcatttgataaagatgttgttaaactgtgtcagcctgagccttcaaagggtaaatttaatcatgattctgagaataaagaacttcgggagcttcttaggtcttgccacaaaatctgcaatttgatattctcctgattcacatctgggggatccttagtcactcagcatcattggcgcccttgggaacttg

SEQ ID NO: 470361 - DNA, 637 bp, Homo sapiens
caaaaagaacacgaaaagatgctcgacatcattagccatcagggaaatgcaaatcaaaccaatattagacactactacttcacacctactaggatggctagaattaaagatcagcccactagaccccaactccagcacctggaaggccaccctagacacaagggcacattctggaggggaaggacttgcagtttgaaggccagtaaacttgggtgtgagtcctgcctttgttctcactgtgtggcctcaggcacggtactgcccctctctgattctaatttcctcatctgtaaggtggggtcctctcggaaccccagaggacggcccagaggcctgcgggagaggccgggtggcctgctggtgttggcgatacccaacctggtaacacccccccgctacactcccatggctgccctgtgggggccaccatcaggcccagaggaagaggcctctttgtacatccagtgtggcccacaccagacccctgatttccgggtccactcctgcttgccttaaggctgccctatcggggcttcttttccccaacctctgtgtctgccaccctcctccatacaacagggcttccatgagcgtcaagtccatgccgacccctgtcgcagcccacaagtcctctcac

SEQ ID NO: 470362 - DNA, 1703 bp, Homo sapiens
gctgcgagatccgccgctctgtgtgtggcaccagcgtcgctgtcctggtggctgccagtcccccggggcctaaggccccaaccccgtccatgtgcccaggatgttctctccgatgctttctgcatcttctccatgtccatgccggcccggcccggcccgccccatcatcaccgtgtcctccttacagttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaagtagacacgcggctgcgggccttggacctcaccctgggcgagaggagccagcagcgggcccgggaaaggaaggcacacaaggcccagagggacgccctgcaggactcactggcacgcctggagggcctcgtccacagccagggcgccaggctggctgctctggaggggcggctgcccgtggcccaccctggcactgcagccctcgggccggccctggaccccgccactcccgagtacggccctcatgttcagtcttcccgcctgtggaactggggtgatcccatcaagagagtgaaggagacgctgcaggggagccatcggcagggccagcgcagagtcatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctgaggccgagccgcacgggggctgaggccagcaagggcagcatgcccccatccacattccgccaccgccctccccgccagcacattctacaaaggccacccccacccgtcctggctttgcacacctgcgccctcacataggggcctcagtgtctgtttttttccctttgtgtccatgtgttctcatcgtttagctccaacttatgtgagaacatgcggtatttgcttttctgttcctgggtcagtttactaagggtaatggcctccagctctatccatgtgcctgcaaaggacacgatctcattcttttttatggctgcatagtattt

SEQ ID NO: 470363 - DNA, 672 bp, Homo sapiens
tctggcagagagcaggtactcaataaaaatatgttgtgtgaatgatatgtctgattccacctcctgcattcttggaaatgcagtgttggcagggtggtcacaggagaataaaaattccagacagcagtttcacatgtctagaggctatgggccgagaagagcctgaaaaactacatgtggaccaagctggctatgaccgacttgaccccacatggtgctggattccacctaggtttctccccggacctcgttatatgctcattaatatcctaaatcacacagccgtcagcgtcagcacagttccaagaataccctatttggtggaagtggtaaattaccagagatgggacgactggctaagagttagccagatgaaggaagggaatcatcttccaggatggtacaacagcagatgtgaagatctggaggcaggacaaaacagaaggctagtgtgactggaagagagcaaatgaaacgagagaaaggacactatagtctgagtcgaaagactcatgactgtcccaaaaggcattagtccatatagagtagtttggcggtcttcagaggcttagggcataggtggttgtcctcctgctagatgattgggagatctccaggtaacctttcctcggagcctctcatggacagaagtgggaattgctcactggggtt

SEQ ID NO: 470364 - DNA, 821 bp, Homo sapiens
aagtgttctacagtcctatgattaagtctcagtcttttagtgagcctgtgtctctgggctttgaacttcataagcgcttctcagttctctctttctctcttagtgcccctggattccgtgaaggccccctcaattctcatgtgttctggattgtggctcaattattgcagagagggatggctctcaacctgaaaaacaaagagaaacgaggtgaagtattagtgtctctaaagataattagacccagagagataagtttaaagtctacctttaaaaaaaagcagacaaagctgaatgcatttccagtcatcaaaagtgttcttcataatctaagcatcggagcagaggagagagcaggagagaaaggagcacgcatatttacgcttcatcaagaaagctgcaagctcaggaacttctgcatggtggaaaggatcagccacttctctctgctctcttgggtgtggatggcatgtcaaaattgctgaaactcattgttcaattcccacctatgagtgagaatatgcggtgtttggttttttgttcttgcgatagtttactgagaatgatgatttccaatttcatccatgtccctacaaaggacatgaactcatcatttatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaagggaaaaaaaagaaacctt

SEQ ID NO: 470365 - DNA, 1998 bp, Homo sapiens
gctcagagctgggagccgagtcaccatcgcggatggtggcgtcccaggcctacaacctgacctctgccctcatgcgcatcctcacgcgctcccgcgtgctcaacgaggagcccctgacactggcgggcgaggagatcgtggcccagggcaagcgctcggacccgcggagcctgctggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcagaaggttccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtggctgggagcccgagccccacacctgccgggcagcaggtgctggacatcgacagctgcctggactcgtccgtgctggacagctccttcctcacgttctcaggcctccacgctgagggtgtccgtgcgtgactggacgggggtgggctgtgtgtgtgacacatcccctggtaccttgctgacccgcgccacctgcagtctggtgtgctggccctccagcgaggga

SEQ ID NO: 470366 - DNA, 537 bp, Homo sapiens
tctgatgtgctgattctacagcatggttatgaatcttaaaaaaccaggtttcgtcttgccgggcatggtggctcatgccctctctcacaccctaaatgtactcacagattttcagaaagacatttctttggagaaggattccatcattaatccccggattacatgcagcaaacaggaaagtgaaaattcagagggcaaaagcaccattttctcttggcccgcagagttttggtgctatcagcagagtaaccaatactgctctgctcttctggaagccacagttaaaggaatacaggacttgactagcaggcaaagagatatcatgaagctcaatgcaaaagagaccagagaaaaaccttcccatgagtcttgggactccataaagaaggcagaagtccccttgaaaaggttcatggcagctttttctgtgttcctcaaggagtcatagggactttacaatttcatgtaacattttcaagtcactgagttactaaacttcatgtaaaaactttttactatttttgaattatctctaaa

SEQ ID NO: 470367 - DNA, 1128 bp, Homo sapiens
caaggacagcttggaggtacacaatggggaatataacaaaatcgacagacctgaaccctgagttcaaaaaggttttgttttggggctctgaagtagtagtcgttcaggccagtaagggcaaaggtgtgatcctggaagaggcaaaagactgtgtgattctttggatgtggaaactacttgatgtttttgaggaactgaaagaaagccggtgtagactgaacttaatgatgattaatcagggattccagagaggagacttattaatagagcatataattgagctatttcgatttatcagaactataatctctgaaggtgggatgaaagaatctgcatttgaacaggtagcatttgagaaccactaccatggactatactgttatggaagaaaaaatgtactttgtgaaactctaaatttccatttaaaatcaaaattgggagaggtaagaaatggcaaaacaggacatgatacttgctaaagcaagaaggtccctccttgcatctgtttttaaaacctctcaggtccatattgctgagtcttcactggccataaacacttccaggaacttcaggctgattgaattgggcaccagattttatcattgggcagcatttgctgtggctatgacttgggcattggagttgctgcttgtataataacttgagtgtgtgtgacatcaaaagtctattttcagcatttgcatattgcatatttaaacatattgggattttcttagtctttgtttatagtttaatctttatattctaagaaaatgtcatttttagctccagtccaaatactgtataatcacagcactctgatgtaaactgcagagctgaacttgagaaaacttaatacattccacttcgtaatgtaataaccaagttgaaatccaactgcactaggaaatgaccaagaatgtaagggcagtttaaagcctaatgatcatatttgctgctgctgatggtgatgatgatgcccattgcctaaaatgactgtagccaaggaaagaaaagcaattgattctgagctcgtaaaaaaaatttttttttaaagaaaattgtttcattcaggaaatgttcttgtgctttcccaaaatgccaaaaataaataaataaataattttc

SEQ ID NO: 470368 - DNA, 581 bp, Homo sapiens
ccgagcacccatttctagtcagcatgtgcttgaatcttggaactggaacccaaagctacaggaaggagccagggattggtgctcttttcctctccttgagaggatgcacagaggctcgacagcaacgtgtctgtaaacctgagagcatgtgtatggcacttcacacccaatctgccaccctgatcatccccaagattgttcttgttatcctggttcctaggatctcaaagaaatgcaatggctgctttggccttgttttgctgttagatgcccttctgcaaaagccagaaaaagtgattactggaagtatgggatccatccggccacagtttgtggatactaagggaggaatgcagtttggaggaaatctgagatggtggatgatggatggcttgttgatgatcggagcagtcgggtaccaggatcatgagacttacaagtccgaggtcaaacagactggccttgtagcacccttgaccctgtggggaccgtaggcaaattatggagctcttttgaacctcagtttctgcattcgttgaaaaaggactgaggttcattcttatagcagggttgcatgaaga

SEQ ID NO: 470369 - DNA, 853 bp, Homo sapiens
ttccaacacttgtttctaggagcatgaccttgagaaccagttttgtggaagacaatttttccacgggcagaggggaggaacagaaggatggtttcgggatgaaactgctccacctcaggtcatcaggcattagtgagattctcataaggagcgtgcaaactggatccttcgcgtgtgcagttcacaataggaaggtaactgtgatggttaatattgagtgtcaacttgattggattgaaggatatgaagtactgttcttgggtgtatctactccaagtttttcagcttttggactcttggacttacaccagtggtttgccaggggctctcgggcctttggccacagactgaaggctgcactacttttgaggtttggggactctgactggcttcctcgcttctcagcttgcagacagtctattgcgggacttcactttgtgatcgtgcaggcgatggtgagtttgaaccagattgatgacagatggagtaatgacaagtggtcaaaatctggatatactctgaaggaaaatgtggcaagatttgtaatagactggatggtcaaggtgagaggaaaacatcagcgtagagtgactccaagatttttggaagatcaggttctgaagtagaggggagatttttttttcaattccctttctctgtaatagcaatgggttcattttattagcaaatggcaaataagtgtagtttaaaaggatcagtaaaatcttggtctttttattatgttctttatgattgtttcttttttgatggcattattcttattttactatttatatcagaatgcttccataaagaatctttggatcacaggttttagaatctttatttaaaa

SEQ ID NO: 470370 - DNA, 741 bp, Homo sapiens
gacctgggcctccaggacaacgatcctgcccctgcctgaacacttcagtcacaccgtcctcttggcactgttctcacgatgatgagttcttgtgcaatctggttgtttaaaaatgtgtggcagttctcccttcattctcttggtccccgctctggccatgtgacagattataagtttcttgagggctccccaaaagccgagtggatgcctccatgcttcctgcactgcctgcggaaacataagccaattaaacctcttttctctataaattacccagtgaagagaaagctcagagacctaagggagatcaacgccctgtgctctgtggccaaaggcccgagagcccctggtaaactactggtagaagctgaggtgggcctggactgctgtggaacagcacttcaatgtggagtgctggcaatagtgctttgttgggacagtggcagcacaatatggtttttgtgtatgggtgcactggtggtggcagggtggccgtatggtgctatcctcacacatgtgttctgggagtaaagcaggtagattaatttttacatctttgtaaatttttcaatactccatttgttattgatatctagtttcataccattgtgatgagaaatagttctagatatgatgtccatcgtcttaaatttttaaagactcattttgggtcttaacatttggtctctgctggagaatgtttcatatgcactaaagaaaaatgaatattctgctgctgtt

SEQ ID NO: 470371 - DNA, 724 bp, Homo sapiens
gacactagtgtgtcatctcgtcgtcagctagtagcagacgactcgtgtcgcagtacagcacatgtcacagcgcatctcatcatctgaccgtcagcagcacatcagctgcatcattacatctgtatcgtcgcagtctcagcatacgcgtcatcatcatcgtgatcgtcagcgctatatcagcgtctcagcgtcatcacagcagcatcgtcgtagtgtgcagcatctcatcatgatcatcatctgcatcagtagcgatctgaatcagcgtcagctatcatcagcatcagtgatcgtcgtcatcagcaacagcatgtgcatcatcatcatcagcatcagcgtcatccagcatcgtcatcatcgtgtgatcagcactatcatcatcatcagcatcgtctgcatctcagctctcatcgacatcgctagtcactatcacatcaatgatcagtcagcatccagtagcatcagcagcagcatcatcagcatcatcatcgtcgtcagcatgagcatcgtaatcatgaatagcgtcatcatcgtgtgcatctacggcgtcgtcatcgtcgtgatgatcgacatcatggtctcgtcatcagctgatcgtcgtcagcagcatgtagtctcatcgacgcgtcacagcagcagctcagcacagcagcacgtaacgacatcacacaggacatcatgagatgtcaagtgacgcaaagagtatcaatacagcagtcatgtc

SEQ ID NO: 470372 - DNA, 609 bp, Homo sapiens
cagtgtattcatacgttgaatcggttcgttccccagtttgtgcgatgaattcaatgatcaagcggtccattcgccatgtgaagggtccaaccgtcccttctgttgtacgattagaagagggacaccgtgaccagcagaactgctcacagaacaaaaccaaccatgatactggcccgtcttccatgtccacaacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctgcaatttcactcctagatgtttacccaagagaagtgaaaacgatcctcaaatactcatacac

SEQ ID NO: 470373 - DNA, 661 bp, Homo sapiens
ctgccgccttctgtcaccacccaaatgcttgtggaaaaaatgaatgaatactactcaggctgtatccaattcaatggttctgaaatgagaaactgtgtcattcccagacttgatatcctgcaatggcccttgctagatacaccctcacatctcatggaagaacctgttgcatatcagactgaaatctatgtgaattatgccttgggcattcctcttttctaccagttgagtaacactattgaaaactacaatgctcatactccattctacactttttgtggtactcaggggacgtttactgtgattaaaggaactgcggagctcgccaaggtcataccagggacgtggcagagcttgggccggtgcccaggtgttttggcttggactccatcctccatcgcctctgagatgaagcccaaagtcaaaatcaagccatatcagacccctaggaaagctgcgccactaacagaagagatgctgccctggccctgcactttaagtgacaaaggaaaacgaatggaaagcaggaacagttgtccaggtgtccacccactccgccaatgccactgacatataggattctgaagagggataaattgcaaagctcaaggttcttagagatctagggattgacggataccagaaagcctttgaggaaaac

SEQ ID NO: 470374 - DNA, 720 bp, Homo sapiens
ctaaatgattgaatgagtaagtgatgacttccatactgggaaaggcagacagttcagcccacgcggcaggaatcccgggatgccaggacagcaaggtggtagaatcatctcttatctggaattccttgcgggaacaatggcaagcctttagcccagtcgggagtggcaatgggagcctcgctggatcaggagcacagtggacaccctgctggatccagaggggtggaagtcagccacgggtctgcgacggcagcaaacaacagtggtggatggagcgtgcccacaatgcctgtccagtgaggagatgctctgtggacaggctggtcagtcatagaaactgctattgggacctgagacatgaaggctctcaaaatctgaacacaggacctaggaactcttggagcaagaagaaattattcagacctgtggacttcacactgtgtaaaaatagcagcacagccctgtttatgaaataagcaattgcttgacactcccttgattaaaacaaaacaaaaaagtaggttgctcttgtagaaacaggtgtgtcctgcccaatggacctcccatttgtttctatccttgtgcagcccagaatggcctttgaaaatatttctcttgctcagctccctcattataaaactggaaaacaattgaatccctgaatggcgaagtgtcgtttcaaagccacaccactaagtctagacagttgttcttgtcatc

SEQ ID NO: 470375 - DNA, 1867 bp, Homo sapiens
aggaacagaccttgcaacaaggattcaagtgtgcggggttgatgtggaaggtgatgggagcactacatgagaataagagaacaggaatgagagtgacagtgagaataggaaatgagataaggcagggaaagcagccaacaaaacggctgttatcaaatcagctgtcaatgtggataactagaactgaatcctgctggatcacggatgtagctggaaaccaacattctcagcaaactaacacaagaacagaaaaccaaataccacatgttctcattcctgagtgggaggtgaacgataagaacacaaggaaacagggagggaaacaccacactgtcgatgggaagacgtttcctggagagaagagtttgctagccatcttgtttttggctgtggcagtccattccttcacctggaaggctcttgaagaactaaagaaaaatttaaaaatatattgtgcacggactagcctgattctcctcaaccaggggtaattttacgattcccctgcttattcttatggacaaaagactgtgaattgctgataaagacagtaggggcttcataatagtttgttcaattgcaggaagttcatttcaactctttcacaaatcatctggggccttcattttattatgtatggagaagatttacccagtggaaagaagcctaaagaaaagaagaacaacatattacttcctctctcgtctccatttccccagaaccataggtgaacccaatgcaatcacaagggtcctgaaaattagagatggaggtcgaaaagagtgcaaaggagatgtaactactcagaaaatggctggagagatccaacttttgtggctttgaaaatgaaggaaggggctgtgagcctctagaaactgggagagggaagaaagtggattctgcccttgggcctccagaaaggaaccaaagccattcagacatccatgggttgctttaagccacaaattttgtcataaatttttacagaagaaatagaaaactaatacaggaggcaaaacatcatttgccagccccctcccctgccaaaaatcaccatgcaggtttgagtgaaatgaatgtcctttaattatattgccataaccaacgctttcctgtgtctgtcatctttttaaacaaaacatgaatttgaaatgtagaaaagattcaggaaggacaattgttaagtaggtattcaagttattctcatttttagaagcagaggttggtgctaagagaggtcaagaatcttttccaagatctgacagccaggaatgggtagaattgggattttaggttaggtatggcacacagcagactctgagtacttagttaggaatctgtgagtttactaagagaaagacagagctgtggtgcctcacccacctctgccatctctcagacaagtgtggataccttagaccaagtacattaagaagaaagtgaagaggcgtcttccacaggactccttttgtcttgccttatgaagaaataaacactggcaaaattatgagtgcacattttccagctatcatgtctccaaaagaagcaataactggtcatagcagaaaaagtttaagagatattcattatagttatactagagatcatttcttaagtgctaatcattggccagatatttcctaggtaatttctagatattatcccatttaatgcatataacatccttgtgggaaaataaagctcagaaaacttagggaatttgtaaatatcacaataataagtgattatgcatccagacctttctgagtccaaagctggtgttcttaatcactaaagtatactgccctgcatgtttgttcagcacagagggtggattcagaagatagcaggggggcgtgtacatgtt

SEQ ID NO: 470376 - DNA, 725 bp, Homo sapiens
cgcagcatcgaacgtttccctctctcacttcagacctgctacctgccctttggaaaaaataggtttccatggtgatggcgggatgggatggctgaagagacggcaggggcggccgtggaattagagccgtgggagctggggctctgagggctgcacacggaagagctggttagacagtggctgaatcgtgggtcacaagcacatgaggttcaggagaggagtcagcaagtgccgggtggttcaacaaggtgtgggaggtccagagcactgggtgcgtctaaggctccaggaagccagtaggagcaggtgccctcagctcaaaacagccactcacggggcttttggggaatttggtggtaaaagccaggattccaggacaggagcctggggcataggtgataggctctattaccatccccattttacagatggagacacagagttagagaagaggaaggatttaaccaggacagtacagcaggcaggaggcaacatcaagattccgtatgtagcccctgcagagttccctctaggtcactttttcctaaacagggaaagacaaagaggctttggatgtcacagggagcctttgcagttttgtgatgaggggagaggcatgatgaaaaggaagtgctaaatcaagtggttatactcagctgaactgataaactattccttgatgttgccataaactctgaatctgactcttttgcagaagtttcttt

SEQ ID NO: 470377 - DNA, 731 bp, Homo sapiens
tctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataat

SEQ ID NO: 470378 - DNA, 708 bp, Homo sapiens
gagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcagcatgaccaaggggactgcagcccctccctgagcacattactggcagtacttttggacaggcacccagagagacatagcacccagatcattgcttcaggtgtaagagtcatgcagagaagtgacacgctgcagctctgagtcagacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatat

SEQ ID NO: 470379 - DNA, 1010 bp, Homo sapiens
ttaccccttcgctcaattttcattcttttctctccttctacgttttgaaggatgcgtttgcttccccttctgccatgagcggctcagaagatgacaggaaaatgtgggaaatttgggaacttcctagagtcttggagggctcagaagacaggaatatgtgggaaagtttggaacttcctagagacttgttgaatggctttggccaaaatgcttatagtgatacggacaacgaagtccaggctgaggtggtctcagataaagataaagaacttgttgggaactggagtaaaggtcactcttgttatgcaaagagactggcagcattctgcccctgccttagagacctgtggaactttgaacttgagagagatgatttagggtacctggtggaagaaatttctaagcagcaaaccattcaagaggaagcagatcataaaaatttggaaagtttgcagactgaagatgcaatagaaaagaaaaccccattttctggggagaaattcaagcttgctgcagaaatttgcataagtaacaaggatccaaatattaatagccaagacgatggggaaaatgtccccaggaagatgtatggcaatgcctggatgtacaggcagaagtctcctgcagaggcagagccgtcatggagaacctctgctagggcagtgtggaaaggagatgtagggttggggcccccacacagagtccccactggggcactgcctagtggagctgtgagaaaaaagccactgtcctccaggccccagaatggtagatccaccaacaacttgcactgcacacttggaaaagctgcagacaatgccagctgtgacagcagccaggaggggggctacaccctgcaaagcctcaggggcagaactgcccaaggccatgggagcccacctcttgcgtcagcgtgacctgtatatgagacatggactcaaaggagatcattttggaacttcaaggtttaaggactcccgtattgaattttagacttacctggggtctgt

SEQ ID NO: 470380 - DNA, 713 bp, Homo sapiens
cttctaaaaacctttgtttctaaaattctgtgattctctaaaaaacaatctcctccggtgggggagattcttaaaccaatatccaggggttgatagacggcagtgacgccccactgggagagaactggagtctgtaggatgactttcaggagaacagcttgtccttacagtccttgtgatgccccttcatcagaatatgttccttcaagggacccaggctttagtggttctcctcagagaggtgtggtcaaaacactggcaagacacacccttctcaggcatctccagaatggccccctgctcctgcccagtgtgcgctggcgagtttatgggaaggtgcctggagaggacactctgggaactggggctctgggaaagagaaagtggaaaaataaggcaacttctggaagcatgggcagcagggaggctaacgatagagcagggcttctcaacttcggctctgctgatattcagggcagggccactccttgctggggggactgcagctgtcgagcagcatccctaatctccattcaggaggtgccagtagcacttctcccaagttgcaccagccaaacgtgtgtccaattattgcccctggttgacaaaatcatccccagttgaaaatcattgttctagtgccaatgcttcccggaggggaaggagtaccctcaagtacagaaaaagcccaatacagaaatttgagagagaga

SEQ ID NO: 470381 - DNA, 740 bp, Homo sapiens
aaatgaatgcagagaaaatatcatccacttcagagacaggtaatgagaaataaatgtgataatctgtgcagagcatgccagacagttgcatacatctgtttcagtctccctcctagttacagatcatgttcccagctaagtagcctagttcttccccaccaggaacagactcctacctcgaaaccccagcctattacctggaaccctgctggattcctcctgcttatcctcttctcagcggggcacatggctcagctgtgggcatcaggattcagccatggcaagacagaggcagggaagtggcttagagaggaacaagagagaagactcccctctgcagtggagatgagaagtacccagctgcccgggccgtctgcaggtcgaggagcagggaagccagtggtggatccatttgagtccccaaacctcaaaaggagagaaactcacagtgcagccttcggtctctggccaaaggcccgagagcccctggcaaaccactggtgtgggaattgaacaatgagatcacatggacacaggaaggggaacatcacactctggggactgctgtggggtggggggaggagggagggatagcattgggagatatacctaatgctagatgatgagttagtgggtgcagcgcaccagcgtgccacatgtatacatatgtaactaacctgcacaatgtgcacttataccctaaaacttaaagtataataataaaagaaaaaaaaaagaaa

SEQ ID NO: 470382 - DNA, 588 bp, Homo sapiens
caggattgcattggtgataaacagcttttgagaggagtcactaaaattatgagtcatatccccattggcatttttcaggagacacaagctgatctgtatggattacagagcaaagggacactttgccatacagtcaacgttctggcttccattgagtttgggcactgggattcaggcaggagatcaggggaggaggaaggagaggaaggtggatttctccaggctccccgctgttgggtcaccttgccaaagctgggacactggactgaaggtcacagctcctctccaggtggttctctctacacattccccacctctccacagtctttaaccaagtctttcacttgccccttcaagcctcggattacatcaagatttctggtatccacagggggtcctggaaccaagccccccacagatactgaggaacaactgtacacacataatttatcacagtctcctagtattgcatgcaccagttcaagtgacatgtgaaaaccttacctccctttaagtccctttaccctcgcacacatataacattacatattacttctatatacattgaaaagcacaacaggcagtgtt

SEQ ID NO: 470383 - DNA, 587 bp, Homo sapiens
agagcacctctctcatgcagttatgtgagaggacagaaagggcatggggagcaaaccatgctgtaagagcctgctggcactggcacacaagggcacatgcaaagaagtgcaccactctcccctcctgcctggcccctgccagtgcctctccaagggccgaatcccagtggaggccagaggagtccaagggctcagcttcctgggacatggagggcacagtagacgagggcaaaaaatagatctgggcacgcagagaaccagcccccacacaactcgagggctcagcatgcaaaagaagaggaggagacactggaggagagaccagaaaggcattgggggacaagccttgtcatgcatggggaagaacattgcagcaggagggaacagcaagggcaagggcaggtggcaagtggaatggcaaggtgactggtgggtctggagcaaagagagggagggggagcactgtggagccttaatgcaaggtcacaagaacgcttaccagggcctgacctgtgaacgtgatctaaatgaggttgtcacagctgctacaggaaacaatagagcagggtgatggagagagaaagccc

SEQ ID NO: 470384 - DNA, 519 bp, Homo sapiens
cagctaacaatgagtacacatggacataaagatggaaataatagacactggggactccaaaagtgggagggtggaactgggatgctggttgaaaaattacctatcgggtacaatgttcactatttgagtaatctgccagacctatctgcagatcagacctgtcttcattcctgggcctgtatgactgtggctgtaattcgccaaaatgacaaacacaaagagaaagaggagaggcacccgatacatattctctggccttttagaaaacatacagttgttcctttggccacgtatatgcgaatctataagaaaggtgatatcgtagacatgaagggaatgggtactcttcaaaagggaatgccccacaatgtaccagtgttaaggggaaaagccacaccaagcaggctttggtttatgtaaaccagctaatcatctcattgcatttcattgctggtatttaatacccagacgttaggctcttttcctccaagtttcctcctccctcccgaccgaccgtca

SEQ ID NO: 470385 - DNA, 1871 bp, Homo sapiens
cccttacccaagggcacaccccaataaaaggctctcccaatctccccagtcagaaagcagccacctcccagtctggtggtcggtttctgggtctgcatggctcagtagaggatgaagtccaaccccccacgctcctccctagaggcctgcaaagctgcaggccagggtctggctcagggtctgagtcaaggcctgcaccaaagcctggtgccattccagggcctggactggggcccaaagctattccaggacctcaggcgggttctggtactgttccgaggcctggtgctatttcagggactggaccaggagctaggtccgtacctgggccaggagctgggtccgtacctgggccaggagctgggtccgtacctgggccaggagctgggtctgtacctggaccaggagctgggtcgggacctggagctgggccaggagctgggtctgtacctgggccgggagctggatcggtacctgggccgggagctggatcggtacctgggccgggagctggatcagtacctggggcaggagctggcgccgcagcagaagactcaagccaaacctacaaaggctgccaggcagaaggttctagtgactggaggaggaggctacctgggcttcagcctgggatcccacctagccaagagcggcacttccgtcattctgcttgaccgccgcagaccccagtgggaactgtccccggaaaccaagttcatccaggctgatgtccgagatgaagaagccctgtaccgtgccttcgaaggggtggactgtgtcttccacgtggcttcctatggaatgtccggggctgagaaggcctggctcccagggtgtagggtcaaagggagggcctgtgggcagcgcatccttcgtgcactgcagacctccccagggccctgcatggtctgtgttcgccggcgggttccaaggctcatctataccagcactgtcaatgttgcatttggagggaagcccatagagcagggcgatgaggactctgtgccatatttcccattggacgagggaaggtgcagccctggggctgggcaggcattgccagcagcattgctgaccctctctggtggttctgtttttcctggcctctggcagcacgtagaccactactcccgaaccaaagccatcgccgaccaattgaccctcatggccaatgggatgcctctcccaggaggaggcactcttcggacgtgtgtgctccggcctccagggatctacggccctgaagagcagaggcacctgccccgtgtggcggtacgtcatccccgccttcaggacccaagtcagagaaggatcctggctgaggtgtacactggtcgggccctcccagcccctggtcgctgcatcagtctcgaggctaagtgtcctgagcctggaaccctcagttctacaagatgttcctgcccccactggtccacaggccccttggagctcctggcaggaacagagctctcagagtgtaccagccaagccaaggcacggggccacatcaagaagaggctgttcatgttccgatttggggaccacaaggcacggatgaactgggtccacgtacacaatctggtgcaggcacacgtgctggcggccgaggccctcaccacggccaagggctacgtggctagtgggcaggcgtactacatcaacgatggggagagcgtcaacctctttgagtggatggccccactgtttgagaagctggggtacagccagccctggatccaggtgcctacttcctgggtttacctgacagtgaggtaagtgggctgctgttatgggacctaggccctgctccccatccctcccttcctacctctccccaccatccccactgctgccactccttacccctttga

SEQ ID NO: 470386 - DNA, 911 bp, Homo sapiens
gggtaggttctccccggaaccaggctgccgcgtcgctatgggctaacgcaggctcgggtgacgttggtatgagtttgcgccgtcggctgctgctctgtctgggcttcctatgccggcatattagtgtgatgacggaggcgccccgccctcaaagtttgcgcatgctcaatatagaaccgctgtctcctgcgttgctcacggagacttggagtcacagtgctctcgcgatcagcagcacaccatatttggcacacaataggagcttaataaaatttgccataagaattaatgctcagaaactctactattacatcctatctgctcaactccctggaaaagagacattctctttttatggttactataaaaggcccagattagtatttcactggcctaacttggatcacatgctcatccctgaaccaatcaatgaggctgaagggatgaaatatgctaattggccaggtctggtcatgtgtccatttttggagccaggggagtggggagggctattttcctgaactgaaatagggtgaactggttccctgaagactaaccaagacgctaatgcaaagaaggacactcctgctgggcagacaaaaatgacagaggctcagagaagtaaaataacttgcccaagggccatagagctttaagcagtagcgtcttttttttttttccaatcttgctttgggcttggacagactagttcagcatctttgatcttcccttcctgcctgacggccccagggtcagaattccaggtgcaattttgtcttgccaaaagctggagtttactctctttggggtttataaataaggaaaaaagttctttggagagcctgaactttgaaatcagagaagtctggatttactgctggctctgccttttctagctgcctcacctgggg

SEQ ID NO: 470387 - DNA, 530 bp, Homo sapiens
gattaaacggatgggtgcacttaaagcatcagaaaggagaaatggctctaggagaagcctgatgacagtggaaatgatgcctgattcaaacagggccgagctgaccacgacccagggagccaagttggagctcagagtctgcccttcccaacgatgtgacagtttctatgggaagttcttgccttccctgagcttcaggtgtctcctctttgaagtgggtttcaagctgtgtcctcccctgtgcttagctcaccaattgttagggagaggctttgaaagccaccaggaccctgtgaccctcggagggatgctgcccttccctcgaggccccttggatgtgggggaagagccaggtgaactcccaggtgttccatttaatcactgcagcgccatctgtgcctggtctggtggtcacaggcctggccatggacaaggacaataggcagtaatgggtgctcagaggacacaggttccctggaggaagggacatctgagctgttttccaagtggatgagggggagaagcatcct

SEQ ID NO: 470388 - DNA, 592 bp, Homo sapiens
gtttttggatccatactgtatgagctgtaatactcactgcgaaggtctgcagcttcactcccgaagccagcgaggccatgaacccacggagaggaacgaagaactccggactcggcgccttgagacctgtgacaccacgaaggtcttcagcttcacttctgagcctgcgagaccgcgaacccaccagaaggaagaaactccgaacacatccgaccatcagaaggaacaaattccggacacgccacctttaagaactgtaacactcaccgcgagggtctgtggcttcattcttgaagtcagtgagaccaagaacccaccaattccggacacaaaaggccccagaagagtctacacatcaaattgggcatccccttctgggcacctcaagaagggccttggcctctggcgaccacttccccttgttggttgctgtctgctcctcctcatgcctgggggttaatggccaagtgtgacccagctgcttctagctttggttctctcaggaagggcagagaaaggaaaaataaaaaaagtattattttaatgggcagcccccagaactggaagaggttcagaggactccctatttcct

SEQ ID NO: 470389 - DNA, 1246 bp, Homo sapiens
ttgtcattgtttgcctatttaaagagagggcagtgtaatgataagattccttaggtgacttcacagggtagtgatgacctcacaagcttccaaagtttccatggcagcgtgactacacacctgcgtcctagagaagcctccctaccatttctctgtaagataccaatctgtttggttggctgagagagaatgactgaccggatcctctatattgtctctaacatgtcctctgtcccctgggagggcagcgcagcagctgcagtgcctgccacttctcctcccacacctgggcactaccatgttctctaccgagggtgtggagaaactcaggtaggctggcatggggagacgtactgcctggttggtggctaccgggtccatggggatgctcctttggccaccccaacaaaggctgaagcagagaagccagcccccaggcgtgctcccaagagacgtcaagctacgatagagtcagataaagacctgggttgctctagccccaaaattcggcgcttggagcatcgtggcaggagactgaccccacagaagcttgctggctgagccatttgggagaaaggacaaatgtttagctgtctaagacagctaatgcctcttctgcggtgacctcccctgcccaccactgcagatagagcctgagtcattctgcctatgccttcctcatccagaagcccccttccatgctaactacccatggccaaggagcctcagaaactgtggtttaaaatgagaggttgctttgaacatcccaaggctgaagacggcctggaagaaaacctgatgttcctctactcatctctccagagtccctttttgggcagaagatagaaatagtctgcactctgctagccgaggagtcaagtgcagagagggagtgcagcatagcccagtaagggcttgatctaccagatgggtctttgctttgagtcactgccagcaactaccagcacaaaccaggagggccaggacttgctgaaactggaagcagcagcccatggctagtcacagcaggagaaagcctcctgcttggcatctcaggaggtagaagaaagagacctggggagacctgccacctacagcaagaacaataaggaggaagttgagcaacatccccctgaagctcacatgttactttatttcctgcccattatggccccagtgaggtccctactgctcaatttaaaaaaaaattaaaaaaattatttttccataacagtatttgacttga

SEQ ID NO: 470390 - DNA, 1630 bp, Homo sapiens
gaggagaaaaccttgatttctgcctcaggaccctgggcctcagttttcctatctgagaagaagggcgaagagctgtgcccccgaccacacccgtcggtgatggggcaaaccgagggcaagcaggtttggttcctgcccagcaaaggtgagggaggacggaggagactctcccaccgcattcagaactttattcctttatttttgtctcaatcttgtcatagaggagcgcttcacttttggtcatcccttgggccaccagggccttcccgtctccgtcttcccatcgcaggtcctggcctccttcacaccactccaggataccgcagcatctcccccagcgcagcagacggagggcgcttcacatgcccccggacctaagcccactctccccttcaagatctggactccacttttttgcaacactcttaacttctttggaagctgggaagcctcctactcccttgggcctctccaccctgccctcagctaactcaagtggtcaagcttgtccgcatgggctccgagggctcccagggaccgcaacgcttcagccttctaggccacactgcagggtacacccagtggtcgctgccctggtcactgccaccgccttggcctgttccttgccctgtggcaccaccagtggggccctcctccccttgcccataaaattcctgaaagaagagagcctgcccggtcaggcctggtggatggacaaggccttcatgttagccaggctcccacagcagtagcagccacagggttggggtggggggaactgtgcaggtgcaggagtccaggctcagataacaaaggtggggagtccaaggccagagtggaggcagaggccttggctgtgccccagtgccaggagataaggtttgtgaggagctgggctgtgcctggcacagggtggggagctgtgggtgcagctgctattctcagtccagggcactcccctggggctttgacagtgaagactggagccaggcactgaatgggggggcagcctgaggaatctggggtggaggctcagcgaggaggtgtttggccacaggccagagggtcaggctggggatccctgaacctggagtacagagtcctgccagcaacccaggtggagccagtgctacctgggccctgtatggagggctgcatgcccctacagagccatggaaagtggccagacagatggaccctcagcccccaggcctccgctggcccacagcggagggagggtgtcctggggttccagtgtgtcagggaaaggagcagattgaatgagccactgcccctggccttcttgatggccaccaagcacttccagcatcaaacctgggtgaagctggggcctcactggggtaccgctcagggctgtggtcaatgtcagacacaggacagtgggggaaggaagaaggcccactcctggtactacaagtggatctgtgccccaagaggggccactatggatggtcagaggaattctcagcacctggtactgcctgaacctggtgtcacccagcagctggcccatcacaggtgagggactgagcgtggaggggtggtgggcaccactcatgctgagcacagtgggggtcctgggacagccctgggcctgcagcctgccctc

SEQ ID NO: 470391 - DNA, 1056 bp, Homo sapiens
ggaagagaaaatcagaagtcaatgcagatggtgttggcaaaagcctctctaaggaaggtgcatttaaatcaagaccagaagatggagagggatcagctgtttcacaagagcacagtggcccctagagatgttcacgtcccgatcaccagaacctgtgaacatgtaacctcacatggcagtaaagactttctggatgtgattaaactaagaatcatgagaccactttggctgctgtgtgatgatgggggcggtggggaggctgtggtgaggacccgtaagagcagaagcgtagagttcagtctggaggctgtgaaaataatccaggaaggcaacacaatggcctctatcaaggcggtagggatacagggcagtgggagagagaatgaatgcaagcagcggaaatgccagatgcttataaaaccatcagatctagtgagactcactcattatgacaagaacagcatgggggaaactgcccccatgattcaattccttccacctggtcctgcccttgacacgtggggattatggaaattacaattcaaggtgggaattgaacaataagaacacatggacacagggtggggaacatcacacattggggcctgccagggggtggggggagcggggagggatagcattaggagatatacctaatgtaaatgacgagttaacgggtacagcacaccaacatggcacatgtatacatatgtaacaaacctgcacattgtgcacatgtaccctagaacttaaagtaaaataaataaataaataggaaaaaaaagaaaaaaaaagaaggcaaagaaaaaaataaaaatataataaaataaaataaagttctttaaacaccatgaaacagaccttgacaagacatgcatatccccttatgcctaccccaagatttaggatgtcacactgtacctgtcctttgcggtaatttgtcttaaggacacaggtacaagttatcctgttttatatgcacttaaatgaattttcacttcaaattcaagttgcagtatatgtcacatgccgccttcccttcaaagtaactaatgt

SEQ ID NO: 470392 - DNA, 1026 bp, Homo sapiens
ctgcctcttgctgacagctcctgcagcagacgactgctacctcatgatccaagatggcagctcacatgaagccatcacatctgcattccagccagcagtagggaggaaggatcaaagaagctctccatgccatcttggtttctattcattggtagctccatggccttgggcccttcatggagctcagaccaactggatcatctctgaagttttccccacagtgaggaaggatgaagataagacacaaagaatggaagacgtagaggcagagaagtttgctggtggagcggtggaagctttaagctcttcctactatgtgagtgatgaatgtttcctttcagctctaaaccctgatggcctttcaaatgctgagtactcctgtacccctttcatgatccatcctctgcctccctccccaccaaatactcactcaaaaaagatgcagctttttaaaaccagctatatttattaatagccattaatgcatgtggtcatttaaacattaatcattcaataaagcaatacatcacaacataaaatagaaataacacaaaaaacagtgctttccctttatttaactagttggcttaactaataaggtgattctaatttcataaaagtagtaatatcaaatatgtatgcatgtgggccttaataggcaccagacactgttctaagcagttgatagttataaactcacttaatcttcacaacaatctccatgaagtagagtttcctcgtcatttaacagagaagggagtggagaaaggaagagaataaataacttgcccaaggtcacacagccaggctcatgcagttatttccctaatcaacttatcccataaatcacatgacctatttcagagaccaaataattacaaataaaagattccccccaaaccatagattcttgttggcaatgagcatcagttgagctcagattcggtaaaaagtaaaaatgaaaaaagatccatagctatagatttctgttagccttttttctatggtttttggtaaccactgtcc

SEQ ID NO: 470393 - DNA, 528 bp, Homo sapiens
ctgaggcgcactaattgtgagcgaagtaggatcatggataaacatcagcaggatctgcacctgagctgtctgccatggcgaccatctgtggctattgcgcacttgaaatatggcaagtttgcgtaagtacactcgatgatgtttgcacaatgacaaaatcacctgacattgcatttatcagagtgacgagggcaaaccctgttgtaaactgtggatgcgagggatctaggttgcacactccttatgaggatccaatgcctgataatctgaggtgcagtttcacccaagaatcctctcccaaccctgccccagtccatggaaaaattgtcttccatgaaactggtccttggtgccaaaaagatgagaatgtctacagaggatgtagggaaagggtggaggaagaaatagagttagcaaataatgaagagagaagtcctgtaggtaaggaaggagggaatggaattttctcttacctctgaagttagctcattcatccaacaaatacttcttagggagtatattagggag

SEQ ID NO: 470394 - DNA, 837 bp, Homo sapiens
ctgagtccagacttggaccgctcactgcgtaacagccaggcggaggaggatgttgaaggcagtcgctctaaaggccaggaaaggagaggatgtttctgcccattgccattggtctatcagcacccattgtcccctggagcaggacccgagggaaggactcagtccagagctgctcacactttgccaaccttgccccaaccatctccagctgcctcataagcctccttctcctaatagagaccaaggggcccctgcaacagagataccccaacttcctcctctctgcaaccagattcttgagcatcttcctgctctccttccagacctcagtgagagaggaaagcaaatctcagtcctcattcctggggcaatgtaccctgtgcttatgctggtttctgtgtctctgtgcgttcccaggacactcccaggagggaaagtcgtttcatctgccccttccctggcactccacaacgtggaggatctaaggctgggggctacctaaccatctgctgtggctcctggggagagagggaagagagtcagcaatacctgggagtctgtaaataacctgctctttgcatgtttaacaaaactcatccataaattgtctgagcatacaatattttggggaagtggggttttgtttgtttacaacttttactatttctttcagggctacttctccacttctcttcctccattattatcacaggtagtgtaatttttaaaatcagcagtgacttctgaaagccatctcacctccactcaccaattctctcgggctgcagcattgccttgagctaatgtggcttcatttctaatgtttgctatcagtac

SEQ ID NO: 470395 - DNA, 808 bp, Homo sapiens
tttctgcaggctgtatgggaagcatagcagcatctgcttctggggaacctcaggaagcttccaattatggcagaaggcaaagggggagcaggcatgtcacctgtcaaaggcaggagcaagagaaaaagaattgggggagaagtgccacacacttttgctcagccagatcttgcgagaacacactcactatcataaggacatcaccagcagatggtgctaaaccattcatgagaaatccaccccatgatccactcacctcccaccaggccccaactccaatactgggagttacatttcaacatgagatttggaactcggtaacttgtgactgtagggctgaggtcccagttaccttgctggctgtgagctggagtcacccttatctcacagatggcattccctggtccttacacatgccccctctatataccaagccagcaatggtacctccaatctttctcatccttcaaatctctctgatttacccttctgctgccagcttgagaaaactctcagctcttaacgggctgatgtgatcacatcaggcccatgaatgaccttccttttgatttactcaaagtcaactgaaattttaacttatggtacaaattgcacctggaattatattaaactactcttactcagcatacatgaaaaatgcttaagccttttgtctttttatttcccttcattttgttactagttcgttctatgtgtttattatattatttcaggggttggcaaactatggcttatggaccaaatctgggctcgctgcctgtttttgttaaaaaaaaaaacttttatc

SEQ ID NO: 470396 - DNA, 707 bp, Homo sapiens
ctcgtagcctgccaggctgaaaaaaatattaacgagaaggagcattttgcaacaacgatggttagagctgaaataacatatgcagataaaaagcaaatgcagggtggtccagtggtcaagaataaagatgagtctgaagcaatacttattctagaacacaagctgatccaaactagccaagcactgaatttaaggtccccaatggggctgaactccagtcgcgacggtggttatcttcccattaatacaacctatgttggtttcctgccctcctctatgtcacttttacatgccttcactaaggtttcaactctcagaggcagtgacttgagctttgccgagcttgttcagccctttactaacctcccttctgctctgattattctaggcagctcattcccatcagtccccctcctcacagagctcctcagcgataacacaaacccagtttgcatctgtcaggctctgcctgaaaagctctaaattcatacaaatgtcacttctcagcctgtaaaagccaaagaaaggttctttcattcaacagatgggccacaggcaaatagtgaaagaaggggtcctgatgttttcctttttcagtaagataaccaataaacagtttaaaaaggcaaccacttacatagtcttcataccctatattaatattttatgtttctacaattcaattaaataaattattagtaaacttc

SEQ ID NO: 470397 - DNA, 908 bp, Homo sapiens
cactcgctggattcaccagcaggattcactcgctgtttgtgtccttggaacctgctgcactagaagggccgaggggctcccagacctctggtcccggcactccagtggattttgccagccgaagcatttcatagggcggtgttagtggaatccatccttgttcatacatgccagcagcagcaccggcggcagtacagcagggtgcacactcatcagctacggcacagtgccagtgggtggcagggtactggcctcggtgcaggtgtttgcagcagcagaggcagcacagctccggggggcagtgggtctctactggttactgtgggcatggctgtgctggtggtagtgtcagcttcagaatttcagttagtcactgtggctgtggctgttttggagagaataggctttaatggattaggaatggcactgataagccaggaagaccaggttgcaactgatggttgcttgagccaaggtggtaatgtagtagtgttcattaataaacagttgttcaacccaaatgcccataatgatggactggataaagaaaatgtggctcatatacatcatggaatactgtgcagccataaaaagaaagagttcgtgtcctctgcggggacatggatgaagctggaaaccatcattctcagcgaactgacacaggaacagaaaaccaaacaccaatattgcgagagtaagaaggtgtttattttctctatgaaagttgcaagtgaaaatggaataaaaatacattgaaaaatattctcatcagacatatggaggtttcttcattattaataaagtatctatctaagtatttgctttcaaaggtattataaacaccaatttttaacatgtttaagttacatttggaaggataaattaaacatctaatatgccttgaatgt

SEQ ID NO: 470398 - DNA, 3708 bp, Homo sapiens
ccagcactttgggaggtggaggtggcggatcatgaggtctacagatcgggaccaccctcgccaacatgagttggaggagtagttcatccggaagcatccgccaagtgatcaattttttggggacggtaggaatagaacaggtccgaggagttacttttctggaaaatcaggaagtactcattgcctctcgttcttcaactgaagtcaggattaaccaagacaacatgattacatacttggcaaagagattcacacctcacatcctgtacagacctcacatcttgccttactctcagaaagagaatgaggatgctgttggaccagagggaagaaaagaaccagttcatgctgatgctgccacatttacatcccagaagaggaaggctaaggaaaccaaaatttgtgtgccagggaagttgcaaaggtttatgaattccccagccatcaacctctcatctctgactattggcttcatctactccattcctttctcctgtatcttgcctgcctctaacatctgaaatattgaggtgacctactttcactgtataagtagaggcaccggagctgtgggctagagcatttgttgaaaagactgttctttccctcatttgtgttcttggcacctttgtcagaaaacaattgactgtgtaaaaacatggaaccaactcaaatgaccatcaatcaacaagtggataaagaaactgtggtgtgtgtgtgtgtgtgtgtgtatacatacatacatatatatatatatgtatatatatatatatatatatatatatatatatatatatataggctttggggactcagggggaaagggtgggaagggtgggaagggggtgagggataaaagaccacaaattgggttcagtgtatactacttgggtgataggtggaccaaaatctcacaaatcatcacaaaagaacttactcatgtaaccaaatgccacctgttcctcaataacctacagaaataaaaaataaaaaaatcggttggctgtaaatttgtgaatttatttctgggctctctattctgtttcactgatctatgtgtctgtttttatcctagtactatgatgggtttttttaaaaatccatgctgtttgattactataactttgtagtatattttgaagtcaggtagtgcgatgcctccagttttgttccttttgctcaagcttggtttggctattcaggatcttttgtagttccatacaaattttagaattgttttttctatctctgtgaaaaatatcactgatattttgatagagattgcactgaatctgcagatcactttgtgtagtatagacatttcaacaacattaattattccaatccatgcacatagggcatctttccatttatttgtgccttccttaatttgtttcatcaatgttttatattgttcagcatataacaggccttttttctctttggttaaatttatccctaagtatgacattttattttttgtagctatcataaatggtattgttttcttgatttcttttttgtacagtttattgttagtatatggaagtgctatttatttttgtatgttggttttatatcctgcaactttactatatttattagttacatcagttttttttttttttggtggcgtctttaaaggtttctatgtataaggtcatcttgtccacaaacaaggacagtttaaattcttcttaaatttaggtgtcatttatttatttcccttgcctaattgctatggctaggacttaaaggactatgctgattagaagtagtgacagtggccatccttgttttgttcctgatgttggaagaatatctttcagcttttaaccattgatgtgaaaattttcaccagtgatgttagctatgggttgtcatatatggccttttttgtcttgaggtacatttattctctacctaatatgttgaggactttctatcatgaaaggatgttgaattttgtaaagtactttttctgcatctgttaagacaatcctatgggttttgtcctttgttttgttaacaagctcagtaattttaaagtgcataatttattggcttgtagcacattcacagtggtgcacaaccaacatcactatctcattccaaaactttaaaaatcccaccccaaaagccagtcattcattcatctttagccgccttagcgtagtgatgcatgagcattcagtgtttattaggtgcctcgaggaggaacaacatccgttttcaataaaacaagtgtccagcattgagagcagacgtctggtaatcattctctgtgttgcagtgtttctaagacttcaggtgtccctttcagcactcggagacttgccaaatgccactctttttaaaaaatccctattggcctggataatttaaaactgagttggcatcgtggtaaaagacaatgtgattcactgttacagtctaatctcacccttctaactgattctttcactaaattccaccatgtagcccattgttcatctacatgaaccatcaacattccttagcttcatagctttattcaaaacgttctctcttcctagaacacccttccctgggacattctactcatttttcaagcccatcgtcagggtcacttcctctatgaaatcttccctaatgctgatctcttcttcccacagtccattgtgtcattcttatgcctttgtaacctcatagcttagctcccatgtatgagtgggaacatatgatatttggttttccattgctgagttacttcacttagaataatccagttccatccagattgctgtgaatgccattaactcattccttttatgtctgcatactattcatatatatatatatatatatatatatatatatatatatatatatgtatatatatcagtttctttttgttttattttaagttctgggatacatatgcaggatgtgcaggagagaatcaaatacatcaaatcagcttattgcttgaaactggcaaggtgctagctacatttcacttatgtttttttctctttttttttttttctcctcaaggctaacagctgcttaaaaacctctttgaaaccctaaaagccacttgaggaggacaattaacaaaccactcattttggtgagggccagagcacatataattcaatttgttgagttgcttatgaacagtggttgcaatgtcctggtaaccaaacatcctttgttattaagacatggttcccttctctaattgttagggagtacaattgcattctttttgctgtgtgtactgcagtctgacataattaaggctagagcaaatgagattcttctttagatattaaaagtgcctgtgttgtaaataataatgtcaccctctctttcatagaaagcactttcattaagagctgcattttaatatcaatgcgtttgcatgaattcatttgggtcatggtggggggacattgctgatgatttttaatcttccatgagctcaccaggtgttccaattaggtcatttataatgcctacccctccctgccaggagccctgaaataaatactttctcactcacattttccatacaggtgtttgttcccagtaagtacccacccatggtagtaactgtatttactgacttgatatgctcagaggaaattgacttttttctttgcagagtaaaatgaacccagaggattcttctctctttttaatatttttcaaaggcttgggaaa

SEQ ID NO: 470399 - DNA, 479 bp, Homo sapiens
tttcacaggtctcctataccaaggaggctgctgggaaccccacaatggtccttggagactacctagtttctctccttcatgttacattgggaggaattgaggcccagggaagggaagggaatttcccaaagccacacagggagttgatgttagatctggccttaaacccaggacccttgacccttggaatagtgctctcaggctacaataagacaggaaggaggcctggagaaagtgacttctggaatcaacccaaaggacttgagtggtttctggaggctgcaggaggcaggatgtccaaagattcctccttaaggagcaactgcaggctcccatccactctgtgcatgtggctgttgctgcctccaggaacggaactcagagttgagtcagatgaaattgcaaaaaggctgggtggttctggactcagagaggctcccagctctgttgaatctggctcaatctcttcctagatctgc

SEQ ID NO: 470400 - DNA, 586 bp, Homo sapiens
aaactgctgtgcaaactgatctatgcacatggggctgccgaatctttactgggctgcttcccatagaggtagttcaagaattataagttcactatctcaaatgaagcctttacctatcctcatgggattctcagaaactgccagctgtgttcaccatctatctcagacctttgttttcacaaagatagaatccaccatcaccttatctgtgccattcagtatagcacttcttcctgtgttacttagaacagccacttctcttcttcatgacttcatccttttcgtggggaaggaacagatgtttgctgtgcaatcccctgttaaaaagtcccctggtaacaggtccttgcagataagccaaagggctccagtgctccaaaatggaatctatcagctttcactgcactactatcaacagccccatggggttcctgggcgagtggacttagatgacagcttaaatctcatgcaatccacaacaacaaaaaactattaactccctttcaatattaagtacttgcctgaaataactagttagccaagaacttggtaacatgtttaccttgagctaaacgtaagatccatc

SEQ ID NO: 470401 - DNA, 633 bp, Homo sapiens
tatcaatttacactgaaatcaatttcctaaactcaaattcatctttatctgtaggcttaaggttattatgaccagtgctgttatgaatatccatccatgtcacaaattcccaagatccattggaagtgtggcccagagcgctaatgattgggtccactgtgagttggggccatggttatttgatccaggagacctgtcactcactatcaagtctaaattcctcactgatgacaaggttctctattctgttccattggtctatgtgcatatttctataccagtaccatgctgtttaggtgactatggccttatggtgtattttgaaatcagtgtcaaaaggattgatacgcattcgtctttgaatgtctggcaggattctgctgtgaatccatctggtcccggagtttttttgttggtaatttttaaattaccatttcaatctcactgtttgttattggtctgttcaggatagaatagatgttgaaccattcagatgcatttgtgaacataatatgattcaaaagaattgtaagtcgatccacatggccaaaataaagagtgtgatggggagaaagcaaggaatattgctggaagggatagtgggagtcagaccctgcagggtcttttatttgt

SEQ ID NO: 470402 - DNA, 600 bp, Homo sapiens
agactgacactgcccgatcgcctcggaagccccctagaccatcacggacatcgagcttcagggcctgtttcccttgcctccataactgttgtgggtattgatggccaggcttctaaacctcttaaaactccccaactctgatacctctactccctccttggtgaccaatcatgcaccccttaccatctcattaaaatctaatcacccttaccccactcaacgccaatatcccatcccacagcacactttaaaaagattaaagcctgttattacttgcctgctacagcatggccttttaaagcctataaactctccttacaattcccccattttacctgtcctaaaaccagacaagccttacaagttagttcagtatctgtgccttatcaaccaaattgttttgcctatccaccccgtggtgccaaacccgtatactctcctatcatcaatacctgcctctacaacccattattctgttctagatctcaaacatgctttctttactattcctttgcacccttaatcccagcctctcttcgctttcacttggactgaccctgacacccatcaagctcagcaaattacctgggctgtactgcc

SEQ ID NO: 470403 - DNA, 594 bp, Homo sapiens
cctcctctgcagaaggggatgtctccatgaagaactttgagaggtttttgagcagcctgccatctgggctacctggagcaggatttactaccccatttctagccttcaaacaagcaaacgagcacaatcttgcttggctgctctggcctctgggtagaggttgttcagacacagacatgcccgacctgaatcagggctggcagtctctgtacaactgtctcctctcactgtgtttgacttcctgttgcaaaacaaagcatctggtaaattcaaccacactcagagttttggcactaattgcagcatttcttaaatgcatggtccaggaacccccggcattggaatcacctgggttccttcttaataacatcaattcttgggcctttcagacctcccaaaacaagatgaggctgggaagtctgcatctggaacaagagctccaggtcattcttgtctacgctaatgttagacaatcgctgctccagggcaaagatctctggtgatggtgatgatttccataatcttgtcaccttaattgctgctgtcacttgcaacgttccttttcatttatgattggaagttgtttctcagatt

SEQ ID NO: 470404 - DNA, 1015 bp, Homo sapiens
gctctcctttgaagtcaagttgcttctctgccgatccagccaccacctctgaagtcaagttgtctctcttcactgtccagctgcttctctctctctctttctttctctctctctctttctttctctctctctctttctctgccaactgagtctggggtctttataggcaaaagatgggggtggggcaggccataggttacatgatcatccctgaaccaatgactgtggacaggcaaatcttcattgcctctaacacgcagaactcctcatcacctccttacagccagactggagcttccaaggacattcaagttggcaaagactggagacagaaggaatcaatcatcacatggaagatgtacattggttccgtccggaaagatggaacaactggaagtggggagcttcccggtctgattaagaagcaagagatgttctgtgttcggcgctctgaagaatatagaggaaagagcttctgttttgttcataagacatatttgactttaaatcccagcccttctgtttcacagctgtgtaactttggcaaagtcatgcagcctctctatgcttccaagtttgatggtgcctacctcaaagcactattgtgaagaagagcaaggatgagccagttgcctggaaactgaatgcttgcttaaagaggcaaaaaggaagctcatactacatgacagtttggttgtgtcaaatattggtgctttgcaaattattctgttgatgctaaatcacagaagaatctaccaatcacatcacctaggagggaaagtgaaatggactaaacaaagcagaaagcccatttctggacagtggtgtaacaaggtgtccatgagagaaacaaacatcatgggacagctatgaacgcccagagaggacaagtcacttcctgtattagtccattttcacactgccaataaagacatacctgagactgggtaatttataaaagaaagaggtttaatggactcacagttccacatggctgcggaggactcacaatcac

SEQ ID NO: 470405 - DNA, 1196 bp, Homo sapiens
aggagagatggcggcaaaggtgcctcctgggtcacctaacgtgtctgttacttgtcagatgatggttgctaagtgacctgaagacgtcacgctgcctgcttccctagtgctgatgaggggccctggggcagtaacaggaaccaacaggtgcctgagcctcagggtaacctgggagtctccttggaggagaaacatgtgggccctgtgggagtgggcatgaaagatgtgagagcacagcctgtgggagggtgccaagggacagcactgcccatcctccaggtgtgccacaggaagcagctgccgaaagtcatcctctcccctcagtgctgtgcctggagtcagggcatcttctcaccggatcctgggcatgctctgggtttccagggcaatgccaacaaactcagactctgtcttggggccaactataaaagcttcccacttatcaatggctccaccacctgccatgtgcctgttgaacaaggtgacatccactggatcccgcaccggggccgcaggtggagctgcctgccagtcccgcgccgtgcgcccgcactcctcagcccttgggtggtcaatgggactgggcactgtggagcagggggcggcgctcgtcggggaggctccagccgcacaggagcccatggaggtggggaggctcaggcatggcgggctgcaggtcccgagccctgccccgaggagaggcagctaaggcccggcgagaaatcaagtgcagcaccggtgggccggcactgctgggggacccagtacaccctccgcagccactggcccaggtgctaagcccctcattgcccagggctgctccaacctctccctgactcagtcagcacctctttgcagctgcgtctctccctctcctgtgctccactgaagtcatttccagccctgcttcagcccaccttttgctccggtctgtctcagttgttattgactcctccctgccccaccagcttccgcagggcaggggttctggtttatctgtgtcccctggtgtcaggcccagtgcttgatgaatacaccatggaagagggaaaaaacactgtcccagtgtcagccagacctgaacttcaattgtggctccaccagcctctgctgttctgctgttgtaacctccatggagttatttaacagttactctgagcagaggctaaaacctactttgagggctgctatgaaga

SEQ ID NO: 470406 - DNA, 1790 bp, Homo sapiens
acgccacggagctgcagctcacgggttccggtgatgccgccccgcccgggcgagtccccgcaagctgcctcacaggagctgtccaggtggaggcagttctcgcgggagcacgaggcccccttctccgccttcctcacagacagcttcggcgggcagcacagctacctgcggatctccctcccggagaagtgcaacctcagatgtcagtactgcatgccggaggaaggggtcccgctgacccccaaggccaacctgctgaccacagaagagatgttgaccacaaaagagatcctgaccctcgcctggctttttgtgaaggaaggcgtcgaaaagatctggctcatgggcggagagccgctcatccagccggacgaggtggacattgtggcccagctccagcgactggaagggctgaggaccattggtgtcaccaccaatggcatcaacctggcccggctgctgccccagcttcagagggctggtctcagcgccatcaacatcagcctggacacactggtgcctgccaagtttgagttcattgtccgcaggaaaggcttccacaaggtcatggagggcatccacaaggccaatgagccaggctacaaccctgtgaaggtgaactgtgtggagatgctagaaactgtatggcagctgtggccagagttggagaagctgtcagagcaggaatccaggacagccaaggcctttaaaatccctggcttccaaggccagatcagcttcatcatgtccatgtctgagcatttctgtgggacctgcaaccacctgcaaatcacagctgacgggaacctcaaggtctgcctctttggaaactctgaggagctgctgagaatcattggcgctgccgtgggcaggaagaagcagcagcatgcaggcatgttcagtatttcccagatgaagaactggcccatgatcctcatcggacaccagctaaactcagaacaactaactcatgtggatttggaaggacgggaagctatggtagatgtgggcaggaagccagacacagagtggttggctgtggcctcagccatggtcatcctggggcctgtagccttcaagcttgtccagcagaaccagctcaagaaaggagatgccctggtggtggcccagctggctggagtccgggcagccaaggtgaccagccagctgatccctctgtgccaccacgtggccctgagccacgtccaggtgcagctggagctggacagcacatgccatgctgtggagatctgggcatcttgccaggctcggggcccccaccagggtggaaatggaggccctgacctctgctgcagcccccctcctctgaaacgggatgtgaacacgtgggccacagccctaaggactcctgacagaccacatagcccacaactggccctgctcatggctgttccacccacccctctttattctggagcatatcagggaaagaagagtgccctctgacgtcagcagctggttgaaggtttaatggcttagagtgcgcacagagtggggtgggaacttgtgtgtctcacccctgccccaccccgcttgggtttccctacagtttctaccaggttcataagcagaacctaaaacaaatgggtttagaagtaactttagcctctttggctacttctggtgctcgccgaatccagaaaaatggtctttttaaatgtcctgttattttgcacaaacgatttcctgcttagagtgaggagcaaaacctctggcttttaaccctgccaaagacctacttgaagtcaatctgtgcatatttaattttt

SEQ ID NO: 470407 - DNA, 1055 bp, Homo sapiens
cctatgatccctgcagagctcccagagttgctcaagggatgctttccaggaggcaggggtggtgtgtgaagaagagggagcccttattctggcgctcttgcggtgttccattcccccgccgcccattcccaccccaagaggctctccaactttgcaccacctcccagcgctagaagcggagcggccctgggcatggtctgcgagctaggggtgcggggccgccggcgggccgcagccaggtgcccctcgctgctcttggctcttgcactctcgccaagccccgtgagcagcgcggcccaagctcccgcagtggcccgtgagcagcgcggcccaagctcccgcagtggcccacagggacactgcctcccgtggggcgccaacccgctctcaaaaagccagcaagcccgaaaacaaactctcctgatcttctgccctgggaaccccatggacctcacagaaaccttgtctgaagcaggaggtgggaggaagaggacccagatcccctgggctaaggacagccccctcctttccacgcttttctcccagcgccccacttccaaggcccagcccaatatcctgcagagtggtcttcctgtacccaccagcaccaagctcagcaccttgcacacaggatttcaggaagcactgaatgaagaaaggagcctctggcagccctgggatgccccagcaggcccagtcaccagggcaggctgctgggggatctgagcacattcttacactgagggttatgtgttatttctcccagcccatggtcaccccttgctaggacctttgaagagctccttggcaaagccgagtggaatctcatcatggcaagccataaggtctctgttgaactgacttaactgcctttgtagtgtgaaaacacccatgcatgggtgtggctgtgttccaataaaactttatttatggacactgaaatttgaattctgtgtaatgttcatgtgtcctgaaatatgagtgtttctttttctcttccccaaccattaaaaatttgtaaagcactcttagctcaagggagggctgtataaaaa

SEQ ID NO: 470408 - DNA, 656 bp, Homo sapiens
ctgcagctgagggtcctgactgttagaaggaaaactaacaaacagaaaggacatccacagcaaaatcccatctgtacgtcaccatcatcaaagaccaaagatagataaaaccacaaagatggggaaaaaacagagcagaaaaactgaaaattctaaaaatcagagtgcctctccccctccagaggaatgcagctcctctccagcaatggaacaaagctggatggagaatgactttcacgaattgagagaagaaggcttcagatcaaacttctccgagctaaaggaggatgttcgaacccatagcaaagaagctaaaaatcttgaaaaaagattagatgaatggctaactggaataaccagtgtagagaagtccttaaatgacctgatggagctgaaaaccatggcacgagaactatgtgacaaatgcacaagcttcagtagcaaattccatcaactggaagaaagggtatcagtgactgaagatcaaatgaatgaaatgaagatgttatccaggagaacttccccaatctagcaaggcaggccaacgttcaaattcaggaaatacagagaacaccacaaaggtactcctcgagaagagtaattccaagacaaataattgtcagattcaccaaagttgaaatgaaggaaaaaatgtt

SEQ ID NO: 470409 - DNA, 505 bp, Homo sapiens
gacagctaccccagaggcagcagcagcagcagcagcagcagcagcagccgccgccatgagggcttcctgggagcaggccctgcattgggtgacctcagaggattggatgatgcccacccacactggggaaggccatttgctttgcccagtccaccaattaaaataccagtcttttccagaattacccgcacagacatgcccagacataatatctaatcagctcttgggacatcccatggcccagtcaagatggcgcgtaaagttaaccatcacaacaagtcagaacaacctcagcctggaggcagagtcctggagaggtcctttcgggtcaggtgttactcacttagtcactggattgcagatggatcctgggggtcagtgggggcctgatcagtggctgaaaagatcagagggcatgagggcacttagtgacttcactaagcctggacctttaaccaatattaaacaatgggatgaactgagaatgtttccctaaacctgtgtt

SEQ ID NO: 470410 - DNA, 620 bp, Homo sapiens
acccattactcagcttcccctaaagatgacatctcagagctcaggggccacaagtgtggatacaaaaggctgccatactggccctttgccctcactggcggagagcagccgtgggcccaccaagctgttaacacttaagctgtccgtggatggcaaagctaaaaagagcactattgaatcccagcttccacccacaaacaggagaggccaggctcctgccccctacaaatggtatgaacttccatggctccaccccagtgcacactactcccagtgcacaggccagtcagaggttctcctgggaccactttatacttggctgtctcagtaccatcaccttggggcttatgttccaacagatgaattttggagggacacacatattcaaaccacagcaataggaatgcgagagatggatcttggtgatgtctgcatgggcaagcagtgtggaagtggcaactccatgccaggcattgaccagtgcaaagcggggcccatccctcattttacagatgaggaacctgagtactagggaatagaagtgatttaagctcatatagaaagccattagcacagccaagatgttgatctctttacttcaatctatttccattatgcaa

SEQ ID NO: 470411 - DNA, 528 bp, Homo sapiens
tctgctgaccacagctgctcaagaaagagtttctttagcttcataatgttggctcttgctctggatctagctgactcctgctgccattcatggcccctggcgcacattgccaaccctgctccaagactggagctggcacagggaaaggagagaggccagacaacaggagcagacacctctgagcctacagggattgggaaacccttcctgggccctgaggacacaggctgcagagatgcccaggccttgctcctgggagggctgctgcagcagcactcggggagcttctgctctgcaaactcggaaggggcagggcttccacttgtccccagctcctgtatactctgtggaatgggaggcccaggtctgcagccgtgggttgggcacccaggagggcagatcccgcccactaccggttccccccaagagcacagagaagctcggattcacagccacagtttgggtggctacagctgcagtttgggtctgcagcctgtggtttgggcagctgcagcagtaccctaggag

SEQ ID NO: 470412 - DNA, 782 bp, Homo sapiens
gtaggtaaatccacgaagatgaggaaaaaccagtgcaaaaaagctgaaaattccaaaaaccagaatgtgtcttctcctccaaagggccacaactccttgccagcaagggaagaaaaccagatagagaatgagttagatgaattgacagaagtaggcttcagaaggtgggtaataacaaactcctccgagctaaaggagcgtgttctaacccaatgcaaggaagctaaggactttgaaaaaaggttagaggaattgctaactagaataaccagtttagagaagaacataaatgacctgaaggagctgaaaaacacagcacaagaactttgtgaagcatacacaagtatcaatagccaaaccaatcaagtggaagaaaggatatcagagattgaagatcaatttaatgagataaatcatgaagacaagattagagcaaaaagaatgaaaaggaatgaacaaggcctccaggaaacatgggactatgtgaaaagaccaaacctacatttgattggtgtacctgaaagtgatggggagaatggaaccaagttggaagacactcttcaggatattatccaggagaacttccccaacctagcaagacaggccaatgttcaaattcaggaaatatgaagaacaccacaaagatactcctcaagaaaagcaaccccaagacacataatcatcagattcaccaaggttgaaatgaaggaaaaagtgttaaagttagccagagagaaagggcaggttacccacaaagagaagcccatcagactaagagcaga

SEQ ID NO: 470413 - DNA, 687 bp, Homo sapiens
agattatatagtccctgacaaaaatgcactgtgtgctgctcagaaccagcagagccatgggcaagatgggccatatcctgtttaatggtggccgcagatatttcctggctgagagctcagcctggaaagataactatgcatcaggtagttacttaagtggaaccactggtgtagggttaccagagtcttttccttttagtgcccaagggcaaagagcattgttaatgacgcctacaccggaaagatgcaagaagaaagatttctatacaaaagaaaatcaaacttatggaaagaaaaatggccctcaggacagggcttgtgacaattgcatctggaccatcttgtcactgcgccaagcctccatcttcacagagtcctgcatccttgccaaagggcctaggaaaatctattttaaattaaatatcataagcccacaagccatagcaaacaatatttttcaccatatgctctgaattaatatgccaaagattgcaacctctatttttcttcataaaaagctgccccaccctgatgtgggtatggtgagctggagggcgggagggtaggaattttcaataaggccaccaaggataggatgacggcaaggaaccaaagaaaaaaaaaaaatagagtccattgtcatccttttgactgggacaagtaaagggcagaattgatttttcagcc

SEQ ID NO: 470414 - DNA, 721 bp, Homo sapiens
gctatcaggatctggtggcaaatgaactctgagttgaaatgtgcacttcagctaccctgtgggcagaacttggccttcctagatggtgcttttgaaacttactcagaagtgctttctgggccggctcactcacattctaccttacttactccatcaaagtcccaaccatggaaggctctggtgtcaaatcataagatcccactgctgtttttttttttgtttgtttgtttgttttttgctgcaggcatgcaggaggaacacagacttggtgtattgtcagctcctaggaggatggacgaagctcctgtagagctgattaacagaagcaatttggccctgggaatgcacagagagaagtggaaagtcatgctacagagttgggtaagagttcgaagtcagagaaggctgggttggaatccccactaccacctagtatttggtgacatgggcaagttccctaacctctggagctccaatctccttacctgtttgatgtgtgggattacggtgcccacctcatgagtttgctgtgaagattaaatgtgtaaacctacatagcaccacattattcttagcaaatattagctttctttaccaccgtcgtcaactttattagctattttcattcactctctttttaaaaacagaacttaacagttattcatatgttgacacattgccttgaattccaagtcaacaaatatgtcagacatttttgttg

SEQ ID NO: 470415 - DNA, 1630 bp, Homo sapiens
ctgccttctcttacatacaactgtcttgaagttggctagagcagaggtccccaagcgggccacatagtaggaggtgaagtagcggatgcaacgaccctcactatgcattctgtgtagaccggccggaaccactgcctggtcattctctgtagaccggccgcaaccactgcctggtcattctctgtagaccggccggaaccactgcctggtcattctctgtagaccggccggaaccactgcctggtgaatctctgtagaccggccggaaccactgcctggtgaatctctgtagaccggccggaaccactgcctggtgaatctctgtagaccggccggaaccactgcctggtgaatctctgtagaccggccggaaccactgcctggtcattctctgtagaccggccggaaccactgcctgatcattctctgtagaccggccggaagcactgcctggtcattctctgtagaccggccggaaccactgcctggtgaatctctgtagaccggccggaaccactgcctggtgaatctctgtagaccggccggaaccactgcctggtgaatctctgtagaccggccggaaccactgcctggtgaatctctgtagaccggccggaaccactgcctggtgaatctctgtagaccggccggaaccactgcctggtgaatctctgtagaccggccggaaccactgcctgatcattctctgtagaccggccggaagcactgcctggtcattctctgtagaccggccggaaccactgcttggtgaatctctgtagaccggccggaaccactgcctggtgaatctctgtagactggccggaaccactgcctggtcattctctgtagacaggctagaacgaatgcctggtcattctgtgtagactggctggaactactgcctggtcgatggtctttcagcagggaggaatgctggcctggaggcttaggagggctgaatggtttgggccagccccagatccctggcagcctcgagacactgctccctgcatccttgccactccagcttcagccatggctcaaaggggcccaagtacagctctggtggctgcttcagagggtgtaagccataagatttggcagcttccatgtggtgttaagcttgtgggtgcacagagtgcaagagttgagtcttgggaacctctggctagatttcagaggatctatggaaaagtctggatgtccaggaaggagcctgctgcaggggcggcgccctcatggagaacctctactagggcagtggagaggaggggaaatgtggggttggagccccaacacagagtccccactgggacactgcctattggagctatgcgaaaggggccaccatcctccagacccaccaatagcttgcaccctgtacctggaaaagcctcagcttctcaatgccagcccatgagagtggctctgcccaagcttcccaaggccttgggagcccaccccttgcatgcctggatgtgggacatggagtcaaaggagattattttggaactttaagatttaatgactgccctgctgggttttgggcttgtatgaggcctgtagctcccttcttttgggtgatttctccattttgaaatgggaatatttatccagtgtttgtact

SEQ ID NO: 470416 - DNA, 885 bp, Homo sapiens
gaggacccacgagcatgccttatagcagctgcacgctcttcatgccaagatccatcgtgcccctcctgggggctcaggtcttgtccctggcagctgctggcgctgtgaaccccagctgcagccccctcagcaagagcctcatggcagcagctgctcccctcggcttcaagcacacccagctacgatcagtgctcaccgctgggggctgccaaaaataccccacagggtcctcagggtgctgctggcagcaacgggaaggcacctatccatctgacaagcgtgcgctgggcacccactcaggtgacactgtgtctttggatgcagagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcgtaagtactgctccctgcccagcgcacgctatggggaccccgtgagctcccccaagagacaaggcagcagggtccacctcctgtccaaacactccctggggggtctagagcctctgagcagcgtctcctctctggaggtccacttcgacctcctggacctcactgagctcaccgacatgtcggaccaggagctggccgaggtctttgctgactcggacgacgagaacctcaacaccgagtccccagcagtgaccagtgaaggacactgacgtgacctgtgtgaacttcagtaactgtgagagcatcagggccgagccttctccgcatgggacagtttggcccagcctctgcttcccaaccccccaggccactcaggacctcattaaaaggaccagccccactgtgactcctgcc

SEQ ID NO: 470417 - DNA, 1143 bp, Homo sapiens
tcatcggagggcaaggggctccgctacgcacagtacctgccccgggagcagcagctctacacccaggagcagctcttcgaccgcacgtgcatgatgctcgggggccgggtagccgagcagctgtgctccgggtagatcactatgggggctcaggacgacctgaggaaggtcacccagagtgcctacgcccaggttgtgcagtttggggtgagtgagaagctgggccaggtgtccttcgacttttcccgacacggcaagaccctggtggagaagctgtacggcgaggcaagcgcccagctccttgatgacgaggtccggcacctcgtcagtgccacctacaggtgcaccctggacctgctgacacggtgccgggagcatgtggagaaggtgggccagcggctcctggagaaggaagtactggagaaggcagacatggtggagctgctgggcccccggcccttctcggagaagtctacctatgaggagtttgtagagggcgtgggcagcctggaggaggacacatcccttcccgaggggctgaagggttggaaccgcggacaggaggaggaagatgtggagagcagcctgtgcagggggctctgtgtagcctgtggcggtcgcctgcacctgctgctgggtggagttggggtgactgccacttacctggggccttggcaaagcagctgcggaatctcacccaaaacaaattaaaacgtgacaactgtgaatgggtgttttagatgagggtgctctgagcccacatgcagggagtaggagtgggagtgggcagagggggtaccctgagtccctgggccctcccgctggaggacagtcgggtccaggcttagacgggagaggccccagggctctggcccctgtggtgctgaggaaggcacgactgtagcttcgagaggggcttgcgtgggacaccttggagacaccaggccttcctggggcctccgtggaggagcgttgatatggtcataaagacactcggaggagcctgggtccagcacagaaaccctcaccgtttgggtgtgtgtcaggaggtgacggctggagcctcgtgggcgggtgaagtgtgtctgctgggtcagcactgcccagatctgccatcgtgttcggaccccatccctgcaggag

SEQ ID NO: 470418 - DNA, 1026 bp, Homo sapiens
gattcccctgtggcactggtgtctggacgctgcctgcccctgctcagggatcagcccgcagtaggcccagtggccctgggcccctggaccacctccccggcccccggaccgcctgtacccactcacctcctcccatccccgctcacctcctcccgtccccgctcacctcctcccgtgccccgctcacctcctcccgtgccccgctcacctcctcccgtgcccgctcaccacctcccgtccccgctcacctcctcccgtgccccgctcacctcctcccgtgccccgctcacctcctcccgtccccgctcacctcctcccgtccccgctcacctcctcccgtccccgctcacctcctcccgtgccccgctcacctcctcccgtgcccgctcacctgctcccatgccccgctcacctcttcccgtgccccgctcacctgctcccgtccccgctcacctcctcccgtgcccgctcacctcctccaatccccgctcacctcctcctgtgcccagggaccacctccccagcccgcagaccacctgtgcccacttgcctcctcccaggctgcccttttgcagacttgcccgacctccccaccacgctaaccctatggacctcacttccttccaaaccaactcctataatcctgaggtgctgctgggaggcctgacactgggcggctgcctgtccacgaggtccgtgcactcggatgagcagctgaagcccaagctgagcagggcctcggaaacccacgggcctgaaattcctcaaactgcagggcagtgccccgaagcccacagtgaggacagcgagggcacctgcctcgcctggactcagcgctcacccgggacacatgatgtgacttttctgcccacagacctatggttcggcctcacagccatcaacaaagtgtggggccggcagggcctgggctcagctcaccgcaaggagcctgggcagtgcggcagcttctgcagagggaggggttctgcgtcccattccccaagtgggttctgatgttggaaagtc

SEQ ID NO: 470419 - DNA, 1367 bp, Homo sapiens
gcccagcacggccataatgaaatacagcacagatgatggaaggagccagcctgagctgctggaccctggccagccagctgggagtcctctggcaggacctgaaatagtgatcgagcgggcagctggaggagaattactgctcggcaaattgctgctggaaactggattcctgagcagtgccacacacaattgtggaaatactgaagcttctcctaggtctagaaactaccaaggaaagggcaggcctggactgacctttgaaactccatatggactagtacagtcgttctcaaagtgtggttcccagaccagcagcatcggcatcaccaggaaactcattaaacatgcagagttgcgatacattcagtccacaccttccgaatcaggaactctgggggtaggacccagtgctctgttttaacaagttcagcaggaggttctgatcaccactaaagtttgagaatccctgctctagagacaaaggtggtgcttgttgttgttcacaaccatttacaataattcatagtgctaccactcatgcatagatattgcttaaactgttaattttctaagcactctgttttaatggagacctttcctttttgtatttgttccacccagtgctatgtttgtggcttttagatattagggagtatataaatttgttacatcaattttctctatgataaattataaagaaaattattctatttagttttattcatctcctcatgaaatagtacaattagattttgggatgtgacaaccttacatcattttgtttttctaaaatatctaactggtatttttatcagagagttggttgtaatgctaacattattacagctatgcataaaccaacaatggccactacaaggcttgtaaaagcacatgtaaaatatgagatgactttccaaattcaccaaatttgtctgccatagaaaaaaactgttgagaactcattggtgccaagtaggtaggtgctatggaaaagcaaagatgaataagacatagctgttatattgagagaggtgtcattgctgagcgataataaaggaaatcttgaaaaaaataaaacaaaaaggccccacagaaatagaggcagaatgtggaaaagtcccaagtggaatgaaatgttatggcatttagagattggagaaatgaatttggggtttaaaactccctgtttggggcaggaaggggtggtggaatttatggtgattaagatttatcaaaactcaaaaaaagactttttttttctgtctctcgagttataaaatagtgccaaataaggctaattcctggggaatcagaaataaactcttctccctagagaagggtcttctcttagtctttgttttttaaaa

SEQ ID NO: 470420 - DNA, 709 bp, Homo sapiens
ctgcagccacaatagggagggtgcttatgaatacctctgaaaggcttctaagaagaaatgatgctgcaactgaaatgtgtagcttcatgggagtgaactgggcacagaggaggacaaccagcagctgttccctgcccctctctggccctggcctgcaaaaccctgcagctgagtcaggggtagctgatactcaggctgctgggccatttctgcttcacctcttcaccagttggcctttgtcaggcagctctgatgagcctggctgcctggtacgttttcctcttggaaagaatggggggaagttgacctactccgccgataaggagggagatctgcttcctcggccacagcccttggcaggtcccctccaggatttccctgggccgtctgagcaccgtggggagatgagagtggatgtacagttgtggcttgagagtcttaaagccagaggggacttcatcgtcatcggcaaggagattacgcaggagtgcatgtccgagtcttcagcctttgggaataaatttccctggggcccctccagggaatgtactgaatcagattctgacagcagggcctgggtaatgatatttcattcttagctcctcattttaaatgtcatactcatcattttttcctgaaatgaaaccaatgtatttctattgccattactgaaaaatgtttacttacagcccttttgaaatctttcaga

SEQ ID NO: 470421 - DNA, 555 bp, Homo sapiens
tgcttctgggtgatgctgctgctgctacctggttctcaatacctcactttgagaactgctgccccagagctttgcttgtccaagcgtattctacggattaacagcattggcatgagctgggagcttggtaggcatgcagagtcccaggtcccaaccagacctgctgaattggagcctgagttttaccatgattcccagggacctgatgaccgagccctgaagaccacctgtgaagactctgaaggtgcagagggcggtagcagagatgagatgggtgggacaattgtgaatggccacacctgttcaggattccacagagtgctccagcggagtttgttgcttcctctgagaaacactgaagaggaggtgggtagcagccagtcaaaccgccggagacaagctgcagctcttgataataaatgtgtgcaagcctggctgtgtggagtcgggagtatcggctgatgcgtgttgtgctgaaaccagcctccattaggtttgtggggtggggggaggggggagggatagcattaggagatatacctaatgctaaatgac

SEQ ID NO: 470422 - DNA, 4573 bp, Homo sapiens
caagatctgaggccggatttgaatccagtttcaacttgacgatgccggctcctccccttcaaaactctttgattactcattgcctttctgtggacttcgtagttgttaaaatcctattctaccagggacaaaccacaatctctgcaggcccttctccagtgtactggactgggtccaggactgcaactagtgtggactttgtaagaggggtaagaactctggtcctccccagcagctacaggggcccatcatctgtggacacactacaaggaaaatacaaggtagaaacatttaacaggacacagacatggaatgaaaaagagagaattgttcttgttttcttcccttggctacctggaaattcaaagataaatgtaaatgctttgaacatcttagcaccttatccttggcttctggtaaaattactgcctctgaccccgcccccccgccccccccaattaccacttatacagttcactttccccacttagcttctgctgagtgtaccccctgtgatagtattaatatattcgacattactgctaatatcacaatgggtgtataccctgtgatgttatttatatcttttatattactgctaatatcacagtactgctatcacacttggtgtacatcctgtgatgttactcctaatattttagattttactgctgatatcccaatgggtgtacaccctggttgtacatccactgtgatattatttataatatctttgatataatggctaatatcacagtgggtgtacaccctgtgatattattcataataacatggaagccgtgtgtaaacattggatattataaatatcagagtgatatttcattaatatcacagtgtgtaaacattgtgttaacacagtatgttataaatatgagagcaatatttcattaatatcatggtttgtaatcactgagtgtaaatactggatatgataagtattagagtgatatttcattaatataacagtgtgtaaacagtgtgtgcaaacactgatattataaatatcggagcaatattttataaatatcacagtgtgtaaacactggatattttaaatatgagggggatatttcattactattacagtgtgtaaacacttgatgttataaatatcagagtcatatttcattattatcaacgtgtttaaacactgtgtaaacactgatattacaaatatcagagtgacatttctttaatatcacagtgtgtaaacactgaataatataaatatcagagcgatatttcattaatatcaatagtgtgtaaacactgaatattataaatatcacagtgatatttcattaatatcatagtgtgtaaacactgtgtctaaacactggatatgataaatattagagcaagatgtcattaatatcccagtgtgtaaacactgtgtctaaacactgaatattataaatatcagagtgacatttcattaatattttagtgtataagcactggatgttataattatcagagcgatatttcataaacatcacagtgtgtacaccactgccattataaatatcatggcgatattttattactatcacagtgtgtaaacactggatattataaatatcagagccatatttcattactatcacagtgtgtgaatactgaatattatacatctcagagcaatatttcattaatatcacagtgtgtaaacactggatattataaatatcagagccatatttcattaatatcacagtgtgtaaacaccggatattataaatatcagagtgatatttcactcactgaatattataaacatcatcagagagatatttcattaatatcactgtgtgtaaaccctgaatattataaataccatcagagaaatatttcattaatatcacagtgtgtaaacagtggatattgtaaatatcatcacactgatatttcatatatatcactgtgtgtaaacactggatattacaagtatcatcagagtgatattttgttaatatcatagtgtgtcaatattggatattacaagtatcatcagagcaatatttcatgaatactacagtgtgtaaacactggatattacaattattatcatcagagcgatatttcattaatatcacagcgtgtaaaccctggatattacatgtatcctcatcagagcaatattcattaatatcacagtttgtaaaccctggatacaataaatatcagagcgaaatttccctaaaatcacagtgtgtacatcgtggatactataaatatcagtgcaaaatttccctagtatcacaatgtgtaaatcctggatactctaaatatgagaccgaaaattccctggtatcacagtgtgtaaaccctggattttataaatatcagagctaaatttccccagtatcacagtgtgtaaaccctggacactataaatatcagaacaaaattttcctagtatcacagtgtgtaaaccctggatactataaatatcagaacaaaattttccttgtatcacagtgtgtaagccctggatactataaatatcagagtcaaattttcctagtatcacagtgtgtaaacactttgtgtaaacactggaaattatatgtatcagactgatatttcactagtgtcacagtgtgtaaaccctgtgtgtaaactctggatattataaatatcagagcgatatttcactaatgttacagtgtgtaaacgctgtatattataaatatcagggtgaaatttcactaatgtctcagtatgtaaatactggatattagtaatatcagagagaaattttactaatgtcgcagtgtataaacactagatattacaaatatcagagcgaaatttcccttgtatcacagtgtgtaaaaagtggacactataaatatcagaccgaaatttccctagtattactgtgtgtaaacactggatactataagtatcagagcggtatttcactagtatcacagcgtgtaaacactttgtgtaaacactggatattatacatatcagaatgatatttcaccagtattacagtgtgtaaccactggagatgataattatcagggtgatatttcactagtatcacagtgtgtaaccaccggatattataaatattagagcgatatttctttaatatcacagcatggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaaggtaggtggacaaaaaatttcctgcccttaaacctcaggacatcagaagacctcacgagattttgtcacttgcacacactttgatgccaaaattctcaaaagggctttcaaaattgtgatgtcagaggcatacaaccacaagccacaggataacatggtgtttcttggagaaggtttaacaagaaaatgaaggaatttagctagcaagcagtttaaaacgctttcacactagggttacctaaccttggtgctattggcatttggggctgaataattctttggtgtggaggctgtcctgtataatgtggtgtgtttaccatcatccttggcctctacccaccagatgccagtagcacacacaaacacaagctcacacacacctttgtccctttgtccagtatgccagtagcacacacaccacaaatgtcttcagaattgcctactatcctggcaggattgggggtgccaaattgccccccaccaagggccactgttttagactatcccacccccagtataatgtgaaaatactagagcatagaagttaacggcctaggctctaaagctagctgtccacgttgaatccaggctctctccttgccagctgtgactttggcctcgttacttgccctctctgtacttcagtcttttcacttgtaaaatgaggacaaaatattagtaactgcttcatacagctgctatgaacatttcacagggtaacaaatgtaaagcacctatataacccaggtacttggcaaggaagaattcagtaagttttagctgtcatcgttagtgtcaagtgacctgtcagacatgacctgaagttttaagataaatgatgtcactttacagaaataatgggctgggaatggagtttctggctcaccccttgtattggtccattcttgcattgctataacgaaatacctgaggctgggtatggtggctcaagcatgtaatcccagcactttgagaggccaaggtgggaggatcacgaggtcagcagttcgagacaagcctgaccaacatagtgaaaccccatctctactaaaaatacaaaagaattagccaggcatggtggcacacacctgtaatcccagctactcaggaggctgaggcaggagaaacacttgaaaccaggaggcggaggttgcagtgagccgagattgtgccactgcgctccagcctgaggaacagcgagactccatctcaaaaaaagaaagaaagaaagaaaaagaaatat

SEQ ID NO: 470423 - DNA, 688 bp, Homo sapiens
ccgatatccttgcaacgtgcagggactctcactgataataataaaccacacgtccacttcaaaggaaatacatggctatgattgaaattactggaacattccagcaatgggatgtttacctgcctctgagaggtgctatctatacaggaaaatcacgggctccgaagttgaaatgcctggcttgactccaggctccaccctttactgccagtgccaggcctttctgggtgcacccaatgacaaggtttctcagtttgctttcagttaccatgagtgtacaacagagaagtgtgcatacagccttacacggaatcaaacacaaagtgggggcttaggagatatcctgcggctgaggttctgttctgggcgggacaggacccatcacagctggaaggtgacatcggaggcttctggatcagagacaggacccttttcaaagctctatgtcccgctgtttcctatcaatgacaaactttcaaagttaactggctttctttgcgagtgtaacatcagtcctcagtttagtccctgagcacagtcatcttgggtcctctagaccaggcacttacgtcctcatgttctgcggcagcttttactcctccctctagtaccaattaccactgccatcgatgactaatgcgcctctttattagcgttaaatgccacttccttggggatgccttccctg

SEQ ID NO: 470424 - DNA, 1523 bp, Homo sapiens
ttttttttttttttttttaatgtaggaggggcagctgctgagagatcaccggccatgagtaagaacacagtcatagtcacgatcacaatcaccatctgcacggggcaaactggattctgggccgtctaccgaatcacctctaaagcttcttattgctactgctggcctggccctgcctctggaagcagcccagctgttgggcccccagttagtgtaaggcacagatgtgggagctgttttccgaaaacccatcaccagtgcctgggcgcctcctccctcaatctgcagcagcagcagcagcagcagcagggtcctgagaagggccttggcgagggttatttgcaagtgccacacccacagaccctgctgtatagtgagctcttgctaacctccgatggcaactgcatccctgagcctgatggcttttctggaaccacggaaggccccctcatcacctttcccagccttacaggggagcatccccaaccagagactgtggtgtataaattccttcgttccgtctcttcaataatgcggtcattctgagttccctgctggtagttcctgaatctcctaagtgaactccttgtactttagtcattgtctcagggtcttcttctggggggaatcgaaaccaatgtgttcagcaatcctttaaaattaaagacacagggcaaaggactctctgcctctgccaggtaacaggtgtcacagcacaaatgaatgactcattctcctcacttagcaaatttcaattttaagtaattgcttgaatcaaagttatttattggatctttcagaattaaagctggttttgattagtttccatcactagtaaaatggaaaatatgcttcccattgggtggggattttcctcaatcatggcctgcttgacaacgaacactgaacttggagcacaccattctgaaccttcccatcaggacctctccttttctcccatccaagtactaaccaggcccgaccctgcttagcttctgagatcagacgagatcgggcacattcagggtggtatggctgtagacaggacctctccttttctgtcttcaaaagacttttccatgatcacagcccttgctatggccaggcacccagtggacactcaatagctgattagaaaattccttctgaccatttaaaaataaaatctagacctgaggacatgccacggccagtttttaaaccagggaaaaataacttctagagttgcttgctgcctggaaaagagttccctgctatgcagaagtccttgattccctgatggttcccgggtaacaccattaaatatcccctataccatggcatctgcgggttgatagtataacctttcatgctcattacacacagtgaagactagagtgactggtattgctagcgatgcaagggagccaaagttgagcttctgtgccttcctctacttcccattgcctgccaggggtgatgtccccggagcacacatttctttgtttcacctgctagtttagaaaccttctgtggccgccctc

SEQ ID NO: 470425 - DNA, 551 bp, Homo sapiens
tgattgataactcaatctccagcctccctcaccttactggaaccatgtaaacacaagttggcttattatgttatacaatatccagcctctgctttctgcacatgtgtatgtcagacaattctgcttttatgcaaattgctgtgtaatcctttcatcatctaagacatcactgctgctgaatccacctggtcctcctatccccctgacagtctatactagtcatcctacagcaaagaggtctatgggcatatccccccaccttgaattgccaaatgaaatctaccacgaaccaagtggcttgaggattttgcacactgtcccaggcagcaacagtgatgggtccaagggcagccaatcagaatcattgcttggaaggaaagctgtcctatttcggtttgggttcatgccaatcacattctataaagcttgtaagtgataaagccactatgcagatgggaaaactaaggactgggggagaaagtgatctactcagtgtcacagagatccatggactggacagaagtgtttttactttgtttgtagagtggcat

SEQ ID NO: 470426 - DNA, 773 bp, Homo sapiens
gcaggacagacaaaacacccaccaagggccatattcagctctcaggcagccaattcttaaccactgtgggaaagaacacgtccacaacaaccccaatgtcttccccacccttcacccctctgacaaacccaggtagcaaggccccggaagctccagcctgccatgcacacagccagaacagccttccgctttcgagcagaatgatccaggtactagcagttgggagttgatcagggcgagaagaaaggggaaggcccacaggatatggctgaagcccagagcatgaaccacccaatcgctgttggggtgaaagatgcacagctccaccactgtgactctggaaccagcatcattcaagtcctggagacagtggttagcgctaacataaccagcaacccaggcaagggtctggggagccctggaggcccaggctggggcccagagcatggaccacccgctcactgttggctctaccactgtgattctgggaccagcatcattcagctcctgatgaaagcttcctggaggtggggaaaggtgagccaagagacagggagagctgaagtggacaatgatgaaggaaaggtatcgctggacagtggcagcaggtggagctgggtggcagcaggtatggagtggagaccactagcgaccttcattaatctcaccagctggggaaatgccaaagcaatagtctagacccaggccaagaccgagcctgagctctggctcctttcccagatgcatatatatacaggggcacaacgtgtgtg

SEQ ID NO: 470427 - DNA, 1274 bp, Homo sapiens
accagcagcctggaagtgaccagcagagctgacaaaagcaccccctgctctgcccacctccgcagagtcctgtcctcatcagaaacggtatcgcggatgctcctcagctcctagaccgtggcttgtgatgttagatccgtcccttagcagccacaccccagtcactgcctgagcctcttccatcgctgactgcctgagcctcttccatcgctgactgcctgagcctcttccatcgctgactgcctgagcctcttccatcgctgactgcctgagtctctccatggctgactgcctgagcctctccatcgccgggatcggccggccaccttctccctgtgacttcctcccagtcccgtcaccaaacccctgaggccgtcctggcatcagaccgcaggccataaaagcgtccagcagagggcgccccaaacccacgagggccgcggcgaagaagaaggtagcggccgctgtcctctcccctcccaggcaggtccggtgcggaagggatcgctggacactggcgatggtggagaggcatggtgggccgggtcccccgcacccttcatggccctgactcggggctgcccgtgaccttcagcgtcagagctcggtctggtccatgcctgccttggggaagctgcgccgcctctgcacccacccagtgctgggacgtctgtctgagcctgagctcagactttggtgtcccgctgctgaggccggggtcccgccgctgtgaccgtggcaaggagagtctgcgactgccccgctcaacacccccagcaactttccttaaaagactcaaaccccacaccttcccccaacaccaccaccggcgtcttcaatcatccagcccttttggatgtacagcccccgggcttctgcagacctgctccctgattcctgagcacagccgcctccctgactttacctctccttcccccattggcacccagctcagggcctggcctgtagcccacgatcacatgcccaatcccccgacatttgctgagctccgtgtgagccgagcaactacagatgcatagaagggaacagagcaggacacatgtcaggatcagaacccacccatacggctttattttaccttaattactacctcttcaaggccctatttccaaatatggtctcattctgaggtgccgagggatagatctccaccatttgaatttgggggccacagttcagtccataagaccaggtggaggaagtacttccactgctgatgtccatctgccagcgaggcctctccagttctcacc

SEQ ID NO: 470428 - DNA, 763 bp, Homo sapiens
gctttgggtgcacagaggacagctcacgcacatgtgtccaccagccgtttcccagctccatgaatttgtggtgcattcccaggttgaggcagtgagcaccctgcacagtggcctgaggcccccaggaagtttcttctctgaattcaaacaagacgggcagctggagcaggctggggagagagctgcgctgcgtgggctttccgaggaccatatgggcaacacggctcattccgcggctacacccgccccgcttgtcatccccaatcatacttgctctaatccgtgttttaatttactctgctggtgcaacgcccgtgctgccagggcggtccttggggccccctcattcctgctgctgatgacaaggcactcgccttgtatgctttcttgccggagatccaagaaccctctcttggggtctggattgggacccctttcctgtaacacagacacaatcctacctctttagatatttaattaaccatttcataaatttaatcttgtggtttttctttttatgttcttaacccaatactgtaattttgttttcagatggacaatcattccatgggccatcaaaaagtgggcctggggccaatagataaaatggcttctacctgcaaagagtttctctgattctttgagtcagttggtgagccctggggggcagcctttatatctttatttaacactcgagtctgacttcacaggattttgctagcccaaataaagccaggtggctaggtttacatttttagggcct

SEQ ID NO: 470429 - DNA, 660 bp, Homo sapiens
ccagggagcgtaggtgcccagaggggtgaggggctggaaaaaacaatgaacaagagatgtgacaacctcaattatctggtggtgctaagagctcggagacagctcctgctgaagagagctgttgggaagcccgggggtgtcagcctggctggaaaaatggcagcccccagccactctcggattgaaatgagcatcttctccattactggcctccaaacgcgtcccgtgtcctgcccccaatccattagtgagatggaactttctatctgcacaagaaagaaatcagcctgcagattaaatgctgttgcgccgaacgaactgctctcggctgaagtgggaaagcatgattcgattagtatagattctggaatcggcaaaagcaaaacatgggagacaaccagcaagaaaagaataggctggtacgttgcagaacgttatgcagctatcaagaagatcaactaggtccataggcattggtgtggaaagatcctgaagataaattgctcacttttttaaaagtcaagagttatgatagtgtgtattgtgtgatctcaattattttgaaaggatatatacataattatacatgtatatatgtatattcacatgtgtttatctatatatatgttttgcatggtggtatgtacacagaaaaatatt

SEQ ID NO: 470430 - DNA, 518 bp, Homo sapiens
gcctgtgttcatagcagtactgttcacaatagccaagaggtggaagcaactccgtgttcctcaacggatgaatggacaaaacgtgcactggtgacctgagagaaggtttggaattcgggctgggaggaaatgagagaagctctcagggcagtggccctgcccccattattctgaagctttcagtagggtctgtgtcccacatcattggtttggaggatggcgagaagtcatcctactaccagggcctgccagtacagcagaacccaggatgcaaaggagcccagcaggccactggaaaggtgaccttaacccatgcccacagagaatcgcccactttacagctacacggcgggcatctgatggctttaatgaatgcaaaagcatgtaagcaagccaactggtcttcactccactcctgcctgcagaatccaatgcatacctccagcctgcactctaagctgccgtgaccattttcttctttttcaaaatatgtacttcaaattcttcctatttcctcc

SEQ ID NO: 470431 - DNA, 879 bp, Homo sapiens
gtgcccgccggcagagtggggccgtcattcctgggtggaagaagcctgtccggtctcctcctgaatccagccccactgcaccgccacaacacccaagttcagatcgcagctccctgtgctctctctggatctctcattgaccacccttgcccccaccttctagacgctgaggtgcccctaggttaatcctcagccctcttctcactcttagttcattttctctttagcttgggtgacagagtgagaccctgtctcaaaaaaaaaaagaaaaagaaaaaagaagaagaaggaggaggaggaggagaaggaggagggaggaagagtaggatggaggaggaggaggaaggaggaggagggcggaggaggagggaggaggagaagaagaaaaaagaagaagaagaaggaggaggaggaggaggaggagaaggaggaggagaaggagaaggagaagaagaaaagaagaagaaagaagaagaagaagaagaagaagaagaagaagaagaggaagaagaggaagaagaggaagaagaggaagaggaggaagaggaggaagaggaagaagaagaagaagaagaagaagaagaagaagaagaagaagaagaagaagaagaagaagaagaagaagaagaagaagaagaagaagaagaagaaattgggaccaggtcacattttaggtcccttgctgccttctcactcacatgcttatccccacatgtgaggacactgagggtcactattataaatgccaacagatgccaggcaggtaatgtcaatgaaccgcatgggttggatgtgaggtattagggaatgatggaaactgtgacaagctaagagcacaggctcttgctaagaagggcagccacatttcagctttgacct

SEQ ID NO: 470432 - DNA, 1047 bp, Homo sapiens
catcgttatcagccggggacccaagcagccacaacctgccacattttccacagggtttggcggtgttaagaaaataccctctagcctggtgttattttaggctgaaacaaaagtcgacatgaatggctgggcggaacagagggggcattgttctccctgtggccgggtgctcagaactggcctgaaactggaatccaacaaacggagaagtaaatgccatcacgtacaaatgagctctcgagtgtccaagggatcaattgagcacagagggcggccgggccaaggattttgccaggccccgggtcatgggaagtttggtttccagaggacagacggaaagtgccacctgatttgcagtggacggacggctgtgaggactgtgtgggatgatgacgtccatatagacactttgcatcatggaagcagtcaatgtatccctgaatacattttttccccaagtgtaaaattggcataagacttaaaggattctagcagtataaaaggttatgcagcgaagagtaactctttcctactcttgaccccttagtcacagagggtgtctacagagaagacacttgttgtcaatgtcttgtgtaaaatgccaaagatggtttccatataccaacatggaaatgagatatatatatatatagccatttttgatctacaaaaatgggagtttcatatggttcaatccaagtggtgtgtgtgtataaacaacggtagcctgctgtatacactgttcacatcttgtttattttttaacgtaataatatcttttagagaacattccatgccacttcttacagacatttctcattcttttcaacagtcgtgaagtcttccagcatgaaggcataccttcctttatttaactcttggtgaatagtacctgggtttttttgtgtgtgacatttttggaggaggaaaggaaagtcgtgcattcaggcattcaccatcccctagaccccaggccagcccccagcctccagcacctgttatttcttctccgttcagtaattccctggagtgcacatttttctcatc

SEQ ID NO: 470433 - DNA, 680 bp, Homo sapiens
ccccatgcaagatgaccttctggaaaccatactacacaacttatctctgctctaaccttacatggagggcccacttattcatccaagaacaatacggcgaacaagaaattcaatttggcaggggcactgtctgtttcagcatactttctcttaatttaatcacccatgcaagagctttccagacatttgaatggttaggaatgcagatggaaggatttttgcaacataaagttgtggagaagacacatgttctggagccaggcccaaccggttggaattccagctctgctgctcattgctgtgtggccctgagcaagtcacctgaccaccctgaccctcagtttctcatctggaaaattttgttctctcattccattgctcatgggttctttcattccatcaacactcttgtgatcaaggagtcatatgccggtgacaactgctgtgaaccagcaaccggcaccagaggaggaattgatgggcagccatgcctgacctgaatttggggagttgtaaagaaggccgctgggacggagggacagtccagcttatcctgggtagagcccattcttgggaacagcaaaataaaatggaaaatgtcacatagcctggagaaaagtggactctctctcctcctctcccaatgatggtctgatccaatccataccctctgcaactgc

SEQ ID NO: 470434 - DNA, 611 bp, Homo sapiens
aatcctgctggctctcagcttcacacatgctcaccagacagtcgctcctcacagctcccctgcggccatcctcatctaaaccatggccatcgcactctttgtcaacttgtggctctggaggcccactgtgacctgccttggttcctctctgagcttttctactctcctcatcacccattctgcttccaccactagggcctccctacggcagctggcaacacccaggctcaccccaccccagggcctctgcacctccctccactatgcctgctgctttctctctcgacattgcctcatggaaaccacggcccctccctccacctcctgtgtgtccttccagatcttcaataatgagctcatctttcctagccgtctgctccaggtggtcgtctccagctgtaccgctgcagccaagcctggtctgaataccaaagagtcgggctgggagaagggaggaggggggagcccagggctgccactcaactgcagaggcccagctcatctgctggccccgcggggctgaaggacagaagcatcttctggcaaggcttgccaataggttagtcttctctcaactctgccaaagtccgctgaaaacaggacttgttttc

SEQ ID NO: 470435 - DNA, 447 bp, Homo sapiens
ggacccatcaagatgaccctgccagaagacatcagagctccttcaaacagtcctgaaaagggtagatattttttaaaagtaaaaggaaaacaacagccaaacaagagaagatgcagggaaggcccaggagtcaaggggcttctgctggatgaaagacccaaaagcaggtgtcatcagtcaggagatgcgtctgagagcagacgtgatcaaaggatgcaacatccgaaaacgcatggcaatgtgaatactaagtcactctgctcgccagcaccacaggaagggctgcccctgaagcttgaaagaggttgtttgcggacaaataaaagcaagcatgacctgtgcaagatagtgttggggagtttagccacaacctctccaaataaaggcattgttatatgtcccagctgtgttgaaatggcgtagttttaaagggagccctggttatgc

SEQ ID NO: 470436 - DNA, 927 bp, Homo sapiens
atcctttgaatgttttaaagcaaataggaggtgcccagcagccaagtgagaggcatccaaggtggagcggagagaggagaagccggtgacagtggggctgcacggtcagcatggctcttgcccacagtactcaagaggaaagaggagggggcgctgcctatcctggtagctgccaaccttttcagaaatcacctccactatctccactccttagaccctggctctatcagagttatctccttgtaaatgaggtcctcagtgaggaacagggattgttcaaaggggcatttggaaaggagcataagacacaggaagaagagaaaacaaatgttggtgaggatggagaaattggaacccacgtgcctggctgctgtgggaaacagtacgatggacccttagaaatcaaacatagaatcaccataggacccagcacttccatttctggttacatacacaaaagaattggaagcaaggattcgaacaagtctctgtacacccattttcatagcagcattattcacagtagccaaaagatggaaacaaccctcaatgtccattgaagatgaatggacaaacaaaatgtagtatatggaacaaaatatacagtagcacatgattcagccttaaaacagaatgaaattctgatacatgctgcaatggagaggaaccttgaagatattgtgctaagcataatatgccagacacaaaaggacaaatactattcaattccacttacatgaggtgcttagaatagacaaattcacagagacaggaaggagaacagtggttaccagcggaatagttataattggagttcagattagatgagaaggtgtgtcagttgggctagactaagttatgctaggtaacaagcaccccccatgtttctcactcatgctattggtccgtcatgggttgtcaaagggg

SEQ ID NO: 470437 - DNA, 623 bp, Homo sapiens
agcacaggagaagattaatcaatccaacagacttgcattaattgtgaaatggaagggatgatgcgatcaatgataggaatgaaagtgcagcaacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaat

SEQ ID NO: 470438 - DNA, 731 bp, Homo sapiens
ctctagagcagactgcctggttcatctgctgcaaccattgaggcctccacctctgggaccttggatgccatttgctacctgactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttc

SEQ ID NO: 470439 - DNA, 676 bp, Homo sapiens
accggaacgagaaagacctggttgctaatagaaaccatggcctcagacatttcagttcagcgtttgactggtaggctaagaaccttgaatcctgccagatatgaacccaacaaccttgttggtgtaataattctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgc

SEQ ID NO: 470440 - DNA, 1010 bp, Homo sapiens
tctctcctccacattctttttttaagacaagagccatctctgtgtctgagaaaggttcatacatcttgtagcatgtgtaagcaaattgttttactgtacatcctgggctgcctttctttttgtttggggatcttgttgctcctctcacttcattattttcatacaaatcctgatggctccattctcagagtagaactctccaagtggaaatacagcactgactttttggatgccgccaattccatttaccccctctatgctaactccctgaagccaccatgcaaagtatggtttcttggggactctgggattcagcattgtgactcggcatgtgatatcttttacatatcccctgttgtgatgaagcaaccattcaagagcttcttagctgagcagctccgcggaaacctttttgaggttgatgtcgatggcattgggtcccatagagttagtgaagccttatcatggaggaagaccttggccagaggaagttccgataaatttcttgctgattcagtaatcctcataacaacgccatgaggttaatggaattatccccaagttgaagcgaataatattccatcaaaggaatatactgcattttgattatctattcatcatttgatgggcattagcattgtacctgctattttgctattatgaatcatgctgcagtagttgagatttggagatagggctaaatatgggcaaattgttatgattgtagtacattccatacagtagttattaaattaattctgtactacaaagactcatcttctaatggaactcactcataggtgggaattgaacaatgagatcacatggacacaggaaggggaatatcacactctggggacggtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagag

SEQ ID NO: 470441 - DNA, 973 bp, Homo sapiens
agccttgcccagccaatgttttgtctgattcctatgggcctcttcatttgggaattaggatgcctttcctcactgtgctctcacatcgagctgcaaagggctgcgaatctggcagaagccactcatgtgaaagtcattgtcactatggaacaaatagcctggcataaggaaggcagaaagcaacagctctgtctatctaaggaggattccaattcccagtcaccacaagggcttcctacaactgaggaaagagaaaaggagaacagagttactgagctccaaatagatagaagttcaactctcaccaaggaagacttctggaaggttagtggaaatgaacccagacctttactaccttggggaagcagaaagtgtctggactcaaagtttcaagcagataaagaaaaaaacctatttagcagtgcctcagatcaggttccctaaaaagaaagcataaactacagattcgaatgcattaattgcaatgtagaatatcctccttttaaagcaaggggtcttttgaactctccgtgagtcaatcagtggtcatgggccctcccttcaagtgaaggggtaacctatgggcaagaagttcagcagctaaggccagatgcactggccaggtaaagggaatttaggtgggaacccaccagcatatgaaaagcaaaaatgaaaatgtataaatgagcataagattttcatggaatgataagaaagcagtccgaatatacgacaatatgtgaattgcagtgtcgaatcaggcccaaacagggtgaagggaaggatgcatggacacatttcagaagccttttgagaaaggcaacacatgcctgaaggtagagcccccccatcctgatataatatatctagaatgtgaactactcagtgatttgattgttttttttttcctatatccgatgttattgctgccatccatctacattttacagagaacacgagctgaacccttctc

SEQ ID NO: 470442 - DNA, 872 bp, Homo sapiens
tgggaaatggacatgctgaaaagcacaggggaggcctatgcccttatgcatttcacctcatggtcacgagatggctgctgtatcccagacccttattccaggaagaaacaagaaggaagaagatactgaaaggatgatactggtatcaggacataagaagttttctccagacttcttggcttatgtctcattggccataaccgactcatgtgcctacctcaagtggccagaggtgagtacccctaggctcgagagggtgagcgatttgtcctcacattcctggtatgtggctgagcctggactagaatttaagtctgcgaccatcatccctagaccagttcaacgttgtatccatgaaagatgtcagtgtgattttaaagaacttaatgaagagtttggaatgaagtgcagcatttactatctgtttattttaacctttgcctaccaatgaggaaacaaatgtattagattctctgagaaacataaagaaagacagcttagctcaaaacacagcttgaaatacaggcccttggaaagaaatcattcagaaaccaaagaaatacatccctatcttcttcactttactatcccccctgccagtagggagaaaaaattacctgaggacagttttcagaaactttttcaaaagatttgaatttcagaatctttttcagatatttgactacttttttcctcttcttactgactaataaatgaggtaatgaaatgtaactatttgatatttggcctctgtgtatctgtctctcttagaagaaaatttggggaaatgttgactatgtggggaggacaccaggagtagtaattcttctatggactttgtgtttttctctctccttcacatgtctgtgtat

SEQ ID NO: 470443 - DNA, 1573 bp, Homo sapiens
ctgccttggtcatcttggggtctctctctgctgagctgtctggagctgggagaggggtgacacaagcactcctgtgaccaccaccactggggctgtgctgggtcatacctgaaaacaacatagcatggccctcacccaaggtcttgtggtgactactgcctggctactgctgatgttcactcaaggcccaagggcttttcagtcagcaggtgcagaaggactccccttggccaccactgccccaggctcctgtgggctcctccctggcctagggccaggtccagaaatgccatcaaagacaaagcctggaaatggggactccaatagcttgcttggtgttctaccacaccgtggccacgctggtgcccaagttacaagaccaagtcccctttattctctcttctcctttgctcaagcagaaggagtctctacccatggccaccaaagctgggaatgtggtgagtcacacctgaagccagcatggccctggatcgcatccaagtcccgtggcaagtacctggcttgcctggctaccgttgctgattatgccggggccatgggccctttagtcagcaggtgatgaatcctgttaggattgtatccttcccttcaaggcagcaggttcccttctggcccagggtgtgtctagaaatgttgtctaggagctagggcctaaaataggggcctcaggactctgcccagtgtcctatcctactgtggctgagctggtattcaagttgaaagacaaggtcctaaaataggggcctcaggactctgcccagtgtcctgtcctactgtggctgagctggtgttgaagttgtaagacacggtcctctttgtctcccagctggtatctcactaggtcacatataccccaagtgcactggctctgagcccagcatagcaccaggacttgcccaggaattgcagtccttgtggcctggacttcctttcaagtctgtgtaggaacctagagccctttagccagcagtagtggggctagctggaactgaagtcctggctgctgtgatggacaatgtgtctctggctagggttgatctaaatccttcctctgggggcactggctgagttctgccctgtgttgctcttcatggtgacaggacagcactgagttccaatgcacagccccacaatcactgcactctgtcttccccaaacacacaaatcttctctccacaccacagtgcagctgctgggggttgggagaggagtggtgtaagcaatttgagaatgtcttttctaccctcttcagtgtctctttccttaatatgatgtgaaaaccaggtattgtgatagctcccttgtttttggttttaatgaagatgctttcttgtgtggataattgttcaatttggtgtttcattgggaggttggagggtggggaatggtcactggggacttctatttgtccatattgctccctggagcacatttttacatgatggtcattactggaaaaatgtaatatggcagcccacctccagtagtgctatttttataaaagtgaaaaaatagagctgaacttcaaaatttgaaaattgagtgccaggag

SEQ ID NO: 470444 - DNA, 608 bp, Homo sapiens
acagctggatagagtctgagctcgatgaccacatgtggccagtggctatggtgttggacagtgtgggcgggactagatggtcctcagtgcacccccgagcattagttgctgtgacaactgtgagctcagaactaaaggcacaagcgaggtatcactgtggagttaccaagggacagacaagacgatcccagcacctgggggtctatttaatggagctcccaaggtgggaaggttggtcatgatttctgaagaatggaaagttctgagtgtgcaggtatggaataaagaaaagcctctaatctcagaggtgctgacaatggatttgggtcctgaaaaagctgccaagtctgcaaagaaagaaagcagtgttgcttttgaaggggaaattcagaaggaagcagagaagaatgaaactagacccctatctctcaccatacacaaaaatcaacccaaatggataaaagacttaaatataagacctgaaactgtgaaaccacaagaggaaaatgcagggaaatgtttctgaacattgtactggcagagatttcatggtcaaaacctcaaaggcatgtaaaacaaaataaaaaatagacaagtgaatttatatc

SEQ ID NO: 470445 - DNA, 592 bp, Homo sapiens
ctgcagcgagtgtgtcaccaagagctgcagcatttcctgtaggctcatgagctgagcgcctctcaaagcagccatgctcccaggtcaaaacaaatcaagttttaaccggggaaagaaaaagctgccatcttcaaggctgcttttccttcttttatgcctggaaaactcctggtcatcctttaagacccagctcaaatatcacgtgcttgtgaagcattccccatgccttgcaaggataatgcagccgtcccctcctcagggcctactcagcaatttgcacggacccttcctacatcatgtttctgtcgtaggggaggaacatgggccatttctatctacagtctcctggtgtcagacatgtgatatgtactcagtttatttgttcatttattcacttaaatacttactgagcacatgcaaagagctgacatttgatgacccagtcttcaaaaatgtgacctgctatttgtgcgttgagggtattgaacaaagtgatatgcctcttacagtgcttcccaaccataacctcatggcaagtttgtttcgggaaggagggagaaagagaaagggtgaaattctttgagcctctgac

SEQ ID NO: 470446 - DNA, 630 bp, Homo sapiens
cagtgacagcagccgctgatggagccctttaggagacagtaacaccatttcaggtcgggagcagaggagggtggtaaaacacaggtagtgtcagaattgatggccacacagcctgtgggggtgcagaggaaagagggggaacagtctgttggtgggaagaagctgaaggggtgtggagaatccccggtcaatgatccactttcttacaatgtgctgtggcttgaatgtatcataagccaacttaattgtagtgaaacctggagctgccccggggctactaagctacaagaaagcatccaaatctatgtcccctgcactcaccagtcccctgaccgccagaatcataactctgcctgcctaatcaacatcaccagtagggtgtgtagaaggcatctcaaatctaccgtgctccgaaacaaccccaactcagttttgtcctctccaggtcagaatggcacctccatccactcagttgcttttattaaattctcccaaatccattcttaatatctttatatcattcaaacctgtatgcccttcatccaatttctaaagggggcttggttcctttccctaaaccattacatctgtgcacttttctccataaatgttggtgtcatcctaggctaa

SEQ ID NO: 470447 - DNA, 710 bp, Homo sapiens
atcacagaactaagcatgctgattaatgctagaaaggacatgctgatcaatgctagtatgggtatgctggtcaatgttggtatgggcatgctgatcaatgacagtatgggcatgctgatcaaagctaatataagtatgctgatcaatgctagcatgggcatgctgatcaatgctagtatgggggttcttatcaatgctagtataagcctgccgatcaatgctagtacggacgtgcttaccaatactagtatgggtgtgctgatcaatgctagtataaacctgctgatgaacgctagtatgagcatgctaaacaatgctaatatgggcatgccagtcaatgctagcataggtgtgctgatcaataagcaaagagaacacatgctgaagtcaagggctttaacaataacttttggattaaacaccagcatggatgtcaatcatctggcccatactaagtgttcaatgaatgatctccagggccttttttacttacctcagataataaaagcccacttaaagcctgtgggtcctgaaagccgagaggaattcacagcttggccaacgatggaaagataatcagaatggaaagaagagagatgtataattgggaaatttcagtccccctctgtttctctggctgtctgtgtccattcacaaaagccattttagcccgtattcacttatgcgcatatgtaaaatgaggacttgaa

SEQ ID NO: 470448 - DNA, 544 bp, Homo sapiens
cagaggccggcttccctgagcttcatgggctgctgcagggcagagaagcggaagctggcctcggcctcacagcagcagagtggagctatgtgtttgcaagcagacctcagaaaaccggagcttaagaaagtttccccacagccagtgaggcaggaaataaccaacccattgtacagaggagaggaggaagccaaagctcaaagaacccgagtccaagcacctttcctgtgctgcctgacacgtttgtgccctccattatctactcgttcagcgcacattcactgcccactgggcctgttccagcgaccaaagcacgccaaggggagaagcaggcagagatctccatttcagtgggctgacagcccaccaagatgcccgtggtcccacccttcagagaaccttgctttcacctcaacaatccttcctgtttggagatggtgtatgttgatctgcaacatacccattagctacgtagccattaacaaaaacaaacaacactgacaactaccatttattgagcacaaactgaataccggtcctctac

SEQ ID NO: 470449 - DNA, 809 bp, Homo sapiens
tggacttaccctccactgtgagagttacctgaagcttggcgtctgtgatggtccagggggcttctgaggcgattgggcagcgtcagtcttcagctgctaagctgagaagatctgggaaggagtcagtcacagagccttgggccagagttccagggactctggaagtggctgccagcgcaccatattaccttctagaaatgcaaaatgtcaacacagaagtcaccagactccatgtggttattgataatgatcacaactgcaataaaaataaggggtgtcctgagctacttgaccctcaggtgaccaggagactgtcttggcctgtgaacatctcggagctgagtggggcacgagctcacagacgcactgtgacaataggatatgatgtgtctatcatgcagatgtcagcaccagagagtggacagagcaggagaggcaggatcaagtcggcctggaggagaggccagcaagggcatcctggaccagtcacctgtgttccctcgctggcggcagccatgattgctaattccttgggtatccttccagagatattctacgcatagataagcatataggtcactttcttaagcatatattgctttttgttttttcaaataaagtttttattttggaatgtttttagatttatagaaaagttgcagggatagtacagtgactttctataaacactttgcctggttttccctaacgttaacatcttacacaatgcagctgattagacggtgcctacccagattgagggtgggtctgccagtccactgactcgaatgttaatctcctttggcaac

SEQ ID NO: 470450 - DNA, 2191 bp, Homo sapiens
ccagggtccacagacaggcacacagagtcccatctcctgtgcagcgcatgggactcctgggcctgtgtccagtccccttgctcctgacgaacatgctcctggtggccttccagtccatggagaccatcgacagggctggacagacctggccacagaggactctcttggggctgctgctgggcgttggggatgtgaagttcccgcagtgtctagcggcccccgcaggtcccacccgagaggcccctgaatctcacgcccctcagaggcagcccctgggggaggtcctgggctccttctcttccccagcacaggggtccctgagtcctttgtactccagtggggtccactttgccagcttccgaaatgcatcactgatgtctctgggcagtgccagggtgctgtcccggcctctttctcccttggcaggccgagtgcccggatcgacgcttttcctgggtccccttggcctggcgatgaggctcccgctcctgcaggccaaggcttggcctatgcacctgccgcgcacgtcccggagtggggtggggggggaaggggatcggtcttcaaacagagggtcccgaggcccgcgcgccgccctgtccctgccctgcgtcccgaacggccaccgccgccgcatcctccccgcgcagaggcagtggcctcggaggcggagtgggcgggggagggggaggggggagggcgtccagaccccgcccccggtcccgccccgcgcccgctcccaggctgcgggaccgccgggcgcagagcacaagccgggcacccacggactgagcggcgcgcgggccgagatgcgcgcccgcctgctgcccccgctcccgggcctggagcggcgcgaccccatggcaggtagcggcggcctgggcggcggggccgggggcggccagggcgcaggggccgggcaaggggccgctctgcgggcgtcccgcgcgccgatgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggatggacgtgggggtgcggcagcctcagctgaagcagcccgcgctggtggctgctcatccccaagcttggacccagcgcctgcagagaggaccctgcccaaggccagttggggagtcagtgggggtggcaggacccagacgcttctccaggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactacgcccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccctggtccggcgcctgcaggagttctaccggcccttcaaccgcaggactatccatctgacagtgaagatcctgggcccaaaatgagggaatgagggccagagacctaggttaaaaaccaggatctcaaaatgcaccctccagattttaatttatgtagccaaggtgtgtagtaggctatgccatataggatttttggtttttctttttctttttctttttctgaggagtttcgttct

SEQ ID NO: 470451 - DNA, 1324 bp, Homo sapiens
ctgagggaactcagagaccggtgccagtgcaggtccttagtatgctgagcgccggtcccctgggcccactgttgtttctctatactttgtctctgtgtcttatttcttttctcagtctctcgtcccacccgactggaaatacccacagcccccaccaggatcaccacccctgcactgctgtggctgagatccccaggcgccagcaggcctccagccacccagctaccggcctgagcctggtagacagccctggggacaaaaccctgcacacaggggcccagtttgcaggcgaaggccagtctgctcttgggcctgagtccactctcggggaaacactggccccagcagctccctccctgccgcagcagagccgccttccacaggacctgcccacagagcccttcccagagccactgctcctcctgcagggagaagcagaaagggacaggtgtgggcatagaggacctgaactggctgcctagaacagtattgggagccctgtgcaccccctgccagacccgccatcaccaaatgactcagcatggcaggacaaggaccctgatcagaggccactggcagccggccacatgtggcctggagtggctcaggtccctggcggcagaggacacagggcttctcccagctgtgtggcctcagactaatcgcgttctctgagtcccccttgtctccccagaagaatgaggctaaggagagtacctgctgcactgggctccagggagattctggcagctagcctcagttctggcccccagcagggcagagatggagacatttgctagaacaggaggctgccacagcacatgctgggggaggggcaagcagcaggaagccccttctgggcactgcccctcctgtggggggacgctgccttccattgagggtgcctcttccaattgtacacccggaaccggggatgaccacgggacaggtccactgggatcggacccgagccaacgctccctcagtcactgggccttcataagcccctactctgacccagtgacgtctgactccagagttagcatcggttcagagccagcatccaggagtccccagaaggtctcatgatctccttttccccagtgcactgccatagagatccctttggagaaggctgggaaaagacgaacaggataaatttggggggtccttcctcaaggcaccctggtcccctccatacagcggtgtgggtctgaatggaggttttaggtctgtgacctggctccagtctgggaattcactgagggccgtggttctggtttttctcgggagatgggttttttgtttgtttgattggttgggg

SEQ ID NO: 470452 - DNA, 615 bp, Homo sapiens
agcaacttgtcaaccatcacacaagtatcccgtagcccagaagtcccacagtctggtgtcttcaagctggaggcccgggaagctggtggtatggctccggttaaagctctaaggcttgaggaacagaggaagaatttgtgtcagtcccagcctgagtctgcaggcccaggaaccagcagcactgatgtccaagggcaggagaagatggatgtcccagctcaagctgagagagaggtggagagagagagagagaaagagagaggtgagtgtcggaggagacctagaaagtcaccttttaaaagagagttgctctcctctcctgtgctgacaccttctctctgctgcatcccttcttgtgcttctgcatccaccctgctgtgcgaagtgttgcatgggagcagaccccatcatccatgcatatggaattccttagagcaggggtcctccatgcttcctatcaaaactgtgttcatcctgaatgaagagtcggctttccatcagagagactatagaagggactggaaataatgagaggcaatgctcagccgtttttgctacacatgaggtgctatagtaagagctttctttacatgcttcaacccattgactcgtcat

SEQ ID NO: 470453 - DNA, 1128 bp, Homo sapiens
gctaccccttgcgccccatgactcgccacaacgccatgcccaatcccaatgggcaattgccatgtgggtctgcccaaaggaatgggaggtcccccatgggaattactggcactcgccttgattcacaaaggcaccacacgtagtaatgtacgtgtgggcaatacaacttgggttcttacatgtggtgccccaaagatacttcccaaaagggccaaagcccaacgaaaaaaggtgcaaacggttcaaccacctagtccaagtaatagtgaccacccccgtaatatgggctatgccccagggaatgctgcctgttcaaatttgcttgctcttgctgctcgttttgctcagcactgcaggacccgtcatgctctgctctggctttctgcagcgatgctcatgctcccatgccgctgcccaagacttaatggaaccctcatttgtgtctaccgtggaaaaggagtggaaaaatgtagttgaaatggggagagatttggggaggaaataattcagtctggaatcctgggggagctgcatgccaggtcctgctccaggtgctggggaatcccagtgtggcttggttttccaaggcagacaggaattccaccatgtctcctttgctttagaatttactgttttttagagatttaaaacccattagggaatggcttgagaagttaataatgtgttaccattctggagaattatatttgatgttgtttatagctatttggcttatgaaaataaatacattaagattgggagccaattcttattcatgctacttattgaaggcagatcatacaataataaataaatgccattaatcttaaacccacacggggagaatttcgttttttaaaattaattgtacttgtggtattgtttttaaactagaacctaaaaaaaagtgcaataatacattaaactttgcatctctggtacagaattcgatttgtgtgggaaaaacaaattaactgtgaaatgtaaccaggaaaagtaatgttgattacaaggagcacataattagggcagctcagatatgcactagattcctctaccaaggcccctaccaagcctgaactctagtgaacaggtattcaatttggctttaattatcatgttagtgtc

SEQ ID NO: 470454 - DNA, 1749 bp, Homo sapiens
gcataagaggaggaggaaagggaaggggtggagaagtgggaagaggaataggagagggataaggaggaggagagggagcaggaggaggaggagagggagcaggaggaggagagtctccggctggggctctgcattggccacatgcaaagagatatgatgagccaagggagtcctttgatgcagtccatgcaggtcaagcttccagaatagaggcaggagagaggagagcaaggggtggacttgggcaggggcaagaagtgatgaacagctctaaggaagaggactatgaaagtctggagaagccctgactttgacccaactgctatctctcttgcatcattgtgcctacaagttacagggatggctcagaggccatggcctatggctgctcaagagaagtacaacgacttttccatcgcctcattaaaatgcaattgtgtgattcatcaacactattggagaaagctgttagataaaataaagggggagaaattagtatttgcaaagacaagattgcttgggatgttttacagaccccaaattccagcaaccagtttgaagacccccatagaggaacaggatgagtatgagatcacggcttcttcctctccatttcatgacttcacgcttcaccctgcgctcttcaaccaatcgataatcgccacactttggcccactccaaaacccttaaaaaccctagccccaaactccttggggagatatatttgaggttccctcccatctccttgttcagtgaccctctgattaaacctctgactctgctgcatcccagtgtctcagagtattgactcactgtgtgctttgggcagtggacttactacacctacacattcgtgactgcttttaccattaaacaccatttgttagatgattacttagtattccattgtgtaattgaggaagcagaggttcagaataatgaaggagcttggccctgacacccagccagggctggggttaaaaagcccacaggatcccttcctcaggccccatggaaaggtctgagtggtacctgccacttgctctccttgggccagtcatgggtcagtcaggctgcttgacattcaaaggtcaggcgggaacaagccgaggggtcagtagcccatccttatggcacctgatgtgcggctgcacacagccctggggtctcacccctccttcctacatctcaccttcttttcatcgtcctatcttccaacataccccgcagaggacctgggatgtcacaggggagctagatgtctcagaattagaacggaatcgagttcaatactagataggcagctattgatagcctggaggagagcaggaggactgacaagctaagaccccaggggagggctgggccatgttcccataggggctggaggcattgcctggctttcccagactgcccttcatgactgcaggtcattttctcctgcttttgtctccatttctcccctattctatgccggcccctctgacattttttcctttggtccatttttcccttgtgattccatttgcttttgagtttcttgttctcttccctccgctctacacattgcccatcccacctgactccccttccttgctcccctctctggccatgcctctctccatcctggctgtctctccctgattctccctgttgccctcattggcccctttccactctgcttctgcctttacaggcttggctgggtccactcagcctctgtcagaagccaccaccctccctagctc

SEQ ID NO: 470455 - DNA, 752 bp, Homo sapiens
tgtcaggaaggacagcagcggcttctagaaaattcttccgttcgctggacgcgagcagccagccaagtcaagcccggtctctggcgctcccggcctcttgtgatgtccctgctatcaatcagctttgggataatgctgctcctgtcagctggcctcctcaagtcgccgttccttgtgtctgtggataaatctcagccacagccaaatctattaaagccagttaagagaatgaaaagacaaaatctgatgaatgcttttaccttggtggatataaaagttggcgggctcgataactctgagagtgatctatttgccaatagcaatactacattaagttggggaaatatcattcccttaaatgcaagggattgtatcacttataaaggcctcaaggatgtttttcatactgaaggttataaacaagtaaatattgctagtctagaagagaatgtttcaccatatggtggctttccctggcttggcttccaggggcatcctgagtcatcagaaaagtgtacaaatctggatgatgctatgaaaatccccttttcttggttggagttggaagatgacttgggtgggaaggactataggactccaaggtctgatgataacaggggttattctacttgccaataggtttagaaaacagttatgaggattcgattagctaaactatggaaagcccccacccatcatgtattagatgctcaatgaatggtagttatcttggtgtcaggggtagtagtggt

SEQ ID NO: 470456 - DNA, 2258 bp, Homo sapiens
cctgcatagccctggctcctgtcaaatgtctccgctgacagagcaaagactacagcttctcatgcctgagaaaaagaatccagaggagcatatagatggagagaatgagcctagagtggagccggcaagcaccgtctccctgagagggtctgtagagggcatggaactggttgtcattgtgtgcctctggctgcgcacacacactggagctcttattattatcatcaccatcaacattgccaccatcatcaccatcagtatcactgctaccattgtcaccaatgttaacaccattaccaccaacatcaacactgccattgtcaccaccattatcatcatcattgtcattatcactatcatcattgtcatcaccactattatcattgccactgtcatcaccatcaacatctccactgccattgtcactggtgtcaccatcatcactatcagtatcaccaccgtcatcatcgttaccgtcactaccatcatcaccattaccactgccattatcaccaatgtaaccgtcattaccatgaacatcaccactgccattgtcaccaatgtaagcaccatcaccatcaccatcaacatcattgtgctcataaatatcaccatcatcactgtcatcaacagcaccaccaccattatcattaccatcatcttcatcatcaccactgcctttgtcaccagtgtcaccgttatcatcaagatcatcaacaacactatcattgtcatcactatcaatgtctccaccagcacgataatggttgtcatcattgtcatcactatcaccaccaccaccatcatcatcactatcattactccgtttctgtgcctgaactgtctgtggtcacagagatattacccctggctaggaaatatgatggaaccaccttttaatagcatccttatctcagtttaactgaaggaaggggtcaggaccctccatgggcaccaaggagacgtcttcaagccactctgcatttcatggcttccattactcaaacccagacagtgttagttctgaaatgacagaacaaagcagactattgcctgaattcattcttctcaatcacatctgaattccgtcctcacagaatgtcacagtgtgcctggttgccttggcattagcgatacaacttttctgaactttctttctccaaggctgttgaggacatctgttttgccatgccccacccttcagttccttcccgcttccgcatcttgacccttctcctgttttgatcactgaggcatgtgggtgtccattacctaatagagtagaagaggacttagttgtccatgtaataatctcatcctctttccctcaagcacctccttcatttaaaaaggtgggcagaggcaccagtgtgtgatgttccccttccctgtgtccatgtgttctcattgttcaactctcacttatgagtgagaacatgcagtgtttggttttctgttcctgtgttagtttgctgagaatgatcttctggtctttaaaaaatgttttcatacattatatttatacatattcatgaaaaaaaaaaaaaaaaaaaaaaagggaaatctaaaggaagtataaagcacattccattgatttcagtctgactgcaggttttccactggggcatttgaattgggagctggagtgggggtgcacagcatgtgaatcaggaagtatttatgactctgtgtaaacatatcacagtggaatgccaaacattagcttctgctgaaatcagctagctcatctaaaccttagctagaggggtttccttaatgtcaacattgatgcaaacaaccagggaagatggatgaactcaaagcaaaattgggtctacatggattttcttctctctgacaaagaacaggctaactcccacttactccacacaccccttcctccacaaggccttgcctgaatctcaagtttagaaaaaactcttttttgctgttgtcttgaaacaccttgaaatctaacagttctgttgccttattgtccttcttggtttaagtatgtgtcttatccattgggctgtaaacttcttgagtgtaggaactgtgccccttttgcacatagaaggtctgtgataattattcaggcaaggaaggatgaaagaaaaataaactcatgattgagggggaacttggcgtccaatatggatattaaggctagtcccagtgaaacatcccacttttagcacataactgttgtgcacctatgggtaacgttctgcgtagcaggcagtactcaaggcacc

SEQ ID NO: 470457 - DNA, 600 bp, Homo sapiens
gcaccgtgatgaacagtattgggggtgtagctctcgctatatgatgagaagagcatttcacttctgcagtgttgttccccacaactccaaaccccaggctaatcatgagaaacacatcagccaaacccagactggatgtacaggacgccggactgtaagcagcagccttgcagttgttcccagaagctggaggctgtttcaagggccaaaggtgagcttacagtcacctggtttccatggaaaccgaagcatcgccatgctctctccagagcgacttggcaaggccccaagctttatcaagttattcatgaaactctacctctctttgcagttccaaatgcaacaggaacagctgaagcagttgagggctaaaccaaattggatctggcattgcctgctgtgcatccgagatacgatgatcatctctattttacaaatgaggaaatgaggttttaaggatgttaaattaatttaaccaaggcttcacagtcagcaggtgacctgaaaatgaaaatgccggtcatcctgatgccagagtccattcaatatgcattttctgagccctacgaagtgaagtttaaggtacaggagattcatcac

SEQ ID NO: 470458 - DNA, 867 bp, Homo sapiens
gcaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggaggcacggaagaagaccatcccagtccttacccataggagccaagcccagctcatgatgggatcacagggcagacagcaattcattttgccccagggactggggtcccaggggtcgaggagctggctctatgggttttgaagtggaagtggccagttcccctctgaggttagagaagtggaccccttttattttcctgaatcagcaatccaagcctccactgaggagccctctgctgctcagaaccccaaaagggagattcaaaaga

SEQ ID NO: 470459 - DNA, 3237 bp, Homo sapiens
cctccctgggctgcaccaggccttgaggggggcactggcagactcctggcctaatattttctgaatttcagtccccacctccaaccatgcgtcctcgtacccctaatcgatgccccttctggctccttctgcaaatcctcttcttctcctttcagatcccagattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagccaaaacgagggggctggaaggctgagagggcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagaagagaggctgagaagctgggaacaggaggaggaggaggaagaggtcagggcaagagagccagggatggccagaggggcggagtcagagtggacctggcatggggagacggaggggaaggctggtgctgttgggccaaaggcggcaggggacaaccgggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagccccaggtcctgggcactgaaagaacagaagaggctgctgagagccagaccgcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccaaggacctgagctgatggggggcgcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccaggacgcgggatgtggaactgaggagggagaggcgtctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtgggcctcccggaccgtgaggatgcacagactggctctgtggctgctgggattatggggggtgatgtggtcccacacatcagcgctgctggcgctggtgaagctttggaaggggcgcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgccccctttcctgcaggccccgctccccgggtccctcctagacgtctctgtcccaaggagtcgcgtgcacctctcgagaagctcctcacagcgtcgctcccggccctcttttcgtcggactccggcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcac

SEQ ID NO: 470460 - DNA, 653 bp, Homo sapiens
gagttcgtatgagagttgtctttatgcagggagcgaatgccagtgtctgcctgaatctggaaggtgggagtcaccatctggtttgaaggcagggggtgcctgtttgagcacccagaggcctggatgggaaagaaaaggcccctccacccacctccacagacagctttcccagctacacctcccctgcgctgccctgagcagacaggctccaaccatggagagaatggctgtgtgtgtgtctttggtcttgacacccatatatatcgacgtgacccacagcccaaagcgcttacacgacctcgttctgccctgggcacctgcgtcccgtgtctctgtatccacacgccttgggctcccgtcctggccacacactcgtctccctcgggtaatggaaatgtcagcttgattcatggagattcatctgcggcagccaggcctgaagacgaggcacgctgcgggaggatcatcccctgtgaagagctgctgcagcaagggtgtcaagcccctgcctgggaggatgtgaggatggaagaaagcccctgaggctggcctgtgccgccgtgtcaaccacggtccttgcaggccagtgttgacatcactccctgacatcacttgtctggcccctgaataacaggactccaccccagggctct

SEQ ID NO: 470461 - DNA, 970 bp, Homo sapiens
tgcctacccgggccttcctgtggtgggagcctgcggctgcctagttggtgttcctctgcccagaaatgggccttggcatcacagcatttctcagcatcacttaccatcttctaacatactttgtaatatacctccttatagggttattaatcatggctttctccttcagctggaatgtaagctccataaaggcagggatcattgcctctgatttatccaagtacctagaacagcactggcaaggagtagacactgaagatgctcgtccagtggttgtgtggaagggagaagaggatcaggaagacacaatccaggcacttcataatggccagttccactctggattccaaagagccaacaagtcacctgctgtacatgtcactcaccctcatgtgggcactgagcttcctgaggctgtgactatgtgtctggggactggcgattggcctttgcacaggattcaagtcacaaccatcagcggtgctatgcagcaggactcagccttgacacgggctgctctttgtcaggagaggggagtgtctcccacagtgaaagtcatgtcaaacagggctgcccggtgaccaaggaggatggtagcttctgtgttcttctccacattccctcatcagaccacgatgttaagtctcactggagccatattttccatgaggtgtcagcatcccggacacatttcaaatggtgtagttgctttcctcggataattctccagggacagtctgggtccaggcaactgatattagtaatactctggttgtttccaaacttggttcaattattccaattgtttttattctttttctcatcctaatgtaaatccttcctcttccccctcccctccccatccctcccttcctcctttcctcctttcctcctttccttccttccttccttccttccttccttccttccttccttccttccttccttccttccttccttctttcctggg

SEQ ID NO: 470462 - DNA, 422 bp, Homo sapiens
agaagggctatggcgactgttcaccgcaggagggctctgcgctgtctgaaaaggggaacagaatgccccagtggaagcagatttgcagatgagtttgcagcatggcagcccctgggtggcgtctccatccccgacgctgagcagtactcatgctctcagagctcgctgcgcagagaaatagccgtaacagacccggagctcaatattcaggggatcccagagctggctgtgcagagcaatggccataacagacccggagctcaacactcagaggatctgcgaggggacacccgggagcccacaacccactggcccctcatccctccctttgccggaggctaccccgtgtccctccctgtgtcctgagggctgcccccaccctgcacaccttctgcaccctccgagcctctgcccctcactgg

SEQ ID NO: 470463 - DNA, 873 bp, Homo sapiens
tgtggtaaccctgactctcaatccaaactctcaaaatgtatccaaagccacctccaacttgcaacccctgtcctggccctgatcactgtgctctaacctcactgtcctgctttcatgcttgttcccaaatttacatttgcttctcctctgcctggaagacccttcttccagatctgcacaggaccagccccttcccatcatccaagtctcagttcagattgtcacctcctcagaaaggtcttccccagccatcctgtctaaggctttatacaggattccttccaagaccccagtgcaaccagaaccatttcaagagagtgattatctactgtgagaagttaccactgcttaaaaatacaggtgccctgggttcgaatcccagctttgccattcatcagctgtttggcctttggcaaattgctgagctctctgaccttcagttttctcatccataaaatgagaataacgatggtatcttcctcataggactgttgtaaagactaaaaatacaaagacaacttagtactatgaagttttaaaaatgtatttatcaaattcatcagggaatttaacgtacgataaggtagtatttcatttcaatggtgaaattataaagtattaaacattattgagattactgactagccttttgaatgaatagcactaggtcctcaactcacttttaataccataataaatcttaaaggataaaaaaggattttaaaaggacttttaaaggtttaaaagttatgttgaaatttcatgaattttaagatttgtaatggaaaatctttataattgtggcatgaaatccagaagctgtaaaagaaaaggttaaagacaaatacttttaccctctaaaaatatttaaac

SEQ ID NO: 470464 - DNA, 2221 bp, Homo sapiens
gtgaggcccagtggtcatctgggccaggccttgatgctgaggccatggaacaggtggcagacactggcttcccctcttgctctcacaactgtcctgtgacctggtgtctgagctgtgagcccatcacttcccaggcctctcagtgctttcttggacagattctgggatcattcactggtgactgccctgctagggtgtcagctgtcagatcccccagcaaccccccaactgagctctgccctcgagcactcactgtgggctcccgaccgtcactgtctccagggccaagggctggaacctccacctgcctcaccaacaacattctcaggatcgattgccactggtctgccccagagctgggacagggctccagccccgggctcctcttcaccagggatcacatcgttggggtgacctggctcatacttggagcctttgagctggaccctggctttatccatgaggccgggctgcgtgtccagatggccatgctggaggatgacggggcacaggaggagcgttacacaggccagtggagcgagtgtagccagcccgtgtgcttccaggctccccagagacaagatgggaagagtgaggcccaggagtgtggctcacacaaggtccttcagcaggtgacacaaacctccaaggcccatcacaaggtccttcagcagatgacacaaacctccaaggcccatcacaaggtccttcagcagatgacacaaacctccaaggcccatcacaaggtccttcagcaggtgacacaaacctccaaggcccatcacaaaccttccactttggcccagggcactaaagggcgcacctttgccagcaaggcttggtcctggatgtcctgggtccctgacttgccagatgaatcatgtccgttttgggaaaatggacttaagtctccggagcccttgtctgggactgaacctcctgagaatgggcccctagcagtggtcggaggtcctgtctggatggaggctcaggggcagctttagggagaaaggatccctctgctcagtgcctgtggggagcagcctctaccctcagcatctgcccacaggttcttccttccgctgtcccttttctttatccccggcctctctgagaagaggggtgtggtctctcagctgttccaccatcatccccttaagcggccagcctgggcccagtggacacagaaactgagagatgaggctggagctcccagtcagtgctagaaatgaccatccagcagtgatggtggcctgtgaagggtccttcttctgtcctcagcctctcatggggtgggcttggggaagagctgtggtctggagagagcggcagatggagcagaacgtgcctgcatttgtttcctagggctgccgtaacaaagtgccacaaaatgggtagcttagaaccatagagatttgctgtcttagttccgaagtccagaagttggaaataaagatgttggcagcgttcctgactacaggttcttaggctcccatgaaacagaagttgatacaaggccaagcaagcttctcagacaaggctttattaagtcttatgcccctaaaggctgggcagaaaagagacgtattaagtcttatgccctaaaggttggccaggaggaaggattcttggctggttccccatggggagtgcgttgtggtatcttgagggtgacatgcataatttatgagttaggtgtctatcttttaattgggttgtttttctttttgttattagaatttgtttgtatatttagcacacaagtctttttctggtttgtttttaaaatattttctctcagtctgtggcttgttttttgattctcttaatgggatatttcacagagtagtcattttaaattttaataaagtccacattatcatttttttattttatgaactggcttttgatattgtatctaaagactcatcaccaatccaaactcatatggattttttctataatttttacaattttatatttgaaaatttaagtctacagactatcttgagtgattttttaggggtgagctatgaagtttgtatctacgttcattttttcccctatggtttgattgttcagtcgccatctgtggaacagacttttctttccccattgaatatttttgcccctttgacaaaagcagttgactatatttatttgggtcttttgggttctgtattctattccgttcatctatttgtccattccttcaccaata

SEQ ID NO: 470465 - DNA, 758 bp, Homo sapiens
gtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggagcccagagcattgttatttcaacagaaacactttaaaaaataaactaaaatcc

SEQ ID NO: 470466 - DNA, 1537 bp, Homo sapiens
aagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcggggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagcgctcgccgcagctcctgggccactgcctgctggtaaccctcgcccggcactaccccggagacttcagccccgcgctgcaggcgtcgctggacaagttcctgagccacgttatctcggcgttggtttccgagagcagccttcttgccgtgctctctcgaggtcaggacgcgagaggaaggcgccgcccctccccaaggaaaggcgagggcctggggcacacccccagtgcccagatccaggcgcgcctctttccacctccagcaggtttggggcctcggccatgggggcaccgaactgcgtgcagcctgaccctcccgaatggggtggtaggtgagggccgcgggacgccccgggcggcgggctgcgaggacggccgactctgcccatcccgagggcggctggcttcgccctccccactctgcgccgagcacgcggcccggacccaccgcgagaactccgcacctgcagcgtgaacgcacgcgggcggcgttaagggctcggggctgactcggagcaggttagggaacagcgccccctcccggcgcgagccggtacctgcgcagcacccagccgccgcggctgtggcctggaatcggggacctggggtgccggggggttgtggtgaaggaggtgggaccagccccagcacctagccacgtagctggcgaggtggaccaggaaccgacccagacccctgccgtcacccgacatcactacggagagtgaagcttttttatatttgtccacataaaaccaatcatggtcattgtagaacttccgaaaacaaggcttgctgcaccttcctgtgtatcccaggtccaggaatgggtgcagcacatccttcagctgccgcttgacacgcggcaaactgtgtcatgtgtaaacaagaacaggacatggctgtcatatccaagagcacatgtgtaacacagacatgccacacacacacacacacacacacacacacacacacacacacacacacggggtagaggcaggcctcatccacacccctaacatttgatgc

SEQ ID NO: 470467 - DNA, 584 bp, Homo sapiens
ggctccatcccctgctcagaaccgggctcatcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagcgcaggcggcggctgcgggcctgggccgcactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccggcctctgggacctcctggtgcttctgcttcctgtgctgccagcaacttctggaaacgtccctgtccccggtgctgaagtcctggaatcca

SEQ ID NO: 470468 - DNA, 506 bp, Homo sapiens
cctgtgaggaggaggttgcaaaggaaccaatcggagagagagggtaagatggggatagaagttctcactctggtcatgggctctatccagatctggcagctcagttttcaggctttatattatctctggtttgcagcaacacctttaacattgtatgtatataaagaagagataggagccatgacagctgcaaaagaaagaatgaaagaaaatgtgaaaggaaagactggaggttctagtgctgacaccataatgggctgtcagggactggagtcagtcctggtatctttggtgatcctggatgagcctaattgctacaggattccttcagtgccgcttcacctgctggaaatctctctagccaccatgacttccatttgggaccttgctcaggcctgccaagctcactccacccgctcagcccagcaggctgtgcttggcttgcaccctggcccagatcccatacctgaccagggactctgcacttagtctgtggctggaccaag

SEQ ID NO: 470469 - DNA, 1410 bp, Homo sapiens
cctgcagtagtagcagcagcgcctcttcataaagatgacgcccttcaagactttggtaacctctgacgttgtagcagagaaaaatgagcagaaaggcagttcacagcctgaactctttttccccaattccctgaaaatcaagggatcaccttttgccctcttgcagctggagtacaagtgggcatcatctagagtccaggggttacccccacagtcacaggaaggcacattctcaaggtcatctccttggaaaaccaacctattcaatgatgtaatggaaggaacactggacttgcgggcaggagcctgggccatgtggtctagcctattgctcctgggctacaaacctgtaccgcatgttactgtactgagtgctgtagatgattgtaacacaaagataatattagtgtatctaaatgtagctaaacatagaaaaggttatattccaacctaagacatcatgagtgatgaaatagcctctttcatctcagtgagacttgaagttaaatgttctttattgttttctgcattaacacaaggtacattttccttattgcctgatactaacaaattaagatccgcatctagtgggttgccaaaagtaactatgatagagacctttatgtactactcatggagattctaatttgaaagttccagggaaagacgtgcaaatgttactttttacaataggccctggctaaatacttgacttggctttagaaataatagaaattattcatattttcaccaaaactatgcccatcccatcctttgagttgaattcacttcatacagttttgaaattgtttttcttaaatgctcaaagcccacatttctgttttggagatagtatgaaatagcacaaaatgaagatacagaaaaagagaaaattgaaaagaactactgaaaagcaagtaagaaatgaagaactgattagttagtggtaggtcagttgaacagttcagtgtggcttgtgggaaccatatggggtgattgtcactttactaggatctttcaataaaccaaataagtgatatggcttaccttctggtgttggtaagcaaaaatgtctgataccagaatgcacgtgcatttcaggaccataatatatcatgatattttgcatataggtgatgacccagtgaaaggttctgtactttattgttttcaactctgaaaaggatattttgtaagaggtcatcaaaaataaaatgtttaatatattatgtcaagaatttttgttaatagtccaatatttgtagctatagggcaatattactaaatagatgttttgtgttgttaagtggtataaataaagttcttattccctaataccagtaggtgaagatcatctgataaatggctcttcaaagtatatcttaaatcagaaatgacctaagaaattcc

SEQ ID NO: 470470 - DNA, 599 bp, Homo sapiens
aaccttagaatgagtagtgtatactcattactcatccccagtgtctttggttggctgctagtgagaagtgtttggatcctgcagctttatgaaatacagaactcatgccccgtgttttcaactgttaccctgatcagtaagcatggcatttgttcgttcttctctgagaacatcttgtctttgtatcaggttccaggagcaacaaagccagcagtgactcagcccgaatccccaaaccttagaagtggggaagccgacaattgcagccttcagtctatggccaaaggcccaagagcccctggcaaaccactggtccgcgctggcagccaattggatggtgcccacccacactgtgggtgggtctttgggaggcaggacagctcaaatcatgctgaggatgaccttcaattaagcagctttcatgagctctggctgtctccagctctgtttcagaaatcatccaaaataagtgtcatttatacatctgtatttgagtgagtgtttacattgctaaaaacatgaactgggagaggcccagcattgctaagcttccagttcacatgattagccgagagaaataggagggcagagagataccc

SEQ ID NO: 470471 - DNA, 2719 bp, Homo sapiens
ggatcctgctggaaagccacctttgtcagtgtgggaagccaggcacctcatcaacgagggaagataaatacgtatcatgggagaggagacggaaaagaaagacctggactcaacgccagaaaacctcactttgaatcccagaccttctgacagaatcaaggagaggagaattaaggtccgcttcttgaagagaggaatatcgaataatctgtggacgtattttcaaaccaccagaatcctggaggaggatttcagacaaagcagtgacattgatctgcaacaggaaaaggtcaatctgaaaacagggttcatgggatggctgttggctgggccacttgtcttccagtatttagcagggcttattcacatcaagtcttcaggattcccacagcagccaaaagaggaaaactcacaatgcacaatttattttcaagcttcgaattgcatcacgtttgctaaagtagaagacgatatggcaaattcactcaccagaaaattgtactatgagttttttgtttttgtttttgttttacataagagaaaagaagaagtcgatgtgcttgaccctagatatttgatccctgttggtgattcttggtcatctggtgttgtgatcctcgttagcagaaccgcatctgcatagatagcactttgatgcacatcagagcccaaaacacttgaattttccaacaacgagaacatcgggtgtttctcttggtgtgtgctaatggtatggactgattttgcagaatcactgaagcaagctgtaaatgatgtatgaaatgaaaaactcctgtccagtgcacagagcgaatatatacagttctgtgtaatcactgtggtgctgggctatttgttttaatatttccttcagacatatagcagtttttttggtgagtcatatccagacacttgccattggcacatagctcaggtttctgttacatatattttaaataaatttcaatgttgtataagtgtacttgaattaatgcaataccagattttagaagacttgacctttataaaatagtatttttatgaaaacaatatcaacatttttgttctgaaaaatttggaaaatactgaagagcctaagtagcaaaattggaaatcattttatgccattatggagaaatagccattgtttacattttgtatatattctttaaggtatttttacccactgtaattagaatatactctttgaaaaaattatccgatgcacttcttttacactttcattcccaataaccaatagggcttgaacatctcccaatggtcttctacagtgtgacttttactcactgcatgctgttcacacatgcgtgtaacacagaaaagttttactcattcctgttatcgaaaaatgaacatttagtttttttctgattttgctaatataaataatttcctgtatcactactgtaatgtttatgtgatttcagtaattttggtgtatatttggtaatgccaaacttgtctctgttcttctcttacaaaattttctttacttttgcatttgtttttccctgttgggttttgacaatgactggattatatttataaattattggagtagactggtatctgtgtaatattgagtcattccattggaggacatagagtgtctctatttatgggtaaattttctaacatgaattcatccttatgtaccagaaataaacctccctaagtcacaagagtattttatttagggtttctgcatattatatactagtataattatttttttgtgccatctttgtttaggaggagaagttgtttgaagcctctaattttctttcaagattaattgacctgttcaggttgttttctatttctatttgaatcaagtttgatgatttatattttcctgttgaaatatcagttcatttaaatttatttttatagatgcaaacaaaatattgttatagttaaaataattctagaaatctattgttaaatcacttttcttattcttaatatatctttttttgtgattagctatgccaaaggtagtgtggaagagccaggtctaaagtttactatttccagttgttctgttttcctactagcttttaaagttgcatgcttagttaattcattttttgttgttgttgttgtttattaataaaaatatttaaaactatgaactttgctatgatttttagcttagctgcatcatataacttttgctgttatattcttactttatccattgtttaataacctaaagtgatattctgatagcctctaagatccaaaattcttttataagagtaattttaaattttaaagtggttgattttatgacatcatgttattattaatttacagttttatttaattgcctcctaaaatatacctgtgatgatttttacttaaattttgttgacatattttggggatagtatgtataaacatctttggaaaagaatccatggtcactggaaatgaaggctattttccttaagatagagaattaactaattataaagctccactgtatcctttggtcttctttgaccaactgtgaggaatgttaaagtcctttatgaagttggtcttactattctttaacttttacttctagagatattctcattctgagagtcagtgttgcgttatttgacacatgaatattgcatatttgtgttgaattgtattcccttaatataaagtctgtctttgcccacttcttgtgttttgccttgca

SEQ ID NO: 470472 - DNA, 597 bp, Homo sapiens
ttggaccctgtactcagaccatacacaaatattaacaacaaaaggcgataagaaaaacatgaaaaccttatcttggaaacaaaagcacatttctaagtatttcatggctcaaagagaaactatcatggacattagaaaatatttggaactacacgataaaatatcgcatgccaatgttaggcttgtgggcggccagtggttccagcatcatttattgaaaagggctgttattcactactctaggatccacagcccacggaagactcacagaattgcattggctttccaccggcagctcacccacggctgtctgtcggagccggacagcggggcatggagagtggcccagaatggagacgataatttaccatccagctcgatcctgtggctagaggggggccagctccatgctgcagcctcgcgcaatggcaatgacggtggtgaatgggactcacctggacttacccggtgggaagagggcttttctcccttttctctttccttcccctttcttgtccaactgtgggaggaagagaggacgtcgaaaatcaagttccacacgggttgatttcatcagtcaacgggttgatttttggg

SEQ ID NO: 470473 - DNA, 760 bp, Homo sapiens
ccccgagcggcagcctccccacggaaagaacccaactttcctcttatccttcatgaaagcgcaggacatagattggtctatattctcacttgtcactttcttgcctgccgcggtgctgggagctatccgggaacacttctcggtgcagctcaaacgcaaattccaggacagaatcaaggagaggagaattaaggtccgcttcttgaagagaggaatatcgaataatctgtggacgtattttcaaaccaccagaatcctggaggaggatttcagacaaagcagtgacattgatctgcaacaggaaaaggtcaatctgaaaacagggttcatggattcccacagcagccaaaagaggaaaactcacaatgcacaatttattttcaagcttcgaattgcatcacgtttgctaaagataggatgcattggtggccccagatgcacaagtgatattggcaaagcagaaatgggctatggatgtcaaagagatgctgctgtcccttattcttggatggagaagtttgatgatacccagaaagatccaaatgtgatggtgcaggtagaagagggatcacccactttggctcatgtgatgggagtcacgtgttaaagacggcaaagcatcaagagagaaggatcttaattgccaataaaaatatgcggccactacacctaccctagactttcatgtaagagagaaatagacttctgtcttgtttaagtcagtattagttttagtatcttggttaaatcatcctcacct

SEQ ID NO: 470474 - DNA, 1351 bp, Homo sapiens
ttcctgcctgctggctctgaagagagcagtggatctcccagcacagcactcgagctctcctaaggggcagactgcctcctcaagtgggtccctgacgcctgtgcttcctgaccgggagacacctctcagcatgtgtcaacagataccttatacaggagagctccagctggcatctggtgggtgcccctctgggacaaagcttccagaggaaggagcaggcagcaatctttgctgttctgcagcctccactggtgatacccaggcaaacaggaagaggaaataccagtgcaaaaatgctgaaaattccaaaaaccagaatgcttcttctcctcaaaaggatcacaactacttaccagcaagggaacaaaactggatggagaatgtgtttgaaaaattgacagaagtagacttcagaaagtgggtaataacaaactcctctgagctaaatgagcatgttctaacccaatgcaaagaagctaagaaccttgataacaggttacaggaactgccaactagaataaccagtttagagaagaatataaatgacctgatggagctgaaaaacacagcacgagaacttcgtgaagcatacacaagtatcgatagccgaattgatcaagcagaagaaaaaatatcagagattgaagatcaacttaatgaaataaagcgtgaagagaagattagagaagaaagaatgaaaaggaatgaacaaagcctccaagaaatacgggactatgtgaaaagaccaaacctacatttgactggtgtacctgaaagtgactgggagaatggaaccaatttggaaaacacaattcaggatattatccaggagaacttccccaacatagcaagacaggccaacattcaaattcagaaaattcggagaacatcacaaagacacttcttgagaagagcaagacacataatcatcagattcaccaaggttgaaatgaaggaaaaaatgttaagggcagccagaaagaaaggtcaggttacccacaaagggaagtccattaggctatcagcagatttctctgcagagaccctacaagccagaagagagtggggaccaatattcaacattcttaaagaaaagaattttcaacccaaaatttcatatccagccaaactaagcttcataagtgaagaagaaataacatcctttacagacaagcaaacgctaagggattttgtcaccactaggcctgccttacaagagctcctgaaggaagcagtgaatatggaaaggaaaaaccagtaccagccactgcaaaaacataccaaaatgtaaaggccattgacactatgaagaaaccgcatcaactaatgtgcaaaataaccacctagcatc

SEQ ID NO: 470475 - DNA, 810 bp, Homo sapiens
tcatcacagctttggctttcttgttcaaatgatgcatgcagatttaggtgtcaggccagtaactagattatgtgatgcttttgttaaagatcttgctgttgattcccgggcaagatggctgaataggaacagctcgggtctgtggctccctaagagatcaacgcagaaggcgggtgatttctgcatttccaacggaggtacctggctcatctcattgggactggttagacagggggtgcagcccacagagggcgagtcgaagcagggtggggtgtcacttcacccgggaagcgcaaggggtcagggaactccctcccctaaccaatggaagccgtgagggactatgccttgaggaaccgtgcattccagcccagatgctatgcttttcccacagtcttcacaacccagagactaggaggagattctcttgggtgtctacacaaccagggccctgggtttcaaacacaaagctgggtggccatttgggcagacaccgagctagctgcaggagtttcttttcatattccagtggcgcctggaatgccagtgagagagaaccgttcactcccctggaaatggggcagaagccagggagctgagtgctcttgctcagcagatcccacctccacatggcccagcaagctaagatcccctggcttgaaattcttgctgccagcacatcagtttgaagtcgacctaggaggcttgagcttggtgtgggaaggggtgcccgccattactgaggcttgagtaggtggttttcccctcacagtgtaaacaaagcccctgggaagttcggactggttggaa

SEQ ID NO: 470476 - DNA, 665 bp, Homo sapiens
ctgaaatgataagatgcaaaattcaggcattagcagtgaccatgtattccactatgtaggagaagctcttgctgatgaaaagtggaggaacatcatcattccagacactgttcttcctccacatttccctgcttcatccaaaacactgatgcagccacttctccgggactctctccagagagctgaattttcctccaagctgcatttcccaggctcccgtgttagctggttttctgagtggattaagctaatgaagggtaatggcaggagactggaacacagaggaagacagaagctggggtatttctcccctttcctttctgccttgagtgatgtctctagcatcttctccatgctgtcagctcctgctagacaagctctgctgcagctcctgtttccaccgggtagacctagcccctggattccagaaacactgtctccatcctccctttatcccaccagcaagtggagactcaaagtggtttcagtactcctggttgaacctgaccgatacgacccttttctccattctcagcccatccgctacaagggaagttgactccacctgcagctgcaatagtgggcatgtgacttacactcggccaatcagaacatcttacacccctggctgtggtgactggttcaggaatttgcacatagcacaa

SEQ ID NO: 470477 - DNA, 547 bp, Homo sapiens
ctgcctaactggcttcctgctgaaggcaggccagacatcacctggacgatgatggaggatgagaaacctgaacagatatagagaggaagaaatggaagacatgggggtgtttgctgaagacaaacagtatttccatggagcacagcggttttgggtggatggggcacagcaggatcatttgggcacggagacaacgtgccttcttggttgtactggttgtcacactcccgctggagcctcctttatattcaagagctcctctgagtcccgtcttcccttgagcggtccagggcttaggtttattgtggcagatttggagccagcttcccaagccgtgcacatctgccctctgaacacatgctggctacctgcagacatcagctggggcttgggagccactgcccaacaagcagtgactggttgtatcctcagcgatacccacagccaaagtctgaaaccactgtctgttaagagtacatgggatccagaagaatggttgcctgaaatggagaggctgaaggcttacagcctttgacaaaatctcatt

SEQ ID NO: 470478 - DNA, 794 bp, Homo sapiens
gcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcagatgcaagtacaagctgacaaggggtcattagttcccgagtcagagaacaaaagcttaaatgccttcgtgcagcataatttctgcaatatattaccacctgatggaggatctgaacaggccaagataaaagtcatcctggtagatgtagaagacatctcccgccaaggggagagcagagaaaatccattcaggttgaaaacacaggcacctcaaaacagcagaagagaatcaaacaaaattggacaaacagcttttgtggagggagtgtccaggggacaccgaaagctgaaagaaaagtggaacaagatgaccacttgaaaatgtatctcaatatttaattattcatatggataaatgaagccgtcgcttcatgtgctttctcctctttctcatgacactcccatcttcctgg

SEQ ID NO: 470479 - DNA, 571 bp, Homo sapiens
agagtcagggatggggtgggggtttcccagggcagggtgcccatccacccagccctacatttttcagggactttacctgcaggctggaaatttactctggatctgggaccagaatcctatcctcaacctggtggcccttcctgtctttttcctcctttcaggagaaaattacatttcaatggacaaatggctcttcctagagaagggtgcaagattccactctcccaaggcccctcacagacttctagggacaaaggctccagagaggcacctagcaggggagccccatggggtcagcccagggaggcccagcaagggtggatccggctctgctgacttaatggattccttcccaccagctgtcctgggtgagaagctgctaaggcttctggagctggctggctcctaggtcgccctaactcgctgggctggcaggggttgtttatctcccagctcctctatgccccaccctgggttcaatgcatcaccagcttgtgcccagcccagtgcccggcacataagagatgaacaggagccctgtggaggccaccctttgcacccactcctgcct

SEQ ID NO: 470480 - DNA, 4117 bp, Homo sapiens
gcttaagacctgtacctggttcaagtcacggggcctggtactgtgcttgtgcatggtggacctcaagaaagagggagcaggtccagcagggatatgggccttggactggctccagggcctggtgaagcagtgtagcctggtggttaatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgcggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccgggtaagtgcagtccacctcatcctgctccctgctcctctccttggggctcctctggtccccacaggagccacgtaccctgagtgccgtgtttccaagaagcggcgctatcgcgcagtggcaaaacagaactgctgtgctgtagactccttgagtttgaacctcagcactgccattgcctttccagccatgtgatgggctcatgttatttatctctctgggtctcatttgtcaaatgctaatgtataaaatgggaataataattgtcccaacctcagagaattgttgtaagaggccgaggacatcatacaggtaatgtgcctggcacagtggctgatgcacagtgagggcaccatgggtggtggcttgtgtctttgttgttgagctggggtatgacatactcatttgcttattgggtctccttaggcaagtcactgacttctctgggccttagatccaggattcttttgacagttcatagagatcacacacacacaaggggccgagagcccagcactcatggctcagtggtgctggctgtcatcaccagctggtactcttatcaccagtggcatcatttcagttagtgcagttgctggtatgtggaaggccctttgatgtggtttcaattgctgttattgttaatgactgattgattcgttcatcaaattttccctgttcatcaaagcacccattatgtttggaggtgcctgggagccaaggagaaccagaaatggaccctgacttgggacttgtgga

SEQ ID NO: 470481 - DNA, 1687 bp, Homo sapiens
tccccatcttactgcacatgagcttgtgcccacagcatgctgtgtggggctgaggagccagaatttgaacctgctgctgcttgattgtgagtgagggcaccagagctctgagcctcctcgacattggcaaggctggtgctcaggcactctgtgtcccccggcgcctttgggtgaaggtttggggtctcagcggctcccagccccggtgctggggattggaggggggttagtgctggggtctatgggaggccttgtgagcacctgtctgggggacatggcatgctggtcactgactggtcacgggttttccttgcagaggaaggcatcaaccacgagtgtaagctgtgcaaccagatgttcgactccccggccaagctcctctgtcacctcattgagcacagcttcgagggcatgggcggcaccttcaaatgccccgtgtgtttcacagctcccatccatgctccaggatgcaggggtcaagggcagctctgccggccaagttcccagcccccagactggctgccggcccaggcgaatggctgtcccagcccgaggcaagtctcaggggctctgccggccccctcctgctgcccagatggcagccggtgtgcgtgggagagcctggccttccctgcctcccccgacatctgctgtctgccacggcaggaagcccaccctggggaggacgcctggcaggagggtatctctgaagtgctcacctcccagacacacagctgctctgggccacctcctgggtgcgctcagggctggggccacctcagaactcctgccactgggaagccagggctagaccttctccatgccaggcccaggggtgtccactctggggcaaatcccccaaacacacacccctggggctccccagagcccctgagcaccctgatgccatcttccccctcatcgcaggagcccccacccatcttcttcgtccaggccaacaagttgcagcagcacatctttgccgtgcacgggcaggaggacaagatctacgactgctcacagtgccctcagaagttcttcttccagaccgagctgcagccccctggcctctgccagcccagcgttctcaaaagaaccaactgccactggctgagcccagagcaggagtcagaagcttacatttgaggtgtttcgtggcaagtcctgtctgctcttggggattccaatttccctacctctattgtaaaatgatatttcactgagctttggttctgtggctagaagcccatgatgtctttgtggctgggtcctggggctgtgtgggaacaggagttaggtctggggccttggagcctccagttttgtccataaaagccagaaaagaagagtagtggtgcccgattgccccagcttagaggcagtcaccagaggtcctgagactgatgtggccctcaggagcacagttgccagtataagggaggtgtgagtcctctttgattccaagttcggagggctctgcccaaaagactgagattaattcaaaggagtttagacaaactgttgcaaattcacaaccgaataattaggaacatgagagggaactagctttcctattcatttgtttgaagcaagtatgtggagggcccatgatgtgccaggccctgtttctagcacctgagaagacagtggtgaaaagatgaagaaatacccacggggtctgcattct

SEQ ID NO: 470482 - DNA, 808 bp, Homo sapiens
actcccctaggggcctctcagaagaggacgctccccaccagtttgaggggcatgcctcagaaccaatcgctgcctggcacggctccctgggtgaggggcttgggcgcagtgccatatgagcagatggccgtgattgctggcaacccggagaccctgcaggagagtcgcgtatgggtgtttacagcatcctggtcccgccgcgagcatcaaaatggcagaccaagtggtgcccagcccatccagggtggggtaggggcagctcgctttcctgagaaaggagaaggaggtccccttcttctcctaaggagagtcctgcccagcgcccatggacagccagagggggccatgaagtcttcagtggatgaggctcattcattcattcaacaaatgtgtacagagcacctcatctttgtcagaccctgttccaggtgctgggatggatcaatgaaccaagcaatcgaaagccctgtcttcctggcacttccattcatgtggtcctggatagtgagaggaagttacaaagagcatggggcctggggcctgcatggtcagttcctggggccagcgggctcccaggagcctgactacaagctcagtccttgcctcgtgtccttcccccatcagctcaacctaaggcccaagttcatgggtccagtgggagtcaaaggaggaaacagccagcaactccctcctcgagcagcagcccggtccatcaggcaccctggtgtcagcagggtgcatcatcagctcctggaaggttaatgccagcccagatgctaggctctaggactgggagggggaatgagtc

SEQ ID NO: 470483 - DNA, 876 bp, Homo sapiens
gtctattggtgcacacgttcattggcgcacacgtccattgatgcacacgtctattgatgcacacgttcattggcgcacacgtctattgatgcacacgtctattggcgcacacgtccattggcacacacatctattggcgcacacgtctattggcgcacacgtccattggcacacacatctattggcgcacacgttcattggtgcacacgtctattggtgcacacgtctattggtgcacacatccattggtgcacacgtctattggtgcacacgtccattggtgcttacatctattggtgcacatgtgcatgcagttctgttcattcacgccgaaccccagaaaaaccttcagtctggcgctacaggtgcatctggtgtctgagaggtttgccatgagcagatgtggatttggtattagcagcttttccaaggggattgacgtgcctagttttggggatccctctcagaaaagcagcggctggaaaatcagctcctcgtctaccccagtgaactacgaaacagcccacatttgtatggagttcttggctgtcactgactgtgctccctgcttcacatgcaagctctcatgtgctcttcacagcactcctgctcagcacatactgtcattaaacccattctacaggcgaggaaacagaggcacagaaaggagaaaaaccagtttctcctatgctggttctgactcggatgtcaaggaccagtcttacggaagcacaatgatcacacagccgaggcttgttttctgattgcttactttctaaagggatgcactaagttggaaggaccacttgtagtgtgccagaggatggcatctggaggtgaagggtcccatgacagaaggagcctgaaggtggtggc

SEQ ID NO: 470484 - DNA, 456 bp, Homo sapiens
atgatgtatgtgcgcacatgtgtgcatgtatgtgagtcacagccaccttaaccaaattggtaccttcaccctcatgattgtgtcacaacacactgcgtcattgtcctgtgtcatggccatgatccaaaattgtcacatttctattgattccgtacctattgttactcttgaacaaggatctgcaaaccatgacccatgggtcaaatcgaacaaatccagtccactgcctatttttgtatggcccaagagcaacttaacagtcacgattcgagaagctgcctgctccgtgaagcacggtgactttcgggatatccaaccaggatcccagaacggatttctgcctgctctttgggctttctgctcagcttcaaaagaagcttctcgctggcatggaagtgtttgaatttgatggccactttgctttttttgaagagttagtttaaaccagaggtctca

SEQ ID NO: 470485 - DNA, 647 bp, Homo sapiens
ttattggaagggatgggagtggcagtaattgtagaaagggcagaacatgaaaaagtaacagctcctgtgaatgctgcaaagtgccaaagcctctccaagttggagttgttgacggcaatggctggctcaagtggcctgcgagggaggccggtgggcagtgatggatggactccaaggatggctttccagagagcagggcatggacatcttatcacctccagagtgaacatcctggtgatttacttcaccaccactcattctctggtaccatcccagagggtcctgtatgctgccctcaagagggctcgtgtgatcagcctcagtttgtcattctatatcaagttcaaagaatgcattaccatgaaggttgtctgaagaatcaaacgagactccatacatgtaggtactttgtaaactctggagttgctgtgcaaatgttagtcattattcttgtacacactaagactcaggcccagtctttccctccagaattacacgagttcagggtcacactggaactgttcatcaaaaacccttatttgcaaatctgacaacccagattcttcttcctgcacagttgtttgttgatgattaaattattgtaaattagttctacttgtagtataataaatgtcattagcatgact

SEQ ID NO: 470486 - DNA, 741 bp, Homo sapiens
cttccaagctgctccaaatgggtgaaaggaaggggagtcaaaacattttgcatctccaacatgttgactccaccaaaaacttcaataacgccttctcaatctttttctttctctgtttcctatttggggttcatatctgtcaacctctatgataaatgcatgactgaacttctactgtttactgatacagggaatgttcagattcatagaattcttcttttctgtcattctcttcaagaagaagcaacgttgacagacatagagcatctggggtcaggtgggaacctgagagacagaaaactttatgtgttaaataaaagcaggtcccttcagttcaacaaaagttggaatagcaatgatgtagtcagacatgagcagggcaggagaggggatccccaacccccaaccaggaatgtcaggctaccatctggtgaaggttcttgtgaacttttccaagaacggatggacctatcagtggtcaagctgtttgatgtgcagagctttacagacttaatggaagacctgttttaagtatttgtgatcttctctgtgacttctatgcaagtattcatgtcattagtgccaaatattttagagccatacacattggtcagtgaatttattttataagttataggctttagcatgtaagaccgttaaacagttaaagcaaatgtattaatttaataaatttattttattggctttaaaattaaagatttgtgaataaaatgtttatgt

SEQ ID NO: 470487 - DNA, 603 bp, Homo sapiens
gagaaacacccacaggactgacttgctcagtgtaggatgtttggcagtgctgtcctcaaccccatcaaatatgagtggctctggatccaagccactgtgcagaccaaaccaaacccaaccctaaacaaaagtgacgcccctgcacatttcctagtggacaggttcacccttggaaccgggctgcacagccagagatcagtggcagcattagattctcataggagcacaaaccctattgtgaactgcatatgccagggatctaggttgcatgctccttatgagaatttagtgcctgatgatccgtcactatctcctgtcacccctggatgggaccatctagttgcaggaaaacaagctcagggttcccacagattctatattacggtcaatggaacaattgtcttccatgaaactggtccctggtgccaaaaaggtcacagtgagaaggcagctgtctgcgagccaggaacagggcccttgccagtaacctgatcatgttggcaccctgatctcagacttccagcctccagaaatatgagaaataagtgttcattatttaagccccccagcctatggtaatttgttacagcaacctggactgac

SEQ ID NO: 470488 - DNA, 618 bp, Homo sapiens
tgactatcatgtaaaggaagcgatagtgaagctgcagacaaatgggcctgggccggccaacccgacagccacctgcatggtggagaattgaaggagaggcagctgtgggtcaaaacgtcatagggcaaggacgactgagcactgacactttgggcaagttagcctccgagatgactctggtggccccagaaattaaacctggaaagagtgttcgtgggagcgtggtgatcaccaaaagcaaggcagacagccatggctccgggtcacagaagcagcatcactcacaccagtctgaaacaccacaggtacaaatcagggctctaccgcagaagggctgggatcttcctcctccccagcatcctgcagccagatcagtgctcttcatccctgcagtgttctcgccaggccagcctgagcactgtccctgcgcccctccttctgaaaggggcattcacccagctggtgctcagcaagcatcttttatgctgtaggcactggcaaagtgcaaataaagaaagcagaatccctgcactaagagtctgatgaaggagataaccacatttgcaaacatttgcaataaagtgaaattagttacaaaagaagtgtgaaaagggaatt

SEQ ID NO: 470489 - DNA, 1500 bp, Homo sapiens
tttctgtgaatatgatggggtggtattgtccctgttgagaatgcatgttcctaaagaatttgctgacttgctcttccttcttgcttcagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctacctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagcagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaaactggtgccctaaaagcagggggtgggcattcacacaagcagaagacgagcccctccatagtcctcaggccaaactccaatcgcagagctgtcctgtgctctcagaattgtgccctttctggcccaccacccctgagttatcccatcatctgcccaggggctcttgtgtgcttggccataaaggttcctcgctgacttgtgggactgtgtcacttatgaggatgcatcttctctttcctgcttctctgtaacctcatcttagaaatgtacccaccttgtttttacttgctttcatctgtgtaacagtcatacac

SEQ ID NO: 470490 - DNA, 596 bp, Homo sapiens
tttccctgcttttttggtctggaatgtccttgtccccatctttgcctactaatattctcttgcttcttcaaacccatttccttgaaaacttcccacatcacccttgttggaacccattcatcccaaagtcgctctttcaaagaagctggtatttctgttgcaaaattattttcctctgctctgacctcctctccttccttcacggactgctctatggcagccctgatgcagagctcacgggcccggatccctgggatgttgttgctgttggccacagcttccagcacaatggaaagctagaagagacaaggaaacggattgtcccccagatcctccaagaaggaacacagccatgctcacccattttagacttctgtcctccagacctatgggagtataaatttgcattatgtgaagccatgaagtctgtggtcacttgttatagtagcaacggggcactaatactaactacacaccggctcatcccttgactggtttatggttaggaaaatattccttgagaatatttagcatgtgatggaagtttcttttcaatgaggattcacactgcagcattgtggtatgctttcttctac

SEQ ID NO: 470491 - DNA, 1197 bp, Homo sapiens
ccctgttctctcctccagctccacacttctcccactgacctgaaacagcttttgctctccctgctgctacacttactttgttctttctttttatgcccaagaaagctctgcccaatgtccctccacctggaaatcccaggcagcagaggggtgaggcatgggggcccctgaactgttttttctctgcctggtttgatgaagggagcaggagaggctggcaaaggaaatgcaagaaaagaagctacagcaggagctggagcgacaaaaggaagaggatgagctgaaacggagggtcaaaaaaggaaagcagggacccattaaggaggagccccccatgaagaaatctcaagcagcaaacaagcaggttcctccgctcaccaaagtggatgtcaagatggagacaatcgaaaggaaaatatctgttagggaacaaacaatgtctgagaaggaagagctaaataagaagaaaaggaacatgggcgatgtcagcatgcatgggcttcctcttgtccaggaccaagaggacagtgaaggggacatctcaaaggaccccgacaagcaactggcccagaagtttaagacctatgaattgacactgaaggatgtccagaacatcctcatgtactgggaccggaagcaaggagtccagctgcctcctgcagggatggaggaagctccccatgagcccgacgaccagcgccaggtcccctcgggtgggcgcaggggccgcaaggaccgggagagagagcgcctggagaaggagcgcctggagagggaggaggcggagcgggagcgcctggagaagctgcgagacctggaggagcggagcgactgggagggggaaggggaggaggaccacgaagagaagaaggagaaggacctgggcgtacccttccttaacatccagacaccagactttgaaggcttgagctggaagcaggccctagagagcgacaggcttcccaaaggagagcaggtgggctgtaacctttactgttgtgataatggctattagtctagaggcaacatgcttattctgaggcaggaagtagctgttaaattttcaaaccatttgctctggaaattgctcattcattatatatgagagcaggatgggaaaatgctggaggaataaatgttttctctctcaggttatttttcacttctctcttcattcccattctcatccccagtccc

SEQ ID NO: 470492 - DNA, 1997 bp, Homo sapiens
aggaagtagacagcaagcagatggggataactggtttagtggggggcaaacagaaaatgaaagaaaagatagaccaagtcttcgagagtcagaaagacaagcgtcacatggccttaaacaggaaggtcctttctggggaacctgctggaaccatttcccagctgtcagatacagacctggacaacttcaacgggcagcactcccaggagaaattcaccagactgaatcacttccggtggatcgtgccagccaatggcgaggtaacgttgcaggtgcacttctcttctgatgagttcgggaactttgaccaaacctttaactttgagatcctaggaacttgctgccagtaccagctctactgccgaggcatctgcacttacccatacatttgccaagacccaaaagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacagacaggaatccagggtagttcttctccgcaatgtcacgctcctgcctgtggcctggcggatcaccagcctggagcacttgggtgatgatttcactgtatccctgatgcagggaaccatcccccctgaggctgagtacggcctgcacctgtactttcagcccaccaagcctgtcaacatcaagaaggctattcggttggaggccacctgcagcttctctcacctggacttctacagaggtttcctaactggcttccctgttggcattcgccacagtgtccagagggatctttacaatgtcattcagacagttgctggatcatggggagtccaggggttcctgtggtggggatgcacaggaggcaggcagcaaggggatattggagaggtcatcatgacagctgcttaccaactggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcagcttttccgtggactctgtagggatttcaacacctaatataaattccatgatctcagtccaacccaaaaagggttcactgaccccaacagaaaaacccagaaatgtccaagttttcttccatgcaaaaaaggaagtgaagattgagcaccagcctgttctgcgctgtcagattattgagcccaatatttcagaaggaggtgagatcattgccagcatcccaattaagttttccgcgaatgcagtatattccaaatacaacatcaccccctcctctgtcatcaactttggagctttgatctgtggcactcgtaaaagcaccaccttcaccatagaaaatcaaggtgttactgacttcaagttcgccctttataagctgacaggggagagccccattcatcaaaagaaagcgtaagacaaatatttacttaactcattccattccctctttaatttatgctttatattttataaagagctttcgtatatcttacttaaattcacccaatcccgttttgtgggtgagatcagt

SEQ ID NO: 470493 - DNA, 599 bp, Homo sapiens
gctgccagtaccagctctactgccgaggcatctgcacttacccatacatttgccaagacccaaagcagcctctcctcaccttttcccctcctgtgttcagagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacaggtcagagttctagatcatgtcaggactggaagggaatttaaagagc

SEQ ID NO: 470494 - DNA, 888 bp, Homo sapiens
atcccaccactgtccagggtgacatcttgcaaagcttcagtaaaatgtcacaacctggtattgacattgacgagtcaagacacagaacagatcccttgccgcaggattcctcatgtgacccttttgttgccacaccctttcccttcccccaagcaacacctcctcaccctctggaatccaatactttcctctgtgtctatcattttgtcatttcaggaatgttcccaattgatattttcttcactccaaagcagcaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaaggagcaaacaagaagttcatttaaaaatttaaaaggagagactgggaagaagatattcatggggggctctgaaaagcttcagcatattccctggaatctagacagccatgcatgtgtaagatgtgtatacctccaggctgttactgctcaggaaagacctgagaaggccctaagctcttacctctgactaacctttgggtcccaggaaagataaagcagaattggcaactgcctgcctg

SEQ ID NO: 470495 - DNA, 600 bp, Homo sapiens
agtgattgattagatgtgtgaaagcaagcatgtgtggagaggagaaagaaggagaaggaggatccagggatgatgctggtggtgatggtggtggtggtggtgatggtggtggtggtggtggtggtggcggtggtggcggtggtggcggtgttgtggtggtggcggcagtggcggcggcagcagcggtgtggtggtgtggtgatgtggtggtgatggtggtggtggtggtggtggtggtggcagtggtggcagtggtggcggtgttgtggtggtgtggtggtggcggcagtggcggcagtggtggtggttgtggtggtggtggttatgatgtggtggtggtggtggtgatggtggttgtggtgatggtggtggtcgcggtggtggtggtgatgatagtggttgtgttggtggtgatggttgtcgtcgtggtcgtcattgtggtggtggtcgttgtgattatggtggcagccaggatgatgaagacagtgatgctgatggtgaaggtggtgatgatatgctggtggtcgtgaaagatgtgattatgattgtgcggcgaggtgttcgtcgcgtagcagatgagagatggtgttggcgatgatg

SEQ ID NO: 470496 - DNA, 2283 bp, Homo sapiens
attggctaagcacttgaatttttttagataagaacacaggtgttatgaaaactactcctaaagccaaaatgggaaaggaaaatactcacatcaacattgtcatcattggacatgtagattcaggcaagtcaacctccactgcccatctgatctacgaatgtggtggcattgacaaaagaaccattgtaaaatttgagaaagaggctgctgagatgggaaagggctccttcaagtatgcctgggacttagatagactgaaagctgagcatgaatgtggtatcaccattgatatctccctgtggaattttgagaccagccagtgctacgtgactatcattgatgcccctggacacagagacttcatcaaaaacatgattacagggacatctcaggctgactgtgctgtcctgattgttgctgctggtgttggtgaatttgaagctggtatttccaatggaaccacactgcttgaggttcttgactgcatcctaccaccaacttgtctaattgacaagcccttgcgcctgcctttccaggatgtctacaaaattggtggtattggtactgttcctgttggccgaatggacactggtgttctcaaacccagcatggaggtcacctttgctcttgtcagtgttacaactgaagtaaattgtgttgaaaagcaccatgaagctttgagtgaagctcttcctgggcacaatgtgggcttcaatgtcaagaacatgtccgtcaaggagattcgtcatagcaacgatgctggccaaataagtgtggactatgcccctgtactggactgccacacggctcatattgcctgcaagtttgctaagctgaaggaaaagattgatctccattctggtaaaaatctggaagacggccctaaattcttgaaatctggtgatgctgccatcgttgatatggttcctagaaagctcatgtgtattgagagcttctcagactattcacctctgggtcgctttgctattcgtgatatgagacagacagttgctgtgggtgtcatcaaatcagtggacaagaaggctgctgaagctggcaaggtcaccaagtctgcccagaaagctcagaaggctaaatgaatattatccctaatacctgctaccctggtcttaattggtggaagaacagtctcagaactgtttgtttcaattgcccatttaagtttaatggtaaaagactggttaatgataacaatgcatcataaaaccttcagaaggaaaggagaatgttttgtggaccactttgattttttgttttgttttgttttttcgtgtggcagttttaaattattagtttttaaaatcagtacttttcaatggaagcaacttgaccaaaaatctgtcacagaattttgagacccattaaaacaaaatttaatgagaaaaaacacacattattactagaccccaaaatgatcacaaatcaaatcattgcatggattccattctggttgtcagggagatgatccagaatgtgctagtatttgtgaacacactaaaattttaataagttattgctgagcacttataaatccctaagtgtaatctgcaaactttcagggagactttaatgatagttttagactcttcaagacaagatctgtcttctagcatgctccagctttgccttgtctctggccctttcctgttccttgcagcagcctgaattagttcattttcatactgctatgaagaaatacctgagactgggtaatttataaagaaaaagtggtttaatgaactcacatttccacatggctggggaagcctcacaatcgtggtggaaggggaaggaggagcaaaggcacatcttacatggcagcaggcatgagggtgtgtgcaggagaactagctgccctttataaaaccatcagatcttgtgagacttattcactaccatgagaacagcatgggaaaaccagccctcatcattcaatttcctcccactgggtccctcccactacacatgggattatggaagctacaactcaatatgcgatttgggttgggacacagccaaaccatatcacagacttataatcaaatgaacaattgtaaaattgttcatttacatgcttgagagtctggactttatttttttgatgtttagtacagagatggataccaattaggaactgagtatatttaacaaataacttcaatttttccttttataccaaagttgtatatgtttacacccctaattctatgggaaaattgggccagtttcactcttggatggagccagctggtaaagttggag

SEQ ID NO: 470497 - DNA, 534 bp, Homo sapiens
ctgcccaataaatatcagtagttatgagatgccgcaaacacaggggtattttgtcagcctggctgtgcatggaaatggtggtgtggggttccctgggcacaggaagctcagcccagggcagcgcacagtgcatcgaccaccctttcctggttccacagacgctgggcatagagccagtcctctaagctttggcctccaccaagagttcaggcttttccagcacaaaagccagagactagcagtgagtcacaaacccatctctcctgaaagtttctcagcaacaagggagacaaggcttgggttgactgagtggagactaaaggcaggagatggtgtttccaccttcttgtatcatgtacgttgtggaacccaatcacgcattgaggtcaactcaaggctcccaagtgctgaatttgctagctcagcaaatgagaaaaggtggtactggatccaaagagaagaggcttagaggagatgagcttctcccctacagtatagaattatttattcaaatcactgatgtaggaggttgac

SEQ ID NO: 470498 - DNA, 543 bp, Homo sapiens
tacacatctgaaatgaaggaggtgctacgtatgtatttgttgaatgaatggaaagatgggtgatcttggattcttcggctctcagggccagaaagaactttatggtcatcttgttcagctccttcttcccaagccctctgcagaatgcctgataatgagttgtctggcattttccaattctggaaaagaatttggaactccagattttccagttctggagttgtcaggctccatagggaaggggagctcaccatcgccagaagcaactctcccttgcattgtcaagaagctctctgggttgcaagcaaagcatttaagaggtgacttcgatgtgttaaaagcattcagttgtaaaagagaaacagagcataaaagtttggaaaatttgcagactgacaatgcaatagaaaagaaaaacccattttctgaggagaaattcaagctggaagcagaaatttgcataagtaataaggagccaaattataatcttcaagacaatggggaaaaagtctccagggcatgtcagagacctttgcggtagcc

SEQ ID NO: 470499 - DNA, 562 bp, Homo sapiens
ttacccctgagatgaggtccagaaaggagctacatcccacacagatgcagaagagacctacaagaatttccctcccagtgcagcagagtcgaggctcagatggaccactgatgagggagctggtctacagtaaaccacgtgagaggccacatgcagaaccaagatgcctcagccaacagctgacaccagctgccagacatgtgactggcaaattcaaagcctttgaattcatgaaagaggaagatttttctcgtacaatcttaggaggtagggaaagtgcccagcagagagctccttcaacacggaaaacagaggcagcagcgcccccaaggggccagcaaggtggggcagcggcgggagtgctgagctccggaggggagctctcctttcttcaacaggcatttattgagcacctgctggacagagatgcttacactgaaggcagagaaagagaacaataaaatccacaacttttcaggttgtgaaaagttcttggaagtaaaaaaaaaaaaaaaaaaaaaagaaaaaaaaaagcaaggtgctgtgcttttgtgctttcatc

SEQ ID NO: 470500 - DNA, 563 bp, Homo sapiens
aacaagattcaaagatgatttttcttttccttttcttccaccccgtcttaccttccactttgattatctcccggcatccccagccctctgaatttggagaggaggaagagaagggaaaaccagagaagctcacgacatggaaacagaagaatgagcaggaggccgatgagcagatgggagttatttttaaaaagaggcagcaaaaagtcgtgggaggagaatgctacagacaagagagctctggagctacaggaattccttcacttgcaatggctaacagagctgagctgaaattttactgcttaacagcagatgtcagtgttggccattactcacaataccgtgaaactaccctatataccaagctactggttctggaaaataaattaatggtaaatttgcataagtcagtacaacttttacttgatgacagaagcctctatactctccccctagggatgtttcataagaacatggaagaacagatctccagtcttctcagaactccttagaaatggttattcttattgtgggatagaaaaaactgctctgaattcttaaac

SEQ ID NO: 470501 - DNA, 769 bp, Homo sapiens
atcacaacaggatgctagaggaaagccttgatagccacgtagacatggacacaaagattttcttaggaaactctcatgcaggcaacaactgcagaaatataactttttcaggtcccccagctgcaggtctgatggagtttgctggaggtccactccagaccctgtttgcctgggtatcaccagcggaggctgcagaacaagctgtcagacagggacgtttaagtctgcagatgtttctgctgccttttgttcacctatgccctgctcacagaggtggaactatagaggcagtaggccttgctgagctgcagttggctccgcccagttcaagcttcctggccactttgtttacctactcaagcctcagcaatggcagacgacccttccccctgctgggctgcagcttcgcaggtcgatctcagactgctgcgctagcagtgagcaaggctccatgggcatgggacccacagagccaggcacaggagagaatctcctggtctgctcattgctaagactacgggaaaagcacagtatttgggcagaagcttatggatgcttattttacactttggattaaaatccaatactacttattttgctgcttaaattattccatttttgccattaggagctctttcagtgcctttttgatatactcccccctttttttttttttagcactttcttctttcctggcaatacaagatgtcccaggctcatcttctattttttgtacccctgtcctagaataattcatttctctgaggag

SEQ ID NO: 470502 - DNA, 1031 bp, Homo sapiens
gcatccagcatccgcatccagcatccataaccagcatccacatccaccatccgcatctagcatccgcatctatcattcgcatccagcatccaacatccgcatccagcatccagcatccagcatccgcatccagcatccagcatccgcatccagcatccagcatccagcgtctgcatccaatatccagcatccagcatccacgtccagcatccgcatccagcatccagcatctgcatccagcagccagcagccagcatccagcagccagcagccagcatacgcatccagcaaccgcatccagcatccaacatccagcatctgcatccagcatccaggacaatgctgcaggtccattatccttggcatctcgttctgctttccacccccgtcttttgctgtcaggaagggttttcttccaggctgccaaccaacctctttgacgatttgtcttggttgttgtgcaatggtatgtcacctctttccactcaccctttgaaaacagcctatttaaagaaagatgatttggggttagagtcaataaaatcaggtggtaagccattcttcagtatgtttggtcttcagcaggtgggctgggtggccagggagacattttttactgaccactgtctccttgtcagcagtgcaagcctgagagatgctctgtggctgtgcatgcaaaaggctccaagtgacttaaagtttatcatgttggaagtcagttaccaccagagaggtacttttcaagcagttcatcgcagagtacagagcaaagttgctggcacctggggggttggtggggggtagttgtctcatggacccttgattcatgtgcttgtccacagcttagattttgagcagtaagaaagcatagcctgaagtgccccaccaagtgaagaaatgtctttgaagttccatattttaacttgaaaatttatgtgaattttattttctgctcaacagtatgccatttttaaatgtaaaattatttttaaaattattgatcagacaaaaagtagaagccaaagaaagct

SEQ ID NO: 470503 - DNA, 696 bp, Homo sapiens
agtcaaagccagcatctctatacacgttgagatttagcacagcatgcaagcagctgagctgatgtcaacttctgaattcaagaaggcaaagggatggctggtgcttataactggagataaagatgacacagggaatgatgatggtatgggtttcatcaagagggcacttactgtgatggttaatactgagtgtcaacttgattggattgaaggatgcaaagtattgatcctgggtgtgtctaacatttcatcaccctgttatctctggcagcgaagacacagagccctgacagagtggagaaagaagagcttcaaggactgctgctggggtcaggctgccatcctcctaggggctgtgcatctcctaggaggagcaaactcgggtccctgcctctgcctgcctcctcacctcccattccttcctccagcagttctatgttcccagcactcagcctcccctgctgtctcagtccctggaggggcagagacaccctctccttcctacgtaagcattagtcattctccaggagagcgctatgacaagatcccatctccgcagtgcccagggaatccgacacctgtgagccatgtgtattttcttccaactcttggtcatgctgtgaatgttattaaaatgccctatttatcagagtgataaatgccctatttatcagagtgataaaatgccctatttat

SEQ ID NO: 470504 - DNA, 606 bp, Homo sapiens
tgaattctgcaactgctcaggggagtgaaactgaccaaagccatgctaatgcggcctcttagcaccttcccatccaggactaatggtaattctcggaaagtaaatacagcccttcctgagcccccagaagccatttgctataatgtggtgtggaatgcagtggtcatcagtgggaagtatttcaaggacaggtggcagataaaaccagacacaagcaatcagcagctgcagttacctgcacacctgcgcatgaatctgcatctgcagaaggtctacaaaagagacaaggagcctgggaatctgaagatgctgcatggagaagtgagaaagctatttggaccaaaggttatggtcagggaaaccagagactactgcttcaggggtgggaccaatgcggacgatgataggaaagttcatgatgagattcaggtggaggcgaatcttcactaaagaagggaggcagaggaatgtttacttttatgtttttttcccactctaccttgaatgcagaagttgacactaagtggagataaaaggcagctctataaaaaaacactagggccatttctgccaccttgctgggaagaacaattcagtgaaggtaga

SEQ ID NO: 470505 - DNA, 530 bp, Homo sapiens
cagttccttcagagcatctgtggattctctcagctttcctggagctgcaagctagtcctgcctcctatctgccatcttcagaacatgtcacaggtatcagtttccattggagttcttcaactaggaagatgtagcagcgacatctttatctgtcctcacttaccctgggcaatactgagcgggcccagggactcatgctacatgatgtatgtatctgaccgttttcctgtccatgcctccagcaggcaaggaagagactgggctccctccggatgtgaaaaccaaggccttgttacagtgatgagccaatgccacattggaactcctcatggccagttggctccctcacagcatggaggcttggttccaaggagcagtgttccaagaggtgaagatggaacctttagatcttttaagacatggtcttgcagttacacatctccctcctatcacattgtattggtcataagaggtcatagggcaaacccagatctgaggcaagggagcacagactccacctctccatgagg

SEQ ID NO: 470506 - DNA, 664 bp, Homo sapiens
gcagatgtaatgttgcaggaccatagtgtcaatcatccatgtcccattgaaggatacaacctgatggaagctgggaccgagagctttattatgtcctgtggtcaccggcaccagagtggcagggaagaactggaccttggactcaagaagttcatgatgagaagccaaagaaggctgggaagtgctgccgtgggtgaaggcaaggtgaggggggaggaaaaaggtggacctgctgggaagtccggaggtctacatccggaggtctacatccggaggtctacatccggaggtctacatccggaggtctacatccggagaatgatgtggctcggaaaaacacagtttttcctctgcttttacctcacaacagtcaacccagaagaggtctgtgaccccacgtgtggattttcccccacacaccaagcaagcaagcaagcaagcaattctgcagtggacaccaactgcacgaccaccaattccattctgacaccatctacctggagatagcgtcagattccacagcttgaggctgggctcaagccccagggcattttacctgtgcctctaaccggttggctacaaatcgggcttctcacaaccccctcctttaagtttgattaatttgcagaagcagctcatagagctcaggagaatacttaggttt

SEQ ID NO: 470507 - DNA, 1073 bp, Homo sapiens
ttgctttttccgagtgttcttaaaacacgcctccggagcagtgtgaagaagaggcgagaacgacccccagaccgaccaaagcccgcgcgccactgcatcccgcgtccagcacctacgtcctgctgccgtcgccgccaccaccatgcccaagagaaaggctgaaggggatgctaagggagataaagccaaggtgaaggacgaaccacagagaagatccgcgaggttgtctgctaaacctgctcctccaaagccagagcccaagactaaaaaggcccctgcaaagaagggagagaaggtacccaaagggaaaaagggaaaagctgatgctggcaaggaggggaataaccctgcagaaaatggagatgccaaaacagaccaggcacagaaagctgaagaacaagctaagttatacaaggattttaagcttattccaatagaaatgagtcagattcgggagcctcgtcccggcccacaggagggtgagctgggaccatccctggtgccacatttctgggagctgctgaatgatctgtatccatctctttctctggttcttcccggggcggggagtggcggggccctgtgcctgggtttccgcttcagctcctctgctcactcttgctatctaaaatcacttcccaatcccagcaacatgcccaaggcaggtagtcccgctctgaatgggactggtttggctggacccacagctacctcaataacatccatagccatggttttacccagtgtctgctctgtagatactcatcgccacactagctccattgaggttaggcgagagcacgtgaactgctttagctaataagcacgtgaactgctttagctcataaaataaatgtattattcctagccagatctcctttgtcgtgtcatttcttctcaaagttttcattctttgtctaaaaagtataaaagcgtcttgctttggccacttcagacttcactctcttttgaagattcctgtgtacatgtatagctaataaaatagatatgcctttctcttgttaatctgcctgatgtctgtttggtttctggatccagccaaagagctcact

SEQ ID NO: 470508 - DNA, 688 bp, Homo sapiens
agacttggccatgggtcatacagtctgtgaagattattgccagctggcttctgcaactgggagccgccttcccacaaagctggaggctctgaaggttggaagtcagaatgttgagcatggaaatgacaaagtagtagaagaggagctagtccctaagataaagtgggtactattggatagaaaaataagagagagtagatgttgggcaaggaaatacaagaggtattcacaacaacaacaaaacaacaacaacaacaacaactctgaaaagatgctcagatgcttggaggcctggaagctgaggcctatttcaagggcctattatgaaattagcacatccattaaatcagcttccatggttccaaattcccagtcatggcaaccatcccccttcctgagccagacctaccgcttcctttcagaactgctgacactaatgatggatgagggtactggagaacaagaaagtcggggctctcccctccggcccctaggtcagaagcagggacttcccatcgccagacttgctagagaagattgaaatttaggaattagtgtcttatgattgctaagggtgatggtgtctaaatgtttcttagcaacatttagacacaatcaataagcaatcagtggttgaaatcatgtgaatgaacacttagaaatctgaggactggtattcttgattctt

SEQ ID NO: 470509 - DNA, 626 bp, Homo sapiens
ctccccaagttaagaaaatgagatgttttatataagcgggtatcaggccggtggtgctgaaggcttgagctactccacacccatagaaagcggtgaaggcaggtccgtgaagctgaaagcaatgagagctagaaccagaaacctgggcccctctgctgcagatatgctggaatttgctggaggtccactccagccctgtttgcctagatatcaccagcggaatctacagaacaacaaagactgctgcctgttccttcttctggaagcttcgtcccagaggggcacccgcctgatgccaactgaagctctcctgtatgaggtttctgtcgaccgctgctgggagccgtctcccagtcaggaggcgcaaggagccagcaggtgggaaagtttaagtccgctgaagctgcgtccacaggcgccctgtcccccaggtgctctgtcccagggagatgggagttttatctataagcccctgactggggctgctgactttcttttagagatgccctgcccagagaggaggaatctagagaggcagtctggctacagcagctttgctgagctgtggtaggctccacccagttcaaacttccacgcggctttgtttacactgtgaggggaaaacc

SEQ ID NO: 470510 - DNA, 613 bp, Homo sapiens
tatttgttttgttttgttttcttttgttttgttttaagattcttgattttttcgcaggtggcaggggagatacgagagactggagacgtccagcttcagagcaggaaccttagttgcgccagcaacgaaaaacagaactaaatatgggtgatgttgagaaaagcaagaagatttttgttcagaagtgtgcccagtgccacaccgtggaaaagggaggcaagcataagacagggcctaatctcttcgggtggaagacaggtcaggccattggattctcttacacagacaccagtaagaacaaaggcatcacctggggagaggatacactgatggagtatttggagaatcccaagaagtacatccctggaacaaaaatgatctttgccggcattaagaaggaggcagaaagagcagacttgatagcttatctcaaaaaagctactaatgatcaatttcaagaaagagagtgggtaaaaacaattttagttcataaaagattttggagaatctacatttgtattttagaaagatcatattggcttcagcaagaaacatcatagaagaccagtttggggaaaggatgtatgagactggaggttgctcaagcctggaa

SEQ ID NO: 470511 - DNA, 493 bp, Homo sapiens
caataaacacttaccgaaagacatggatgaacctggttccaggatccagaagggcctgaaagcatcagcggcaagctgggctcttagaatttccgctgatggaactcaagattttcctttatttccatgcttggcagggagcagggtgggtgtgtctgcaggcatccaagagggacccctgcttcatctcaacaggtatcagtggccttatatgcctttagcatggagatgtaaccacagaagcatcccaaactggccctactctgttgataacagaacattcactgtcagaaccaagaagatagacatgtccagagcccaggagaagaacctgaatgctggaaccctttcagaagaaaaggttcctctgagcccttctcagaaggggtctgttggccaggaaaatccagtgctgaaatttgcttgaacataccttactgtaaatggtcaaatttgaagacctccaatcagactctgccaagccaacattccc

SEQ ID NO: 470512 - DNA, 1055 bp, Homo sapiens
aagagacactagaccttccagaacataagctcacactcaaccatggttaagatgaaggaaaaaacttttaaaaacattgacctaaagcttccggccaggctcctagtgactgctatctataagaaggtctccaacagccataaggcactgagcatagcaccgggcccacaggctctaaagaaagagggcctgagggatccccaggattccactcgctgctctggttgttgggggcacaaaccactctcagcacgaaagtccccagatcccacccaaacctcaggaggggaggcttttgtcatgcagaggggtcctgatgagaagcccctctcctgtgagcagcagttgacaatgttcagcgatttgtttaccatcgtcattattgttgctgtacaggagcatctggaggcagccatcagtgggctgaacatcgtgatgctcaggttggccactggtcaggttgggtttggcagaggttggccatcgtagcggaattcacttatcaggccaggtccagggacaagtaacaggacattatgacagatgcttcgtggagctggaaatattaaaagcaacagccctctgctgacattcgtctccagaacctggtaagacttgttcaacacgctgctgtctccagacttcccatcagtccttgcaggcacccttggcctgatgaccaaagttttaaaatagcttcattgttttaaatggtgccattttaaatatgaaatatatatatatgtgtatatatatatacacatacacatatacatatatatgtatatacaatatatatgtattttaaatggtaccattttaaatgtgaaatatatatgtatatatatttgtatatatgtaatatatatttcacatttaaaatggtaccatttaaaatacatatatatttatttttaatacatatgtattatttaaatatatgtatatatgtataaatatacatatatatttcacatttaaaatggtaccatatgtatatatgtgtgtgtatatatattttttttaccaaattttaatgataaaggcataatggt

SEQ ID NO: 470513 - DNA, 1238 bp, Homo sapiens
gacatcctcctcctgctcccgctttccttcccaattcgaagggaaaaggtgacagcctgctggcagccctcacagccctcgctctctctcggcccctcctctgcctgggctcccactttggcagcacttgaggagaccttcagtttgctgctgcactgtgggagcccctccctgggctggccgaggcgggagccggctccctcagcttgcggggaggtgtagagggagaggtgcgggctgcaaccagcgctgcacgtggtgcttgcaggccagcgcgagttccgggtgggcgtgggctcggcggccccgcactcggagtggccggccagccccgcggaccccgggcagtgaggggcttagcacctgggccagcagctgctgtgttcaacttctcgccaggccttagctgccttcctgcgggcagggctcgggacctgcagcccgccatgcctgagcctccccgcctcctccgtggactcctgtgcagcccaagcctccccgacgagcgccgccccctgctccatggcgcccagtcccatcgaccacccaagggctgaggagtgcggcacacgcttcactcctgaagccagcgagaccacgaacccaccaggaggaatgaacaactccagacgcacggccttaagagctgtaacactcaccacgaaggtctgcagcttcactcctgagccagggagaccacgaacccaccagaaggaagaaactccgaacacatccgaacatcagaaggaacaaactctggacacgccacctttaagaactgtaacactcaccacgagggtccgtggcttcatccttgaagtcagggttgctctagagtttgcaaatatacagttctgcagaggtggaagctgctggctgaataatggtgacaaaactgggaatctttccacacaagtggcagacaccctggcctataatgattccctgaaaatgatttttccacaagccctacggagaatcactggattattttgggaagggaagctcgccaagttcaaggtgaaggatgaacatctgcagccacaggaagaggctgaggactgtcatgaggacaggaagggtacagtctgtcaccagatggaaaagacttcccacgtcttacacatatttttcaccagttgagtgttttctgtggacctggcattgagctgagcagttgatacacctcagttactcccatgtggtcatgacaatgaccatccagcgtagaagcactt

SEQ ID NO: 470514 - DNA, 635 bp, Homo sapiens
aacaggaagaaagagtagcccactttctggaaactgctgatggtttatgcagccagggtgtcatgttcacagcagaacaacaagaggggcactggacaggtaggcatgaccagataatgaaaggacttcgagggaagggcaatggggagccagtggagattgtagagagaggaaagacatggagcctggggcggcacctgagcaaagacgaaggattcgaacttacagcccagcaatccattgatggaagaacctaccctggcaccctgtctagtccctgggtgagtgatgggggctgccatcactgcgagagtgatgcaggaggaagaccacactgtggagttgacgagacagtgaatttacttgtggatgagttaaaggccatgaactgggacctaggagagaaaggatggaagaaaggagatattaaagatgcagaagagagaaaggaggagggagcgaggcatccctgagaaggtgggaaggaacagggagagggactgcccatggccgggtgggatcgtgcctgcacacagagcagagtgtacagcagctgagaacgagttgtgctcccgcattctgactgcccatcagtgcactctccctcccatagcctgggtgagctttataagtga

SEQ ID NO: 470515 - DNA, 582 bp, Homo sapiens
agctcatctagagccattcacatcatggtcacaggatttcagattttagttaaattagaagataactgtcactccaggacatatctagccagaagagtatacccaggggtctcccccatgaagttttcttgtcatctccattgcctggtgggctcgggtgcagaaatagaaggctcgaggctagtggctgactgcaataaagctcttgtctttgcagcattgctttgggaaaaaaaggatgaaacggatctaactgtagcaatgccgctgcaggccttgcagttttcagtgcatctcattgatttgctgagcatacttctcagatgtaatcgtttccccgggattcagaaagcggtagtggatcagaccggcagcagaccagcaaacagcaaggtgcaaagtgctttggagcttcttctcagttcaaccattgagctggtcgtcttcagttgtcatatgacatccacttttcattgcatgtcacaatctgattgagaaatggttcgttgttgcgtagaataagagaagacgacatttcaaaatgacgatttgtttttatttttgctcagctcatgaggcacc

SEQ ID NO: 470516 - DNA, 1438 bp, Homo sapiens
tccctgcacacgtgaggagccgcgcgtcccctcccgggataaactctggtccctgcacacacgaggagccgcgcgtcccctcccgggataaacgctggtccctgcacacacgaggagccgcgtgtcctctcccaggataaacgctggtccctgcacacgtgaggagctgtgcgtcccttcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacacgaggagccgcgcgtcccctcccgggataaacgctggtccctgcacacgcagtggtgaggaatagatcagagatccggtgtccccctcatgtggtctctcccgaggtggcatcctgtgcaactgatgacatgtcggaaccggatattgacgtggacacagtcaggatggggagcacccgcgccccggggccattggccatcgtccctgctgtcctacagccccgagaggccaggtacgtccatgtgtcgtgcccattttacagacggtggagctcaggcctgggagacagactgacagtgttcggcactaactccaccccagcctttttccacctggccacactgtttactcgttcccgccagcagcatgggggctctgtcctccaggaggactggggctctcctcccagcaccaccacggccattgagcccagtgcccaggagaccgaggcctgtgattccaactcaagcctctttgccctagagccgtggctcagcttgaggagcattagggcccctggaggttgttaaacccacgttgtggggccccagcccccagttcctgatgcagctgttggggtgagctgaaaatctgctgcagagcctgcatttcagggttcccaggtggcgccaccagcttgagggggtcttggcgctattgtaacgataacagcagcggtctccagaaccttctgtaggcctctgcatgctcacaggttagaccactgagaccacccatggattttatgtagtagacacacagggtgggcctcgtgcccagtgttgtctaacatgctttgtaagtgcagacccgttcctcccagtgcctttggaggtggagattgtggtccttgttttacaggcagggacagtgaagggactgtgaccgctgttggtgccaggcatctggctgcagctcccaggctctcatccctttgctgtgctcctttgcagcttggagggaatgattttttatccccatcttacagtatggggaaggtgaggctcagagaagtcaaggacttctgtctggggtcacgtggctaggaagctaacagccaggatccgagctcagatttgccc

SEQ ID NO: 470517 - DNA, 719 bp, Homo sapiens
agtgatgatgatggggatgatggcggtgatggtgatgatggtggtgatgatggtgttggtgatggtgatgatggttgatggtgatggtggtgatgatggtgatgatggtgatggtgatgatggcgatggtgatgaggatggtgataatgttagtgatgatggtgatggcgatggcggtggcgatggtggtgatggtgattgtgatgatagtgatgatgacggtggtgatgatggttatggtgatgatgatgatggttatggtgatgatgatgatggtgatgatggtaatgatgacagtgatggtgatgtaatggtggtgatggtgatgatggtaatgatggtggcgatggtggtgatgattataatgatggtgatggtggtggtgatgatggtgatgatggtgattgatggtgatgatggtgataatggtaatgatgatagtgatgatggtaatggtggtgatggtggtgatgatagtgatggtgatgatggtgttggtggtgatgatggtgatgattataatgattataatgatggtgatggtggtgatgatgatggtgatagtgatgatgatggtagtgatgatggtgatgacagtgatgatgatgaggattatgagaatggtgatgatggtagtgataatgatagtgataattgttacatgtagacataagagttccttatggtttgtggctgtttttattaaaaacaactgcttt

SEQ ID NO: 470518 - DNA, 1093 bp, Homo sapiens
atgtgaaggaggtggacaaaggccagacagcagtgagctctgagggatgggaatcggctgcatcaacagcctggctggactggtggctgatggcagagattcaggtaccacggagaaggcaggagccctgcccagacgcaggcagcgtcccaagaatgggcttctccagcctgatgaccacatgtcaagcctggcggtgaacacactgccctgggctgtcatctgcctccagcttcctgcaagaggagtggtagggggagacgtgtatacctggggccctggccattcagagtgtgggccccagaccagcagcatcagcaccaccatagaaatgcagagtcttgggcccctcacagacttcctggaccagaaccttcattcgaacaagagtccaggggactctgatgcatgtgggcagggccgtgagggcacggagcagaggaggatggatgcgggtgagcgtcctcacaaagaagggagtgcaaatcgcaacctgactggatgccccaacaccagtgaggacgctggacacccccacatcagcgaggacgctggatgcccccacaccggcaaggatgctgaatgctcccacactggcgagaacgctggatggacgccctcacaccggcaaggatgctggacgccctcacactggtgaggacactggatggacgccctcacaccggtgaggagactggatggacaccctcacaccggcaaggatgctggacagacgccccttcaccagcgaggatgctgtcatcagagagacagacaaaaagaagtgtcaaagaagatgtggagaaactggaacccctgtatgctgctggtgggaaggaaggatgatgcagccccagtggaaacagtttggcagctccttaaaaggtaaaatacgcagttaccatatgacctggcagttttacttttcggtatatacccaagaaaattgaaaacgtgtgtcacccaaacacttgtacgtgcatgttcatcatagccccaaactggaaacaccccacatttcatccactgatgaatggatgaacaaagtgtgctccagccacacagtggaagattaactggacagaaatgggac

SEQ ID NO: 470519 - DNA, 1177 bp, Homo sapiens
ggaggaactccagtgtccacccggatcccgctctctcaaccctaggggaaaaaacagcgtgaccctgaggccctgctgggtttgcatcctgcctccagaggttcatttctgggtgactctggaaatgatgagacttccctgcgcccagtccccaccccgcacggggagttcacaccaattgttcttccccggggactcctgccaaccagggaacgtgacagttcacagtgaggggcccgaggctgtgggcagcaggtcccgctggggactctgggcaggatgccaccttcagatgctgccgtggccacagcattcgtgccagaccagcaagggtgtcctggacactgcccagatgctgaccccgtcatcaaagcagacactggacactgcccaggtgccgaccccaccatcgaagcagacactaccttgtcccctcccgccccccagcaagaagacgccaagccctgagagatttgcctgtgctcagcactgtgtggaggagcggcatgttttcgtgggcacagagacagctctggtgaggatgtaaaatagcgcaactgccacggaaagcagtctggcagttcctcaaacagtttaacctagagttatcacattttgtgctccccgccacactggatatctacccaaggaaatggaaaacatctgtccatataaaagcttgcacgtgaatgttcacagaagccatgttcacaatagccaaaaggttggaagcaacccaaatgcccatcaaatgataaatggttaaacaaaacatggtctatccatgtgatggaatattactcagccatgaaaaggaacggatcctgacacatgctacaatgtgcatgaaccttgaaaatatgatgctgggtaaaagaagccaaaccaaagacaaatattgcatgattcaacttgtatgaaatgcccgaatcatagacacagaaaacccgagtgctgagggatggaaggattggggattgacaggtaggggttcaggagtgatgaaaatgttccaaaactgactgtggtgatggctgcacaaccccatgaatccacgaactgctctttaaaaaaactttaaatggatgaattgtatggtatgtgaattgtatttcaataaaacagttaaaaacaaaagttaatggaaggcaagaatgtagaacaactggaactctcc

SEQ ID NO: 470520 - DNA, 639 bp, Homo sapiens
tcctcaccccaggggcgcaatgcccctggagggttttaagaagacgtttgctcctaaggattggaaacgaccatcggcaggggacgggttaaaccgattaaggacccccccccccccccgccccctgtgggagcagaggcaggcacgacttggtggaaggaggttcgaggcagcagggccctgcttcctgctggcgggaggatgggggccgtgccaggtgacagcacctgcccgggtggccgcctcttactatgaccttagtcctgggctcctacctgctccctgctggaggagactagtccaggccagggccagcttgactcctgcccgctgcttccgcacgcagtcgtgcccagccctgcggggcatctccagttccggccagaatgctggggaaggctttggtggggaggtggtgttctgccgggggccgtacaatccacccatcttcttgctacctgtcagcaagtggctcaccctgccgccactccagggcccatccatgatgtagcgtgttgatgctttgttccttcttacagctgaatcctattccattgtatggagagaccacagcttatctgctcatctgctcatccattgaaggacattgggatgttttctttcattaactgccaaaac

SEQ ID NO: 470521 - DNA, 897 bp, Homo sapiens
gtcacttgtgttactcttaaaatggagcttcctgagcctcgtcccagattaactggatcagccctgtgcctcactcaggaagaatcctcggaggagaactgctgcgcaagaggatttgccgttgtcagtgccggggctgtgggcatccctaaaacgtggacagaggaagcagagagaatggagtccaaacactcagatcctgttgtcaccccaccagggtctacccagcaacgccgagacactgaacagggccctccagggctggctgcatccaggaagacagcgctgctggcatttccgtgcatgagggtgaagcggcttcagagagcccacaggccaccctctaaaccagaggtctccaacccccgggccacggcagaaggtgagcagcagggctcccactgattctacgttatagtgagttgtataattatttcattagatattacaatgtaataataatagaaataaagtgaacgtggaagtgtacgagtataaaatgaaataaaaacattatatgcgtagatgtatagtgtgaatatatatcagtgtatgcttatacttgtgcatacccatgcatatgatgtaaaaatatatatagcggcaagcagatctgtaggtatgatcttaaatttggaaatcaatcaatcaatacatttatgtggagagttttgaaaatcacgatctggcaatccacgcaccacggggctcgcggtgatgattcctgggtcatgagacgatggcggcttcctgccctccctcctctcgttacactttcgatcttctgaatattttgcaatgagtatgtacggctctcacaatgagagaaacagctatttagcaataaataaataaataaaataaataaataatgttgcaaggacaagcagcgtttac

SEQ ID NO: 470522 - DNA, 523 bp, Homo sapiens
tgtccccagctggcgagcatgacgcgtacacctcggctgctttccacagggtggtgggccgaggctgctgtcatcccgggctgctgctaccctgctgctcccgcactctttgtggtcatcctcctgcattacagcccattttcaatcacgaagtgtgaccaggaggaggctggagaggctgtctatccgtggtttcctgctgttgaacccatggctggccctgacggaggacacctgcggaataggcacgttgtccacaacattctcaatcctcagcgttcacttggatcttgtgccgtgattatcactcgcatgaacactagcttccgccctgccttggccccgagcagactgcgctggaatgctcctcaccctgtcagcttattaatggttagcagctcttaataagtgagagcattggaaaaggctagcgctttggaaacctgacttctgtacttcctatctgtgtgggcttgggtgtgccttactccgtctgtgccttggttttctcactgtgtaatgc

SEQ ID NO: 470523 - DNA, 638 bp, Homo sapiens
ggccacctcaccccatggagacctcaaaatgctctccagaaaagaaagtctcagaaagtggttcccttgtagactctgaggcagttgctcctcagcaccttctattttggaagccagaaaattatttcttgattgacaaggggggcagtcctgtgcaccataggagtcccattgttgactgcatgtcagtagctgccaccagttattacaaccagaactgcgtgagtaaacttcctcaggatgcagaagccgctcccgacgataacaggaaggggcttactgaagtagagaagcaccaacaagaggactgggtgcatcaccacagcaacaaatggacccatggagagccaccctattatctcagaggaggaaaaactctaaggctacaagaaggattcatcccaaataattacatagctaatcaggactagacttatgacaggaattaaaggcacttcacgatccctttttattttctccattagtacgttgtaaccgtgtagaaatacagtacttcacagaattaacatattaatagaaatttaatcctgaagaaaatcattctgtgtatagaatatgcatcttctgggctttgtggtttcttttaaatggctagatgattgaatagcatacccttt

SEQ ID NO: 470524 - DNA, 1378 bp, Homo sapiens
ccagaaagcaactcaccagcaacaagatggtccccttttctctggggaggctcttggagagaggttggttctatgaaggaggtgccagggctgatggcgacagcctggagcatgctcaggaggcaggtggtgcagatggagaggctcctcatcaccctgtgcatgcagaagaatgccttacacttgaagtcattctgaaaatacagcaccagatgaaattctggtactttcacagcaccagcctcttcccaagaccttccccagagaaaagtgccactcagaccatcctgctcctagtgagtatctttgtggtcatctactgggttgatttcatcatcttattcacctcaaccttgctatgggcatatgaccctgttgtcctgggtgtccagaggcttgtgggcaatgtgtatgccactaacatttattgtgcatttacatttggagactgaagaaaatgataggagcagtatttctttccaagagcaaaaactttaacttgaaagagcccactgaagtggacaagtggatagcgctagccttagacactagtgtgtgtaaaacaaattgagggaaggacaccactgataaacattttcattttaatttgattaatattcatatcaagtaatacatgtttaaggtggtgaatatcatggttactctgatttgatcattacacaatgtatgcatgtatggaaattttacattgtataccataaatatgtaaattactatttgtcaatcaaaaataaaactgaaaaaagaaaccaaacaaaaataaaaataatagaattatataccaggacaaataatttatttattaataaataaattaaacctgattgaatgttggaacctcaagctaccaccttttcttccctcaccctctacatttcacgtactttgactgtccttaggaaatacagttgcctttccttggaatcattagtaaagattgagatgcttgcttggctgcttaagcatgtatgttataacacccaaagaataatgaaaacgctgttcaaaatttatggtgtgaaggaaagtaattagcttgaattatttttaattaactcagtgttgaagccctgtttcttctgtctcccgtatgtaaggtaaaaattttgaggaatttattagtattaaattatcatttaaggaggaagaaaatacagacctccatgcacttgaatgataactcacacatatttctggcttagaatgaaaggagatggaggtggaataatgtcttcattttaggcaggagcctctgagaataaatgcaatgggttaataaggcaagagagcctcaggatgctactttcttctccctttcctcagaatgggctgtgactcatcactcagggcttcttcc

SEQ ID NO: 470525 - DNA, 513 bp, Homo sapiens
agtccaggacagggtggcacctacgactctcaggaccaccctgccaaggcagaataaacctaatcctgcttgcaaggaagcatggagcctgggcacctctgtgcacctagcagtgaaatccatggctggctctgcaggggagatgttcgagtgggccacatgcccacagctgtcactcttcactgcacccaccaagggagtggggcaaggctcaccagtgacagccctggagcacagctgctctgcctgcaccctggaattttggctgctgcccagtgttcttctgagattacagccttgcgtaggatattgctgctgctcctgtgggagaaaaacgtgggtggacaatgtgcccggcatctgcctgcctccactgctccccctgagggagccctgccttccctggaacaggccagcagcacagctgccctccttccatgtgatgattttagccgtggcctggggccttgctgcgagaccagccctcacaggcctatgatctgtccttgagct

SEQ ID NO: 470526 - DNA, 1248 bp, Homo sapiens
tcagacagctgcactgggctctgagctgcaccatgcttgcccctaattccctgatgagtcaagaaatctgccaccttaaggtgcttactgggtggctgtggatgtctaacctcagtgccagccacacagaacctgaagcaggggtggttgctcctcttaatggatgtaaacctgtacagagctttgattctgcgtacacattccacatgagcaacaaagcaagaacctgtttcaaaaaatttttcttgagtaagaagcaacttataaattgtggaacaccagagcaaaagaggtttagcatttcaatggcaaaatgtcagaggggggaaaaaagcaggattctacttgctctgtcttggcagctgtctttggagctgattctcctttacttggagtttccctcatgcaagctctactctggttctattgataaaataatagtttgagtgtgctgtctgtgcaaatagtggacccccaaaaaatatcagatggtagacagacactgcctaacaaaattgtctgaatttaaataggatttaaatgaaacttataatatcactatatattgataccatattatcatataaaatttatttgatatataaaccattttgatatattatggtataatatcataaagcagtcattcacacaagaggagataatattcttaggtactattaagtttatatgttaaggtagttacaaaatttaactcaattttcttataaaattacctaacaaaattttatatgttatcataataatacatatgaattatatcacaaaatatgatgtcacaatgcttatgaattatgatgtcagaatatattgtgatgtcacaatgtaaacaaatatgatttcataatatattgtgatgtcacaatacatgaattatgatgtcatgacatatggtgatgttgcacatatattgtgatgtcatgatatactgtgacataatggatgtgaatcatgatatcataatatattgtgatgtcataatatatacaaattatgctatcataatatatcagatgtcataatatcatatttatttattatatttatgatgttaaaataacacaaaattttttcaggtaattttataagaaaattcagtgaaattttgtaacaacattaacatataaagaagcttacagtcatggtgaaagatgaaataggagcaggcataaacgctagaagtgggaacaggaaagatgagggagagatatgcctcacttttaagcc

SEQ ID NO: 470527 - DNA, 1020 bp, Homo sapiens
cacgacccgtctcctccctactcctcctccctgtttgcttctccctccccatctggaatttcctgactcccatggggtgccccccattctggggcccagacaaaacagatacaattattttaaatggaaacgtgaattccattgaattcatgacagcagaagggcccgagtgcttctggccccttgacttctcctacgctcctcctgctgttactatagctgaggaagatgtaatagttcccaggagttttccggtttccagaccttgcagatcggggagggccatcagctgcccccttgcttgttgcccacagccccgtttggctccaggcaaatgtgtcagggcatcctggtgggagccacagcagccatcttggcgaagctgcctttccatgcctgcattcccgtggcctcttggctccccaactgtccattatggcccccgtgcagccctcctcacattaccagtgaagggaatgtaactgcagaagatactaaggaggaaaatgagaaaaaaaaatgtcccgtgtattagagtaattgtcattagatcacctgtgttgcatacagggtcactctttatcattactgctgtaaaacctgtggcaattggaagagaaaatgatcctgagcatactctttgaatccctgaagttggtgtcagtaagtttcatgcagaaatttattttgaccatgacttacaaagttatgtccttgtagatcaaggcagtcaaaagagaacagttgttaatggaaaatggattgttcaactggaaattaatgtgacccttatgtacttgagcatagtcatgaactgaaaattggagagactgtgttacccttttacactcatcctagcactgatacctgggctggctgtgaaccacgacaagttagagctcacccttgccttgataagaaagatgaattgttaattggaccaactctaagcaaggagaaaaaatagttggaaataagaaaataattaaagaaaatacaattaaaatatgtttacagaaa

SEQ ID NO: 470528 - DNA, 598 bp, Homo sapiens
agtgtggcctgaatgtggaaggtgggacctgtcttccatttatctgcacttccacctggagctgtggcaccagcaatagagcctggtcatgaagtgtggcaccctcagactgctgtcgctcacctctgtgatggagaacaagttcagcagccctcagtagacatgcatgctgggcatctgggtgagggctgtgacacatgggcagggggcaggaagagggctccttggtctagcggtaacgccagtgcctgggaaggcaccggttacttagcagaccggcaaagggagtctccctttccctgggagagttggggaagactctgctccaccacttcttgtggaaggcctgacatgagtcaggcccgcccgcagtcatccagaggcctaaacctcttcctgtggtgctgtgcttcagcggtcacgctcctggtccactttcatgttccgccctctgcaaactaaatgtgacccttatgtccttgagcatagacatgaagtgaaaattggagagactgtgttaccctttcacattcaccctggcagcgatacttgtgatggctgcgagccacggcatggtagagctcacctttgccttgat

SEQ ID NO: 470529 - DNA, 693 bp, Homo sapiens
ttctgcggacatggccccccagggaggcagttcccagccggctcggagagctgaggggagcacagtcgtttcgcagggccagggtgacagcagaaacaagagatggctgtggatcccgctggccccgtgggtggacggggcgggggcggggacggggccgagcgcttgtggcccagcgctggggcctgcaggtggccctggaggaatccactcacacttacagtgggccttccaggagaccagtgtggatcgcgccttggagacgcccttcccagctggaacatttgtaaggctggaatttaaactcttgaaaacaaggtgccggaagaagaactggaagaaacccgagtgcaaagtccaacccaaggggagtaagcggaaatgcctggcctgcgtcaaactgggctctgaggataaggttgcggcctggatggtcactgctctatagagacgcaggctctgcgggaccctgaggagcaccaacgaccccgtgaagcaaggccgagcggacggacttaagtgaagagcccgacatttctattttttcttatattttaaaacttatttacctataaagaaaatgtgtagaataaaagctgtgtagacagatgacaggaatacagaaataaacagtgaactgttcagagggtttttttggtatttatattgactttcttgtgctttgtagagcaa

SEQ ID NO: 470530 - DNA, 701 bp, Homo sapiens
ggggcaaccacttcagaggccgatgtcagcgcgcagcgctggatttcattatttgtgtgaatttattgaaaacatttttaatgtaataatgtttttattgcaactgaggacattttcaataaatatcttaaacttgaggctctggctaagtattccttttgtactagaaatcagatttctctggtgcaattccattgcctgcaataatatttatgaaaactacaaacaccagcacactatatcaatactatactcagttgcctacgtgtgtttgccaaagctgaagctgaatcagagttttcattcctacaccatccttccccaggccctctctttcttaccacctcatcttctccaacatcatccgaccttcgttgctgtcagtaatttcagaatgaacagatgcaggagcaccatctctttggaaagttccttcacttccaatctgctcactatgtcttccaactgtatctttatattctaggtttttcaatgtctatacctcttcatagtgtatattctgtaaaccatatattactaagattttatttaattattttcttatttccaactcttttttgtccttacttagtgttgaaccaataaataattcatctttcttatcaaggcaaaggtgagttctaacctgctgtggttcgcagccatcacaggtatcacttccaggttgaatgtaaaagggt

SEQ ID NO: 470531 - DNA, 1098 bp, Homo sapiens
ctcaagacatccagagccatctaatacatattttcagaaggaatggtaccaattcctccttctacctctggtagaattcggctgtgaatccatctggtcccggactctttttggttgggtcccgccgagcctgagtctctataggacagtggcccatccggcccgaaaccttctcctcagagcccagtttgacgcaggccaggcatttccacttccttcccttgggatggacttcgcactcgtgtttcttccagtccttccgccggccgcttgtctgcctgagcttaaattccagtttcacaaatgttccagctgggaaggacgtatccaccgcgccgtccacaccgttctcccggaaggcccatgccggggagggtgcattcctccagggctacctgcaggccccggagctgggccccggagctcggacccgcctgcctccccagcgccccccgcgcccacccacggggccagcagcatccgcagccgtggcttgcttctgcggtctctcactctggccctgcgaagctcctgtgcaccgctcagctctctgagcccgctgggaggtgcctcctcccctgctcttcccctgggtggctatgcccacagaactctgggcagaggtcaaagagccaggaaatgtctctttctccaaattgactttggtgtgcgcctggttctctccactccctcctgccctgtccacactgttccctggggcccgcaggtttagcaaagttccctgccccctgcctgggccaggaagcagtcctgttgcccactcccacccttcaacccttttatggcccattctctctccccactgggtctcccacacgacaacccctcctccctactgtccccggagcccctctctggttctcgcgctcagcctcttccctgactgcttctccatctccatcctgaatctcccagctccagtagggtgccccccaatcccagggcccaggcaaaaccaacaaaattatttaaaatgggaatatttgaattccactgaattcgtaaaagcagaaacccatctggttatattttaaagaattatgaattaataatagcaactatcaatttaaagtgtaa

SEQ ID NO: 470532 - DNA, 789 bp, Homo sapiens
cctccacccatctgttcctttttttttttttttttaattcagttgctccagactgaaagttcctggatgaagacaagagtgcaagccttctgttatgcccagacagggccaccagagggctccttggtctagccgtaatgccagcgtctgggaagatgccattgccaagcggacgtggtgtagcggtagcatctgtgtcaaggaaaaacacccactacttagcagaccaggaaagggagtctccctttccccaggggagtttagagaagactctactcctccacctcttgtgcctgcagttatccggaggcctatccttctccctgtgatgctgtgcttcagtgggagaaatcccaccgaccctgtggggctgctccctacagtgcagagctgcccagagagggcttcaggccaggacaaagtcactgcacagggaagggacagaacaatggggtccctgctgccggcccagccgccatcttatgttctcctgctcctgccacaagtggggctgggccacaacacggccccgccccctttctcgggctgggtgggatttgtgcggctgcgttctgggccctgggcaaattctgacccactctaaacaatataattctaaaatgaccagaaaactgcatgcaacttgtctgggcacttttcatccttttcatgaatctccttgaagacacaatactccaggattttgtgtgcttatgaagattttaggaactgcattagaattaatccattaactgtggaaatatcttaaaatgcttataaaggcacatc

SEQ ID NO: 470533 - DNA, 490 bp, Homo sapiens
atagcccaggaatacttaagggaaagttgagatagagggcagtatgcctggtaaaagtcttcaccattctccattcttgattaaccagggatacaatgcactgcggagagccacagggacctttgtccaagaaagcctgtgtattgtccaggaccaagttggcatgggcagcctggatgggctggtgagtcaggaaaccctggtgatgcaattcccagctgacagcactctcccaattgcaaagagtatcttttcacttctccagttgctaggtcagaggggacccatgggcagctccgcaggtcattttaaagtcagggaaatgcagaaaaaaaggataaaattgagtctctgtcccagtgtactcctgcccccagccaaccttccacctctctcattagtgtccctgagatgcctggcagtgccttgggccctcctttcatctgggtttcagcccactctgtcctcttctacttcctgtctttgattg

SEQ ID NO: 470534 - DNA, 1756 bp, Homo sapiens
tggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccatttgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggacctgacacatagaaggtgctaagtaagtattcactgcttaatgcaagcccaagtagaggcccgggcgtatgtctttttcctgtgctcctgtaaactccgaagtcccagtaagttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttattgacatcttctcacccactgg

SEQ ID NO: 470535 - DNA, 1296 bp, Homo sapiens
ggtatggacaggaagactagcatgtggggaagccttcagctacagtctgctttctctaggggatgcaggaacagggagaatggcagacgagccacacagttccaagtacatcttaagaagcacactctagatgcagaatgaagattcacttgggagaggcagggagcgggtatgagacgcagatgtgagcaggtcaccttgccagggccctccttcttgggagctttcagtgtgagtgcgagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccaaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtc

SEQ ID NO: 470536 - DNA, 1491 bp, Homo sapiens
gttgccctcatcggaagcagccgcccagttgaaatggtcatcccaacactctgcgacaggccagttgtttccaccttctggttatggccaatcatgctgctacgaacacaggtgcacaaatatctgcgggactccccactttcagttctttggggtgtattcccagacgcgaaagcagttatgcaggtggcaatgcctcacctgtcccctatcatgcaggcccgagggcctccaccctgtcaaggccctaatggcagctataatttggaagtcaaatgcagcagggagctcttagagctgatgcatgattcctgcatacaggcagccaaggtgagattggggcctgcctgctgcggaagtgaggaacagacgttggagcaggagagatggatgaggagagtccggtctacgtgttcaaggaagcgaagggatgaagactcacctggtgtggagaagaacaaagaaatcctgaaaatgttcattggtttggcagtggagggatggccacacacgctcctgaccctgctcttgccatatctgccctggatgcacgtttcggccacgtgccgcctggaagcaaaggatgtaggtcagcattcatgggagcagacagagatggcccaggctacaggtcccggctgcccattggagaacgcagcttggaaagtacacgctgatgtggccgctgagaaccaacacccctttgaccatgagaaggtgccttgcctcctcttcaccttccaccatgattgtaagttccgcaaagcctccccagccatgctgaactggatactcaatatcacatctaatttcatcagctgaaaagaggattctttcctcattgaattgttttgtcatcttgtcatatttgcagaaaatccactggctatttatgtgtggttctatttttagtctattctgattttactagaaaaagtaagatataccttctttttggaaaaacggtaacaccaaatgtagctgaaaaaacaatgtaacaatgccaaaaaaaaaggcaaaaaggcacttatattcttatcaccctaaaacccgtatatatatgtgtgtgtgtatacatatgtatgtttatatatgtatgtatatatgtatgtatgtaagtatgtgtatatatatgtatgtgtatatatataatatatgtgtgtatatatatgtatatgtatgtgtgtgtatatatatatatttcagatgactctactcaacctgaagatgacaaggatgaagacctttatcatgacccacttgacagagagtaaatatatactcttcttcttatgattttcttcataaccttttcttttctctagcttactttattgtaagaatacaggatagacatgtaacatacaaattatgcgttaattgactgtttttgttattggtaaggcttctggtcaacagtgggctattagtggttagatttctggggaggcaaaagttatatgcagatttttgactgcatgggggaatcag

SEQ ID NO: 470537 - DNA, 1203 bp, Homo sapiens
ccttcagctggaaggaactcagtcactgctgtaggaggaagtctgagacccgcggcccatgatgcctgactcccgggctcctccaggtgtttccctctgggataagctcctgctgctgcacagagttcctcgagatgattgcagctttgcagccttatatacaagggctgcagccagaggagagctgctggtcctcactctggagactggaagtacctctggccccagcgaccttggtgttttattgcctgatgctttatttgggagaacggaagctgagcacctgggtgtgcctggaaggcgctgtcctgggggccccacttcagtggaaagccagcgttcctcaggctatgcaaacccagtgttcaacagcgacacagttttgaaggttgctgacctcccccatggacccagaatgcccccagacttcacggacaatagggaaggtgaggatcttcaagatgcaatactggactttctacaaataaagacaactgggatcaagcaaggccatgtctgtttgtataatgacgacaatgataactgtaatgatgacggtgatggtggtggtgatgatgagagtgataaagatgatggtgataatgataaacatgaagatgaaggtgatgatagtgatgaagatggtgatggtggtgatgaagatggtgatgatggtggtgatggtggtgatgatgatggtgaaggtgatgatggtgatgaagatggtgatgatggtggtgaaggtgatgacggtgatgatgaagatgatgatgctggtggtgatggtgtgacaatgattatggtggtggtgagggtgatgatggtgatggtgatgatgatgctgatgatggtggtgatgatgatggtgataatacgatgatggtgatggtaatgatgtgacaatgattatggtgttgttgatgatgatggtggcgctcatttggttaatgataacaatccaattcattgatcattgtcctttactggtgcttgtgacataccagccactgggctatgtgcttctcacatctcacttagttttctccctatccctgaggacttcagcaaggagcatgaacttctaaaccatagctgcctccgtgagctgggacccactgtactttctgaaccccccagccacactccaggtcagaggctaggatgggggccttttcccatcccactcagtacagtgcccagggt

SEQ ID NO: 470538 - DNA, 694 bp, Homo sapiens
agcagtacattcagtgcctgctattaccttgccctacttctgtctttccccgggactgacttcatgctccagccctgagtgagtatctcatgggccatctgtgcacctggttggagcttgtgcatctgcagcgttctgtggtgaagcagtctgatgttgatggggatcatgaggctgtccctgggatcactgtgaaagccaactctctaagggcctgcctgagtactaccttctttgtgaagtattccttgtgtgcagctgatgttgaagacagaaaaatgtatatagataattcagccagagaccaaggggcagcccctggtggagtgttaagccagatgttcccaagcacaggcatggccagccgcagccacatcatgggtcagagtcctgggccccagcttggactctcctgtgatggggtcagagattggcatttttaacaagctcccaggtgattcttaggcattacttggtgagagaactcctgttagaatgcctaagagtaaaattctgccacgctgtcccagagctgagacctcagtcgctgcttctcaaaccattacatttaatggcaaaaactgcaatcgcttttgccccaacctgcagggcaggaccagttgttaaaaattccttgatctaatgtgaaccaaaattgcaattaaaatgttagtgggcatttccccatttttgt

SEQ ID NO: 470539 - DNA, 895 bp, Homo sapiens
aactcattttcacctcctcttgcaagatggttgtcagggctctttcttgtgaatttaggcagcagatcccttgcagccattgttcctaccgcctctgtgactaccgcctctatgaccgacgctggtactacgactgtagccattgttcctaccgcctctgtgactaccgcctctatgaccgacgctggtactacgactgtagccattgttcctaccgcctctgtgactaccgcctctatgaccgacgctggtactacgactgtagccattgttcctaccgcctctgtgactaccgcctctatgaccgacgctggtactacgactgtagccattgttcctaccgcctctgtgactaccgcctctgtgaccgacgctggtactacgactgtagccattgttcctaccgcctctgtgactaccgcctctgtgaccgacgctggtactacgactgtagccattgttcctaccgcctctgtgactaccgcctctgtgaccgacgctggtactacgactgtagccattgttcctgccgcctctgtgactaccgcctctgtgaccgacgctggtactacgactgtagccattgttcctaccgcctctgtgactaccgcctctgtgaccgacgctggtactacgactgtagccattgttcctaccgcctctgtgactaccgcctctgtgaccgacgctggtactacgactgtagccattgttcctaccgcctctgtgactaccgcctctgtgaccgacgctggtactacgactgtagccattgttcctgccgcctctgtgactaccgcctctatgactgatatttctcctgctcctcctattactccctgcactgcttctatcactgccacgttactgccttgactctatgattactgctgct

SEQ ID NO: 470540 - DNA, 589 bp, Homo sapiens
cgtccctgatggataaggaggatgctggtgaccacctcgggctggggcttggagactggtttggggaaaacagtgattccagacagctgtgcctgctcagcccgggcaaggccacgagactcagccaaggagcagcttcgctcagggcgagcctgctcttccgaaggcccgggtgaagctgctgcagaatgggcctgggggaatcacctcctccccaccttccgcttggccgggctggcgcctaacacgcgtaacttctcccctgccaagaggagacgctggtgggaaggcagcctgactgctgacatcagcccaatcttgacttctaggctggagtcgctccttcactgtccccgctgcattctatggtatgactgtgctatcactgacccactctcccatggaggggcacctgcttggtttccagattttggctgtcactgtgggacctgcatgagctgagcatgtatgggtcacctggctttccggagcctcagtttccttatttgcaaaacagggatgatgttggtagtttctgtggctccacgtgcttgtgtggggctcttgggtgagtgcctgcacctgactc

SEQ ID NO: 470541 - DNA, 1353 bp, Homo sapiens
ctgcagaacatgaaagacaaagaaatgtctgcaagcagccggagagaaaagccctccccagtggaacacagatcagtacatttaagtcgagagactgggacttcaggccctaatggcagctataatttggaagtcaaatgcagcagggagctcttagagctgatgcatgattcctgcatacaggcagccaaggtgagattggggcctgcctgctgcggaagtgaggaacagacgttggagcaggagagatggatgaggagagtccggtctacgtgttcaaggaagcgaagggatgaagactcacctggtgtggagaagaacaaagaaatcctgaaaatgttcattggtttggcagtggagggatggccacacacgctcctgaccctgctcttgccatatctgccctggatgcacgtttcggccacgtgccgcctggaagcaaaggatgtaggtcagcattcatgggagcagacagagatggcccaggctacaggtcccggctgcccattggagaacgcagcttggaaagtacacgctgatgtggccgctgagaaccaacacccctttgaccatgagaaggtgccttgcctcctcttcaccttccaccatgattgtaagttccgcaaagcctccccagccatgctgaactggatactcaatatcacatctaatttcatcagctgaaaagaggattctttcctcattgaattgttttgtcatcttgtcatatttgcagaaaatccactggctatttatgtgtggttctatttttagtctattctgattttactagaaaaagtaagatataccttctttttggaaaaacggtaacaccaaatgtagctgaaaaaacaatgtaacaatgccaaaaaaaaaggcaaaaaggcacttatattcttatcaccctaaaacccgtatatatatgtgtgtgtgtatacatatgtatgtttatatatgtatgtatatatgtatgtatgtaagtatgtgtatatatatgtatgtgtatatatataatatatgtgtgtatatatatgtatatgtatgtgtgtgtatatatatatatttcagatgactctactcaacctgaagatgacaaggatgaagacctttatcatgacccacttgacagagagtaaatatatactcttcttcttatgattttcttcataaccttttcttttctctagcttactttattgtaagaatacaggatagacatgtaacatacaaattatgcgttaattgactgtttttgttattggtaaggcttctggtcaacagtgggctattagtggttagatttctggggaggcaaaagttatatgcagatttttgactgcatgggggaatcag

SEQ ID NO: 470542 - DNA, 787 bp, Homo sapiens
cgccctggggacaggcggccaccaacaggcacctggcaggtcctccatgcctgcagcaggccccgtggagggcgcttcctgccccttcgcctcccgctgcggcgtccatgggcttgtggttgcctcggccccaatctggactccgagttgctcaaccggccatgcttttcctgttccccttttcccaggcgggtgcagctcctgccggtgtggtcccggcctctgtgggctcaccgcagggaagcacagcccctgcacggtggcccccggggctgtgcccacaggtgcccacgtaccgcccaggccacacagacgtgggaggatcctttgaaacacctacacccaaaaacacctacacccaaaaacatctacgcccaaaaacacctacaataaaaaacacctacacccaaaaacacaaccaaaacacctgcaaccaaaaacacctacacccaaaaacacctacaataaaaaacacctacacccaaaaacacctacacccaaaaacacctgcacccaaaaacacctacacccaaaaacacctgcacccaaaaatacctacacccaaaaacacctgcaaccaaaaccacctacacccaaaaacacctgcacccaggagaatcccttctgtggggagggcgggggcgagattaacactgggtcccggataatgtggcattcttataccagctgatgggtccatggggattcactgtattaccctttatacattctgtgtgtttgaaatcttttataataattttaaagcaaaaaactttacataataata

SEQ ID NO: 470543 - DNA, 1470 bp, Homo sapiens
cacatatttcttgagtacctaccatgtgcaaggcaccgtgctagatgctgaaggggacagaaaatgtgagatacagttcctgttcaggaggatcttgtggtctagagagtagtcttggcttcaccttcatcatcaccatcaccatcatcattatcattgccatcataaccatcaccatcatcaccatcatcatcatcaccatcaacatcatcatcaccatcaacatcaccatcaccatcctcatcatcaacatcaccatcaccatcaccatcatcaccatcactgtcctcatcatcaccatcaccatcatcaccatcatcatcatcaccatcaacatcatcatcaccatcaccatcatcaccatcatcatcaccatcaacatcaccatcaccatcctcatcaacatcatcaccatcatcaccatcatcatcatcaccatcaacatcatcatcaccatcatcatcatcaccatcaccatcatcatcaccatcaacatcaccatcaccatcaccatcctcatcatcaacatcaccatcaccatcaacatcaccaccatcaccatcaccatcctcatcatcaccaccatcatcaccatcatcaccatcattgtcatcatcaccataatcaccatcatgatcatcatcactgtcaccatcaccattatcatcaccatcagcatcttcatcctcatcgtcattgccaccatcaccattgtcatcttcataggcttaaagacaatggtgtctgttctgtttctcctgtaaccttagcttctaggatattgtctggcacatattaggcattcaataaacacttaatgcatgccttgtcatcataaatcatgctaacagctatgttgtacattgtgtcacctaatcctgcaaccctaagatataggaggtatggttttctgttccagatggagacaccaagaaaggccgaacaacttccaaaggctgtatgtcaaacaggtgataggaccgggattcagacacaagtctgtccacttccagggccagggtgttcagccttgagccatggtagcctggctaatagcacagacttcagataagagttgagctcagagggagcaagcccttgaggccaacttggtcaggggtggctgtggcttggctcctccactggatatcgaggcaagtcatgtccagataccagagagtgccaactggaggtgaccacatgtggtcagagggtgtggccaacaggggactcaggcagtcattctgtgtgcgggcttcctggctaatagccatgtaggcttctggtgctgcccaggcatcccacacaagctgtgggtgtgctgggctggaggggggtccctggggttttccctttgatcaggagccttctggggatttgggggaggacgcgtcttcagactctctggggtcacctgggaagcagagtcatgaggctgcccagaggactttcccagccattggggccact

SEQ ID NO: 470544 - DNA, 674 bp, Homo sapiens
tgaatattgaatgaataaacaatcaatgaaccattcgcgcattgggcagcccccagaatcacagcagattcacagatactccagggatgtctcgtggtcagaacaaatttatagaccaaaaagaagaagaagaagaggaagaggaagaggaaggaggaggagaagaaaaagaagaagaggaagaagaagaagaagaagaagaagaagaagaagaagaagaagaagaagaagaagaagaagaagaaggagaagaagaaggagaaggagaaggagaaggagaagaagaaagaaggaggaggagaaggaagggaagggaaagggggaagaaagagaataagaagaggaggagaaagaggaggaggaggaagaaggaggaggaggaggagagggagaagaagaaggagaacaatgaagagaggagaagaagaggaaaagaattcttgaccttctttttctcagtttggaacttggcagcagtgttaaaagaattattatttaatgtgccaaacttcaatgaatgagcaaaatttggtcctttggcataacatagaggctgaatatcatgaaatggatgtctggaatcattgtcctattcaaactattggacttcaggtgattgaattgctatgcttcttttgaatttagtgaaatgtttagaatactgtttattcact

SEQ ID NO: 470545 - DNA, 500 bp, Homo sapiens
aacagaaagttactacactggataggttatgtcttggctttcccttctacgaaagtttcgaccacaaaatattgacaaggatgaggggaaaccggggttacagactaagaacttgggtactgtagaaaaagagagtagcacaaaatccaaggctgagaaagtgaaaaggtgcttcagagaggtgggtggcagtgtaggagtgaaggaagagccgacaaggaaatctacagaatcctctccccttataccccaagccccaggaacctgcccagcatacacccccagcactgattccaagattttcttaagctcggcccctcgcttgctctgctgtatagagcagctcattcaccagctctggccaataagtccacagaagactcaagtttgccctgaaatacaagggcatgatccttgtcttaccacaggattcttcagatcaaatgcatatatgcatacatgtgtttcttcagaacactgtagttcacactcatagtaga

SEQ ID NO: 470546 - DNA, 919 bp, Homo sapiens
ctctctctggagtcaagaggacaggaggaaggtctgggtgagagcagtgatgggggtggtggaggaggggagaacaggcctccttgcatcatgaacccgccagcccagctgtgctgtgtgcaaatgttcactgggctagctggaattcttaacagacattccaagaatccaggaggtttctgggcagataatggtatcacgtacgtaagtggagaatcctggatggaggtcgagtttgagggggctgataaagagtttaggtttggacctgctgattttaaatatgtagtagacaatgggatatggagagctagtgctaagaaaaatggtccatacatattagaaatgtcatgtaattgcaatcatacagtattcacactctatgattctatttatatgaaacctagaaaagacacatctatagtgacagtagatcaaggttaccagggtctagaagtaggggttttgtggggaggatgtttgactgggaagagacataaggaatcttttgggatgatgaaaatattctacattttttttttgtggcggtgattacacaattgtatacatttgtcaaaacatagaagtgtacccttaaaatgggtgcattatgttgatgtaaattataagttaataaaattgatttaaaaaaaatgacacagaggatggccactcactttgtcctgtttcctccaatggtaacatttgaacatatagtgtaatagtatcccttatatgtggaaatatagaatgacatagtatctattatatgagggtattggcattgatgcaatccactaacctcaatcagatttccctaatttcacttgtgctcattgtatgtgtgtatatgtatgtataggcatgtgtgtgtgtgagtgtagtgttacacaagttatcccctgtgtaggttcattgt

SEQ ID NO: 470547 - DNA, 982 bp, Homo sapiens
agttccttcactctctccttccactattctgtcttctttcttcattaccaaaccatattattttactcatgcaggctgatcttacagaagcagtggaaactgcatcttcagaaggtctacatgtgaatgcagagattgaagttcttcaacaggcattattatatatgaaaacaatgcaagagaaacgtgaaacactacagaaggatcaggagaagttggaagaagaactagtaaacctcaaaagtcacatggaaatgaatatgttagaatgtggtcaattggaacactataaacaggagtcacagaaaatagctcatgaccagttacagttaaaagaggaaagcaatgctactatgaaaagtcagatggaacttagaattaaagatctggaattcaaactctacaaagcaagaacttcacaagcggactgtaatacaacagaattggaaaaatataaggagctgtatctagaagaattaaaacttagagaatctttgtcagatgaactaaacaagtctcagcagaatacatattccaagagaagccttaagaattcctaccttaaactcattgtcttcaaatatcagaatggagagcgacttgtcaaagatgtaaatgattgatattcaaacacctaaccacatatggatgattattatgtaaaggaatccaggataaatactttttatgaattctatgaacctgtaacactgaaaaagatttcttctgtttttcagtttaaagttttgtgattttcttacatgaatacatccttaattgctattgtacttttagcattttaatatcaattgttgtaaaatgtgcccgttgctgtgcaatcgtacagcaatttttaaatacttaaagcaatatttgaattcgtaaagtgaagttcacttatgtctatcttaccatcacttgaatgatttatggctaagatggcaatgatatcaaaagtagttaaatagcaaatgtgaccaaa

SEQ ID NO: 470548 - DNA, 1196 bp, Homo sapiens
tgggaaaagcccaaagctctggctcctaaagggaaatagctgttgtatacacttcccagacggggcagccgggcagaggggctcctcacctcccagaaggggtggcggccaggcagaggcgctcctcacctcccagacgatgggcagacgggcagaggcgctcctcacctcccagacgatgggcagacgggcagaggtgctccccacctcccagacagggcggccgggcagaggggctcctcacctcccagatggggtggcagccgggcagaggcacccctcacctcccagacggggcggccgggcagaggcacccacttcccagatggggcggctgggcagaggcacttctcacatcccagacgatgggcggccaggcagaggcttcctcacttcccagacggggcggccggccagaggtgcccctcacttcccagacggggtggccgggcagaggcgctcctcacatcccagacggggcggccgggcagaggtgctcttcacatcccagacgatgggcggccgggcagaggtgctcttcacatcccagacgatgggcggccaggcagagacgctcccctcttcccagtatcctctgcttgacttcttggctcttgcactaccggtgtcaccagttccccatattaaactgctgctgtttggaggcagaggctgtggaagggacacagtcactgccagagacaacagtcagcaccaagaagagccagaatgtgtaggtttctatcaaacgtcccctccccaatccttccccaagcacacacagagaatcccggatgctgctagaacacttccaccactggaaagctcaggaccctccatcccgttggtggctgccccagtcattacagattttcttcctttcactgagccaaatctgtccactggcttccaggaagaggaggcctggtctgtgcccctgcctggcaaagccccgtagactttcctcaatctttcaagtgtcttctttatcttctatcctgcttacaacataagcaccacattcagctttgggttttatatgtcggcctgctaagtatctgaaccaggtttatccaaaatttgtcacagtatatgaattgatgttctttgaaaaagaacaaagaaagttttatggtcaaataagctttgaaaatgctgggttaataagctttggtggtcacactaagtgttcatct

SEQ ID NO: 470549 - DNA, 686 bp, Homo sapiens
gattggaccccatcttaacatctcggatcctcaacttgctcccaattgcttaaacacagctgtctgtcctgctccctcttctcctactccccaaaatactacttggcacactctttctatgcactcgttgatcactgaatacctagaggatgctgggcatggtggcaagtgtggggaggcacattcagaaagaataagacacaggctgtctccctccaggggcctgtatttgcactttaaattgggatttttcaacccaaaaaaggctctaagatctaaaaatgcagctcaaatggtagatttttcaggaacttatcacactcgattgcagctgtctgtctgtgtctaccaccagacagtggaacccattcctattcatctttgtagctcatgtctctggcacatagtgccataccagagacatgaggtaaacatttatcagatgtataaagatgtgcacaactccacattagtcacacacacacacatcattgtcatcatcaccatcatcatcgtcgtcgtcatcattgtcatctactgtattcacatggaaaaagctggtcctagctctgccccactacgtggtgcctggcatgaatacctgcttttgcaacatgctaagaaggaaggcttcataaagccatagttgacttggcagctggagaaaagtacaaaggcatattgca

SEQ ID NO: 470550 - DNA, 678 bp, Homo sapiens
tgactaatcaacccagctggcattggccaccatggactggcaaccaactggcctgtggggcatggccgcaccacacgaacatggcccttctcactgcacagaagaagttgggggcggggagcggcagttctcagagaagagaaaaagaagaagaagaaaggaagaagaagaagaggaggaggaggagaagaggaagaagaagaagaagaaagaagaagaagaagaagaggaagaagaagaagaagaggaagaagaagaagagaagaagaagaagaagaagaagaagaagaagaagaagaagaagaagaagaagaagaagaagaagaagaagaagaagaagaagaaacaaacaaacaaaagggccaccgtgcaaaaatctaatgttggtcttctgccctcagaacaaagccccttctccctgtctccaaattgcagcagagttcagctgggcatgggcaagctggagggggttggcctggagctggtgggggtgttttccatcatgacggatcctgctgagaaagaagccgacaaaggaaagccagaccaagcctggggaaaaagagagttctgaagacactatctgagcacctggatccaattgtgcctgaaggtggtccacccctcagttgcctgctggctaggcttatgaattctccctttgaaagctggttgtaa

SEQ ID NO: 470551 - DNA, 1717 bp, Homo sapiens
accccgatggacattagtgcaggatgaagttggcttggggtgcagccccgaggggcccccctccctgcatccactctgtgcttgactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccggggaatctccctatctcacccagctccctgactccctggcctggccgcaggagctgaaggggccagggagaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagaggaaaggcggggtgctggcccagatcaagagccagaaagtgcaggacatcctcgccttctatctgggccgcctggagaccaccaacgaggtgattgacagtgacttcgagaccaggaacttctggatcgatggcaagggtgtgttgagggcctggagcccagagcggggccagctgctcaccccctttcccggggagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgaggatgccctgttgatggccttgtacctgtgggctcctgagcccagaggggcaatgacgggcccagcttcatacagcaaggccacgcaggaaggactagagctacagctctgcaggggatttctccaaggaccctctcctgtcatgaaagctgcttcctgggaacctgttgggttccttggtgttcccgggagccccatgaactgtggtggaggcggagaccctgtggggcagcggagcttccctgtggcatgaaccccacggggtattaaattatgaatcagctgaacctgtgcatg

SEQ ID NO: 470552 - DNA, 982 bp, Homo sapiens
tattgacatcgatcgcacatcgccaattaacaaattgattattcgtaccacactggccgattttagcgacggtctctaggaaatcctgatggtggaagtataatgttccggccatctagcaccaggtgacaagcctgttctatatcctgcccacaggtaagccctccctccctggtcggcaaggcctggcgagatggtaaccgctgctgtcggagctgggcgagctgcgatcttcgcgcatcacgccggccgtcatgcactggctggcgccgcgcttcccgcagctcgacctggcacgcatgcttgccggacttcctgcgcccgctgccgctgccctccaacggtgccgacggcgtaaagcgcacgccgaacttctgctagggctgcccgcacaatacctagacccgtgtgccggaaggcagacgaacctatgccggcatcggctgccacttcatggtcacctggatgaagcgcgacacgaattacctgttacatatgggcggcgaaggcgtcagctgggccgtggctgcgcgcaccaacatcacctataagatcctgtacaacgacgcgccggaaaactatgcgcaagtgaagctgcccgacggcgtgaccgtgcaccatcggagcgagctcgatgtcatccagcgcgacttgcgcgtcatccccggcgtgacggtgctggtgtacgaccagacatgcgccgccgagaagcgtcgccgccgcaagaagaacaagcctggcaagaccgtcttccccgacccggcgcgccgcatggtgatcaacccggccgtgtgcgaaggttgcggcgactgcggcgtgcagtcgaactgcctgtcgatcctgccgctggagaccgaattcggccgcaagcgccagatcgagcaatcgtcctgcaacaaggattattcgtgcgtcgagggcttctgcccgagcttcgtctcggtgctgggcgggtccttgcgcaattactaatcaccatcgc

SEQ ID NO: 470553 - DNA, 958 bp, Homo sapiens
acccccagcccacggcaggactctgctccagcaggtctgggaaaagggatgaggtccaggtcctgcctaacaagtgcccaggtgatggtgaggccaccactggtccacagacagcatcaggagaagcaaggccttgcagaaagtagatgcttggagaatggagaggggaagcaaacacctgaaacatggcactgtgtcctacacatagtacaccctggcaaacataagcaggctgaattcatggaaggaaaggcttgcatggctggtcgtctgctcatcagtccaccatttgtgggtgtgcactgccagcctggcagaggattagaggactctgcatgtggcagtggcctttcagacaacactgtcctaaagcccgtttccctgtctccaagtgggatgagggggctctcttcatcaaatcctacttacgggaccatctgtgtccctgaccatgtaaataggcctcttgactctcactcaagcattgttgcaaattgtcctcttctccacactaatgctcaaggctgtgggacactgcaaagaacccttcttccattagggatttctctgtctaagcaggatttatgatgatcctttggcaaggatctttgaatcactggcattcacaggacagccaaagcatatttcaggagactctattgctaacaagcaatacagccctgaagatttatctcctctgatgaagcaggcaaatcctaatgctcccaggatgccatccctagacaatgtgctattgcacagccagcgtagacaatgtggtattggatacaccaactctctcccaaatagctgtgtgacctcagggaagtagttaaacctctcttaccaagttatctcatccataacatataaatgattgtgttttcttcttagggctgtcatcaagattaagatgttgaatggaatcaaatgcctgatttatcttacacctgattta

SEQ ID NO: 470554 - DNA, 806 bp, Homo sapiens
aactggtagtcctgacatctgtacaagtctggctgagtccagggtttttatgggctcagaatggaggaagtgagtgctgattggtccaaggatagccatgggtgggcctggaaaaagcaccataagttctcactctgggccaaggactccacctggagctggcagctgagcccccacgcttcaggccatcctggcttgaatgtggggtctcacctgggacctaaccctttctgctcaggagtctgtctgcctcccatcttcaacatgctgtccacagcacccaggatgttcatgctgaggggcacctgcaggcccacactgagctgccctcagcccacccctggcctccctcctggactcctcagtgtccaaagtctggagggggccaaggcaactgggggaatagcgtgtcagcactgccctgagtgcacacactcccagccaggtcactacagtgcttgggctcagctcaactttcctccaaaatcagagcaggtgccagcatgagggagaggccagggagtgggagcaggcaattctgagcctgtggggacagagggcttcctgagcccccaagagtgcagggatgcccagctcctatcttgtattctgtgtctctggtcactcagactgaattctcaagagataaggcaagagctttagatccagcgtgattcttcaaaaggcccattttcaccaatattttagtggcttggtccatgaaaattgtctgtgcttcatttccagtgtctttcttggccatcgtatcttcagatttcctgtttaactgtttcacattcatctca

SEQ ID NO: 470555 - DNA, 605 bp, Homo sapiens
tcaagacttttctggttcagaatgtatatttttggtgagcttagttcaaatagtcatgggcgatctctgggggttatttttaaaatggaatatgtggctttatcactatcagagagaaccagaaaattcctgtggtgtcataaaacaagtctcaacgctgagaaaacaatgaatactgctccaagaggtcagacctggtgtctgtatacattaaatgctggtgcatggatttacagtttgcgtagacaactacatcattacttcaaagcctttacaagcacagacattacaaaaggcctggctgtaactcaggagggacaaaagtgctgtggtgatattgacggaacggtttacatggaacactttttgcaagcatggtttcatttgtccctacctcaaacgggtagatggatgacaacagagagtttaatactacctgacgtgagataaagtgtgatgcaggacaagtcagaacagaaagagaaatgatcttaatcaattgtggtcaaaatattttcattttaagcattttacaaaattgtaagacaatgtgataatactgcagaaaaatactgacacagacatattctatatgtcctagtact

SEQ ID NO: 470556 - DNA, 555 bp, Homo sapiens
ccgcgagggtccgtggcttcattcttgaagtcaaaatgctgtctgggagccagggactggcatcaaaaccctcagcaatttacctgatgttctcttgtactgcagctaagctggcacacaaaccacaatataagttactttccactctttcctctcctttccatggacactggagcctcattctgtggccatctccaccactgaactcacctttgagggtagtggactctcccctggcccagtgtagatgcagaaatgctgtccaaaagcctacacctaaacttggggacctcaagagcctgcttattgctctaacccgctgtggtcaagctgcaaagaatctaatcagcagcattgctttagtgcccatcattaaaaagcttaactgttgcaccatttttcttttctgctttatgaaaaactcatttatgtaccatttcaatgctattgtaattgtgagcagataagtaattcagtatatagtctgaaacatagcatggctaatgtttagttccttttaaaaaagatattgctcttttcaactgtgaattcatg

SEQ ID NO: 470557 - DNA, 571 bp, Homo sapiens
gggtgacacctcagacaaggaggccagcgctaaagatctgacaagatgctgtcttgctggccgcaggaatctggagttcagaacggaggtctagacacagcgggaggtgacatgaaaaaggcggtcctatctttaccaaagaagaaagaggataaatggagctatgtcaagactgtgttcaggaacaagaaaagtaaactaaagaaaaggaaaggagataaaagaaacaaacataaaaagaaaacaattcacctaagtttatgggaaagttcaggaagtcaaagcaaagctgaagaatcagatctgagaaaggacagcagtcaggagctagggcaggttggggatttaagggaactaataaccttgggcattgcacttaaaacaagcataagaagcctcgaaaaggcaaaaagaagaaggctcacaaactacacaacttgggactcaaggaacagcacagtggggagttcctttagttttctctttgcctcatatattcccacacttagaggagaagaagccagcaagtccgaaatgccattcagcacagaagaaaaaatactataataaa

SEQ ID NO: 470558 - DNA, 907 bp, Homo sapiens
atataatctcctcgtgtgctgtttgctaagaccattggaaaagcacagtatcagggtgggagtgtcccgattttccaggtagtaaagggctctgcagaagtatgaatttcatatgcaagccaaccagtcggcagtctctaccctccaactaccctctttatttagttctcccacaccaaaccagtatgtcccctgccctaagtcaacccagagtgagataccaaagaacatctacaagcatcatcaccatccaggaaaacatgacctcaccaaatgaactgaataagccaccagggaccaatcctggagaaacagaaatatgtgacctttcagacaaagaattcaaaatagctgtgttgaagaaactcaacgaagctcaagatagcacagagaaggaattcagaattctatcagataaatgtaacaaagacattaaaataattaaaaagaatcaagcagaatttctgaagctgaaagatgcaattggaatactgaaggatgcatcagagttttttaatagcagaactgattgagcaggagaaataattaggcagtcacatgaacatgtacatctatctcatccacagcacttttccagttgaattttacactggtgtataaacatttgaataatatctttatcactattagactattaatgtcacaagggcaaaaaatgaagtctgtatttgctaacaattatatccctattgtcaaggacagtgctgagaacatcgaagtcactcagtgaatagttattgattgagcaaatgaagatttttagcattaaataaaaccatatatgtagaagatctggtacatattaagttatattttgtaattagagtaacttcttttggacgtaatttggattttgtaaaatatcaaatgatagtttatcaaaatc

SEQ ID NO: 470559 - DNA, 536 bp, Homo sapiens
ttctcacttaggctccaccagtgggtatggccgatgagtgtgtctttctggattttgttcaccatggcaaccaggatctccgagcggccgcagctcttcatggtctccaggtagcagcagatgagcgcatcggtcttcaccttgttcccccatcagtagaagattcctggctacagctcgtggtgccggcccacagagcactggtcctcgtagtagacaatgacctgctggccccgggaccacagctgccacagcgtcagcacctcctgctgtacaaatatcagctcatttggtcagaattgactaatgcccgctggatagcattctggggcaaaagcacacttggcagcaccagctggagcagctccagagagtgtggagggagaggcatggctcagacagagaaggcaaagaaactgcagggccctccctggtaaagactgagtagtccacagaggctgtgctggctgttggtttccttaccagtgaaaattcttggtttcctctgtggcgcagctctttgtggtccatgatgg

SEQ ID NO: 470560 - DNA, 1326 bp, Homo sapiens
ttagaagagaaaaagtgagagagagagcaaaagatagactatggaaatgatgttagacaaaaagcaaattctagcgatttttttattcgtgttcaaaatgggttgtaaagcagctgagacaacttgcaacataaataacgcatttggcccaggaactgctaatgcatgtacagtgcagatgttgttcaagaagttttggaaaggagacaagagccttgaagatgaggcgcatagtggccggccatcagaagttgacaaggaccaattgagaggaatcactaaagctgatcctcttacaactacaggagaatttgctgaagaactcaaggtcgaccattctaaggttgttgagcatttgaagcaaattggaaaggggaaaaacaagaaaaatcttcagtggttgcacccagatgaagctccaaagcacttcccaaagtcaaacctgcatcaaaaaaaggtcatggtcactgtttggtggtctgctgccagtctgatccactacagctttctgaattccggtgaaaccattacatctgagaattatgttcagcaaatcgataagatgcatcaaaaactgtgatgcctgcagcaagcattgatcaacagaaagggcacaatttttcatgacaatgctcgatttcacgttgcaaaatcagcgcttcaaaagttgaatgaattgggctgtgaagttttgcctcatccgccatattcacctgacctcttgtcaactgactaccacttctttaagcatcttgagaacgttttgcaggggctatactggaataaacaaacttatttctcattggcaaaaatgtgttggttgtaatggttcctattttgattaataaagatgagttggagcctagttataatgatttaaaattcatggtccaaaaccacaattacgtttgcactaacgtaatattacattctcataaagtgcttagtactggtgtaacccatttacataaattatctcagttattccacataaacactcattgtatctcatttcccaggtaaggatattgagaccgcaatatattatctagccagattttgaatattggaaggcttttggggtctagaagtgccaagtttaatataaaatgccaaatattagcagaagcatggcctgtaagctggcttaaatgtacggagttgtagaaaacaaatatccttttgggaagtaacacttttttgatgtttgttttcaaatgatcacaggggaaagtacagcaaagagaacaatcatctgatctccattctcttttttttcttttttttaattatactttaagttctagtgtacatgtgcacaacatg

SEQ ID NO: 470561 - DNA, 976 bp, Homo sapiens
tacatcagtagttccaaaatctgaaggtttgagtgaggaagcatctactctgtctgttccaaagccaactaatttctcatttaaaaattaccctttaacccttcctgccatctttctgcgccacaatggcgcacatgaatatcctgactgatgctctcaagggcatcaacgatgctgaaaagagaggaaaatgccagtttctcattaggctgtgctccaaagtcatcattcggtttctaactctgatgatgaagcatggctacactggcaaatctgaaatcattgatggtcacagagctgggaaaattgtcgtgaccctcacgggcaggctaaacaagtgtgggatgattagccccagagttgatgccatagaggagcatctgttgctggctcatggagctgttggcataattcagttccgaaggggtggtgggaaaggggtccagggttttcctgctgcttgtaagatgaagggccattcactgctctccttggctaatagcccttcctccattttcaaagtgaccaatagcaagtccacgtttttcaaaccagcgaaaaggattggtaaaggaactttggaactaagagctgtttgcactaatgagtctcctgacactgtcccaagtgatgggcatggcagaattccatcaataaaacattaagataaaggacccacgacccttaaggtagcagccaaatctcattccagggacttgcatttttgtgtcaattaaagaatagacttcaagaggtgaaattcactttactcaggcttgtgggatacctccggcaaacattagcacaacaatcgccatcttttttgcaactctcaggtctgtgtgtaatgaccatctctctcatttctcattggtgtactgttgttctaatttactcaccaggacttgcatttacgttctaactgagcttgttggacactgaaatggaggaagaatcacaagccattttcaaacct

SEQ ID NO: 470562 - DNA, 480 bp, Homo sapiens
gctcagccagtgatgggtgctttccgacttgctccgcagccatgtggactggggtcacattaggtctagcagccatgtggactggggtctcctcaggtctcacagccatgtggattggggtctccttaggtctctcagccatgtggactggggtctccttaggtctcacagccatgtggactggggtctccttaggtctctcagccatgtggattggggtctccttaggtctcgcagccatgtggattggggtctccttaggagagatccgctgccagctgacatctggaaaggcaagtgggatcctgagtcagcatatttcgtccgacggcatcctggtgtccagtcaagtctcctctgaatccagcgttttccccttaggcttcctttctgattcctgtttcctaaaacagttttggtgaagaaatgaatggagtggaacgtgtttttcttagctcttgggttttcataaccagcctt

SEQ ID NO: 470563 - DNA, 872 bp, Homo sapiens
cggcaaagtggccaggttctccagggtttcaaagtgcaggagatatgtctggatggggggcctggctcctcctcctcggcagaggggcagctgccttattccgacgagagcctgatgccggctgcagcgagggagggcacgctggcactggggaacacgaccgtgccaaggctggaggtgcatttggcccctgcaaggccatcgccctgctgaccctaagcaggcagccagcagggcacggccggaggctgcacggcttctccactgcacggcttgccggcctcggggtgcgtggggaatgggaaccaggggcttatggggccaagcagcctgagatcacgcagcaagcctggcaggcctggctgggactcacactcgccaggctctcagggctgctgcggacgctgcgaccttgtcatttaccagcattcccacctcccttgaaggtctcagaccagcccagcctccaacacagctcagagccctttaggatcaagagcattctttatcccccgacgccccacccacccagctcccagtgaatccctccttcttgaaagtcttcccacactcactctttcagtaattaatgtgataaatcaataattcactccccaacaaccttaattctgttttcttatgttgttaaaaatagcagtgacctggcccttttgttgtttctttaggaggttgctctaagcctctcattgtgcaggggaggctgagaggggaggtgcttgctcagacttgtgtctgaagttggcaggaaggccagaccctggtggggaaatcaggacgcctggtcgtgcctcacttctcccaactctcagttcattccatgcgtggggctagagagccccagtttttcatta

SEQ ID NO: 470564 - DNA, 687 bp, Homo sapiens
ctgctctgggtctcctgcagtggccagcactgtgctgaatccgcatgcttcaagagtatgtcggtgacctggatcaatgacatcacagcccagaaagtgtacctgggaatgaacgccggatcacactggacacttccccttctacagagagtgaggagaagccattggcatgaggagggcagctcagatgtcacctgctcaaaggagcctccacagaccacactggctcccctcacgttaagttccagcgaggcaccctgtttccacaaaagcacacccaggtggtgggctctggagtccatgctggtgccaaccgtacgacgatggccgccaggggctctgcagggattgaatgaggtcacagggggaggcatgtgccacgtggcaaaccatgtggcctgtaggattgacttcatcctgcttaaaaggccaccgactttcctcttccggagtgataccgcacggctttccatcgctgtccttggctcgggggacattggtaagcagatgacttactggtcagtcacgctgtcgcagaaacgacgtgggcttgggaccggtgacagaaggcctgggtcagaacttccacgttccccacgactgcgggaccttgccaagccctgtgtgtgagtgccctgcagatcaccttcaacgcatgcctgcctctcgtcactcagaagtgcctgc

SEQ ID NO: 470565 - DNA, 1056 bp, Homo sapiens
tacaggaagcatggtaccggcatctgttcatcttctggtgaggcctcaggaaggtttcaatcatggcggaagggcccgaagaaggaagcgtcaccctctggggcctgcccaagctgatgactcacgaattcaggagctctcctaaaaccgctgctgccgcagccattggctgtggtgtcatttgttacatggcaattgtcaccgctgtacgtcaacactgggcggggatggtgactagagctgagaatgcaagcagcgcctcacctctgcccatgattgaaactgataatgtgagcagcacctcacccctgcccgtgactggagctaatgccagtagctcctcacccctgcctgtgattgaaactgagaatgtgagcagcttctcacccctgcctgtgattggagctaatgccagtggctcctcacccctgcctgtgattgaaactgataaagtgagcagctcctcacccctgccagtgactggagctaatgccagtagctcctcacccctgcctgtgattgaaactgataaaggtcttgcatacatgaggggctctgtaaaattttctcaagtggttgaacgtttggaggccagaaaacactcactcttaagaacagatgtggccccagccatgactgtcagagtcactgggacaggaatccaagcagatcagtacagacaatataagtcctgcatttgggttgaaaagatcatccaaacagtactcttgtagaatgttaaaacgaaagctttctgcttatagtcatcactatctatggaaggccccctttttacgctaccagtttaataataaaaatgacatatagatgatgaacaaaaaaggaaaaaaagaactcctctgactactgtacttagaaataacaaccaaatttgtttcaagcttttccccttctctgagggtgccttttttaaaacagaaaatttagaatctcatagacttcgtgtgctcgcctgaattttattgcaggtttattgctgagggatttctcttgttaactcactgagcaagactcaaatgacagtcaggagtgttc

SEQ ID NO: 470566 - DNA, 870 bp, Homo sapiens
caacccccagtgcatttgccttcctcctggtctctgtgttgcgggggtgcagcctttgtcccattccttggccatgagtaatacacccggtatgaccttgtgctgttggcacagcaccctcagagcttcacaggcctccgatggtgatggaagtgagggctgtggcgatgatggcaggagctcacattggtggcacctgttctgtgccaggcgctcttctgagccctgcacatggatggacccattgactgcccgaggactccatgacaccccccagaatccccctcctggaaatgccattgcccccctggggcctgaccctcgctggcaatcctccacttccctggtggtcttccctctgggctttctgtccagtgggcagacattggacaccgtcccgcagggaccttccctgacccagctcagatctgtgagcgtggctgacccggcctgcagggatgctcatgtgcccgcaaagaagagctttatcctcattgatttctaaccagctttattgaggtgtgatgtacacaccctaaaagtcacttttttcggtgttcaatggaattcaactcaataatgaaaaagaatgaattaccgatacatgtaacagcacaaccaagcctcagaagcatgctaagtggaagaagccaggtgtgaaagggcacatatgcgatgcttctacctacatgacatttctagaaaagaccctgtctttcttttgaaatatctgatccagaaatattcaactgaattcgaagtctattcatatcagccccagtccctttaacatcacttttgtctgtgatgaaagatgaagcacagagagtgtctttaaaactctcagtttttatacatttaaaacaagtt

SEQ ID NO: 470567 - DNA, 1298 bp, Homo sapiens
cacccaaccccgcctctcagactcacaggggaacctggccgtccactccacccacgtgccttagcaaagtgcccttggtgaggctgagggactaggcagccaggactcctgaggggaccttatcagagagggaagccacctcggactgagtggtgagtgctgctctaggactgccctaaaactggatttgaacaaaagaccacatgccgtatgactccattggaatgaaacatccagaacaggcaaagccacagaggcaggaagcagcatccccccaggtcagcaacacctctggagctgaggctggcagaatgtggcgggggctcctctgagagcatggcagcttctaatggacccacgtggttagtttgagagaaacagtcaccagaagacagccatatgtgtccgggctgggagacctaacatttcagagccaccaaccctgcatcactggctgacaggtggctggacatcgtgtcaccactgtcttctgggaataaacatttctcagctttccatgggaagtctctgtctgtgtcttgttccagctcatttagagcaactatcatttatcaaatatcctcccctccaaagcctcctggatgcctacaaaggcttgggccagatggcagaattcaccaaagatacaaaggccccaacacggggatgtacttggagagggagagggatgaggaggttcatgtggggaaggggacaggacactattacttacagctgcaaatgggagctggctgccaggcagggccatgcagggggctgcacccaaggatgggtaacagtgagcggctgtagccagcagcttatatgtggtcagcggagtgtacttaaccaggttttgtgggctcctgtggaccaatttgaaaaattttgtgggctccaaagcatagggctatccctagctgtcaggtacctggccctggggagacagtggaatattaatgagatatttacattctctttttcatatgaagcctttgaaatccagtgtgtgacttattctgagggcatgtctcagttccagctgtgtttcaggtgctctgaagccacagaagataaacacatccaagaacctcaaggatttaaaattggccagattattaagggctcaatctcataatatttttggcataagtatacacttaaaattaattttggttgaatatcccactggtaaaatctggacttatccattgcattaaatataatctaactggatatgttaagtatcctttaaaacttgtctttctatgcaatattatgtttatattttacttaac

SEQ ID NO: 470568 - DNA, 607 bp, Homo sapiens
ttttaagtgttgagtttgataaggtttgacaaatgtatacacccagtgccaccatcaaggacctgaaagatgcaggggtggtgattctcatcacatccccattcaactctcctatttggcctgtgcaaaagactgatggatcttggagaatgacggtggattattgtaagcttaataaagtggtgattccaattgcagctgctgtaccagatgtagtttccttgcttaagcaaattaacatgtctcctggtacctggtatgcaactattaatctagcagatgcctttttctccatacatgtccataaggcccaccagaagcagtttgccctcagctggcaagagacagatctcggtctgctactgggccttagtataatagaaactgaatgcttaatcatgggccaccaagtttccatgcgacctgagctgcccatcatggagaaggttcctatctgattgggttcctcctgtgttctgggttataggcagaaatccagggtttcacctcaattgtttatattttcacaagcatcacaaacctgtgatgtgtgttgacaatgtctgaaagcattaatagttgtttcatacattttgtttagcatcat

SEQ ID NO: 470569 - DNA, 753 bp, Homo sapiens
ctcaggaaacttgccaccatcgccatgcacagggctcatggcagagtactccatccacgccaaggcaggcattgcctctgtggctgtgcttggcggggtctggggaagcacttcggaccctttgggaaggaagataagcatccgcacgtttccatggatttgtctgctaagaaaggccccgagaaggagaactttgtaggctctgaaacaggagtgggaaagggcaagagggtcctcttgggctatcagtccttgggccctggcattgcatcccttcccagcccccagcctgaaactgaacctccaaggtctctagtagagtccatgggccctgacatcaaagccctcctgaggctggctgggctggaagagaagggccccaagataataaagccacacatggaccgggcagagatccctgagtggccactggaagagaatacagcagtggacaaagatggccatggtcctggctctcatgaaactcacagctaaatagggggagagagagaaaaagataagtacatactccagttgatgataaatatacattgtgatgagtgccatggacttgaatgtggggctggattataaatacaaatgtttcagcaggtgaggtaaatgaatgacatgacctaatatattatcacatggtaaggatatggcatactgggacatgcatgttcccatcacactcaaatccagtgctgtgtgaagaactttctgttcttcatgatggaaatgttctgtagc

SEQ ID NO: 470570 - DNA, 857 bp, Homo sapiens
gcatctggggacagaatagggagccgcaggggcaaagcccttgttattcgactatgtcctgccctctacagtttggggaattgttgggccagcttgggtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacttagcagagaatgtggtcaggcaccttctcaccatgtgtttggctttccttagtgaccatgcccaaggcacctcatgctggcccaaggtgaaccttgttcctccgtgaaaggtctggttcaacaggaaatgggtctagctacacaatgccacaccactggtgtgcacaagtgtgtgtgtatgcccccagcataatacctggtatatatcaggcagccataagtgttcc

SEQ ID NO: 470571 - DNA, 788 bp, Homo sapiens
ccaaatgtgtggcctctggctgggatggtcaggactggttaggatgtggcgctggggcagctgttgcttgtgcctgctcacccccactctctgttctgctcacagcagactaggctgtcctcaagaaagcaggtgtccctaccagccatgtgccccaggctatgactatgatgggaaaagtgagcccagagaagttaaggaatttgaccaaggacacacagcaagtaagcacagtactggaacccgaatcgttgattctttcttctgcagctgctgctaccttttccacggctggaaaatgggtggtgaccactctatcctgatgttgtgtggtcagctatctggctgtgggtgcaaaaaggatgcactgagaccaggttttgaaggcatttacagacacatggagctcttggaaggctcctcagcttgtcctctggagtggttctcagaggtggatgatgccgcagaagcagaaatgctgcagctgtccttccaggtccctgtggagaatccctgagataggaacatagaaggtgtgggggccagagggggtgcagaagaataacttccctttgggtaatttttccattacactgttcccctttggactttcagaaataaaaacccagcccccctggtgtgcagtcacacttgcgccctgaggagtagttaaaattcagcttgaggggcacttagtgtcacagaagcctagataaagaaacaagatttcaggcaggaagaaataataaagaggcaggacttcaagtgtcctgtgaaacacaacattc

SEQ ID NO: 470572 - DNA, 559 bp, Homo sapiens
gcattagaagcctttccaaccctgaaaaataaatcgggtaggggttttgaaaatgatggatttatgtagggagatcagagaagacctcactgggaagaatgatatgaacagagtcctgaaggaggggagagagtcagtcatgtggatggatatttggaagaagagaattcctggcaccagaagcagcaagtgcaagggccctgaggctggaacatatttggcctgctgcagaagagcgagaacaccagtgaagccagagtcaagtgtgctagagagagaagtcgatcagacgccagagaaagggggacttggggaaggggtgtataccatgtcgggcctttcaggtcattgtaaagtcttcctgtacaagaaagctgggaaggtggacagattcttcactcatttccattgcagtcatttgttcttttattcaacttatattcattgcagcagccactctgtgccagacagtgttctcatccctgtgccatagacatgcacagagatgagaatcacctttgctctcaaagagctctaaatcaagtaggattagttagcc

SEQ ID NO: 470573 - DNA, 760 bp, Homo sapiens
tggggacccgtggggctggtgatcatgcttttcagtcccaggatacggccatggcagctgaccccacagccaggcttccctctggaatcctttgcactgccccttcacggcctccaggacccgagcccctgtgtccccagccctcccaaccacagccacctcacttacccattttgtaggaaaatcatccttgattcttttcttatgggtctcagaatgggagccgtgtgtagaactggcatcccagagtacatgctggggacccactggcaaggacagatggttgagccatatctgatctacgtgcatctccttctgggaccagtgggctccccaaggtatgtacctatgacaatgacaggagagcaagaaggcaagcccaaccacacaagcacatttcaagcctctgccggcatcacaatggccaacatcacattggccaaagcagtcatcccagttacaacaagagggatgggctacacagtggggcctctggcctttaatgggaaaagcagaaagctggggctaggcctctctgactttgaagagggtaagtggagtgacacagctcataatgtgcaaataaatgggaactaagctcatcagctcaagtggaatgaattactgtcgccggtgaaatgcagtgatggagagcagtggcccagggaggcgggaggcctccaagcaggcttcgttagcatgcttttcatcaactctctgagttttttcatagaaagatcatattgtctacagtttcttc

SEQ ID NO: 470574 - DNA, 746 bp, Homo sapiens
tcttaaactaatgtgtgggttattggccacccccgcccctgcccctgcatctactgtctgccattcttcaccttgctctgtgcccagggaggctaaattccatgcaccacgactctcacgctcacctgggctctggctgctggtgggtttggccagttggaggctttggcttgagattggagacaggggagaggatgtccagctgcttcttccccagcttgttcctgctttgatactgtggttctggcccctggcaggagggccctctatcccaccccggctctctttgggatctggcaccactactccctgccctgcctcttttaggcctagggagggtagcagcttcccatggtcacccatctgttgtatctcaacatcccttactagtcccctcattaaattcccttcaaaatcccagccaagtgtgccttctgtttcctcccaagaccttgtcagataacaaataaatatgtaagatgaaatacaaatccagatgctagaagcatctccttccagttgtgaccaccaaaaatgtctccagtcactgccaagtgtcccctgtcccctgggggaaaaatgtcccagttgagtgtctagttgggctagactctcaaagttccagccctcacgggtcttacagttcagtccagaagccagtgaacataatggccaatgacaatacagtgtcacgattgtaactggggaaagtgaaaattcacccagggttggtctaagctctgctt

SEQ ID NO: 470575 - DNA, 884 bp, Homo sapiens
ccaaacatcctctgattttagagccaagatcttttgaaatctcatgatgtctggcagctctgtggatcgagagctctctgggcagtggaccaattttgttgttgttatttatgtatgcacagtattatataccaaatccctggttgctaataactcagatggtcacctatgcactcaaggcaaacaatccaactctgtgaagaaacagaagggcttattttgccctcaaaagcattgtccatatggttttgatggcgtatgtcccatctgtgagctcctaggccattccacctacctagtcacagtaattggctctgattgggccacacagccaccaaccaaagagaatcagagattctgtgactcagtggctcccatcacaggtaccatctatctgctcttagttcttcctccttcagtggacactgccttcattttggaggtgtattagttatcttgttgcattacaaattacttagcagcttaagacaacacacatgaactatctcatagtttctgtgggcaggaatcagacaggcttagctaggccctgtggctcaggatgtctcctggatagcaatcaaggtgacagccagggctgcagtcagctcaagtgtcagcagggacaggatctgcttccaagctccctcatgtggttgtggacagaatttggttccttgtgggctatgctctaaagcatccaggattccactcaggttgttcttgcaacggtcttatcctccccatcagtctgtgagctccccgaaaggcagagactgtttcttttcatgtatccccagtgaccagcagagggcatggtgacttttgggcatccataaatatttttgtgatgaaatggtgtggagggctgggttgagatgcag

SEQ ID NO: 470576 - DNA, 645 bp, Homo sapiens
gcatgttgcaatccaaagatagaggtgggtgctggatgcctgcctccttgtgggcgttcatcatagtgccagaggcaacacagctggggaaatgtggagggcccctgctggtgactgcatgcatggtcacactgaaggtgctgttgacactggggcaggacactgatgggcacaggtctgggtgccttctctgtgccccgcatgcaggagtggtcactcagggtggggaatatgttctctgcacagtgttaatacaagggtggggcacttgtaggggtggggctggctggctctgtgcccaccaaatctctgtctacaatggtgtttggccagcagtagcatggagtggactgtactaccacacaccggaagggcaagaaaagaaaaacccactcacccagacacgtgctagcaaagctatgtggggagttgctgtggtcctaggggaccacatgctgcagtatgggaagggagtgtgtgggctggtgcgtggccataggggccaccatgccggagaggccagcagaccaaggggtgctcaggtcaaactggctttgtgtgatgggcaagaccaccctgcagagttcaggtctgacagttcccctaggtctaaagtctcctatgggacaggagcaagctgatcct

SEQ ID NO: 470577 - DNA, 1433 bp, Homo sapiens
tggaatgatcaatgaacacgaaaggaatcatcattgaatggaatcgaatggaatcatcgaatggaatcaaacggaatcatcatcgaatggaatcaaatggaatcatcatcgaatggaatcgaaaagaatcatcatcaaatgaatttgaatactcgaatggaataatcatcgaatggaatcgaatggaatcatcgaatggactcgaatggaatcatcatcaaatggaattaaatggaatcatggaatgtactcgaatggaatcttcatctaatggaatcgaatggaatcatcgaatggactcgaatggaatcattgaatggattcatcaaatggactctaatggaatcatcatcgaatggtatcgaatggaatcatcgaatggaatcaaatggaatcatcatggaatgaaatcgaatgaaatcatcgaatggagtagaatggagaatcatcatcaagtggaatccaacagcatcattgaatggactcgaaaggaatctttgaatggactcaaatggaatcatcatcgaatggaacctaatggaatcatcaaatggactcgaatggagccctcatcgaatggaatcaaagggtatcaccgaatggacttgaatggaatcatcgaatggcctcgaattgaatcatcattaaatggaatcgaatggaatcatctcatggacgcgaaaggaatcatcgaatggactcaaaaggaatcatcaccaagtggaatcgaaaaagaaactaatggaatcatcaaatggacacgaatggaatcattatcaaatggaatcgaatggagtcctcgaatgcaatcgaatggaatcatcaatgaatggaagagagtaattgaagggaatcaccaaatggacttgaatggaatcatcaaatggcccagaatgcaatcattatcgaatgaaatcgaatggaatcatagaacagactcaaatagaatcatccaatggactcaaaaggaatcatcgaatggcctcgaaaggaatcatcatcacatagaattgaatggaaccatcaaatggactcaaatggaatcatcatcgaaatcgaatggaatcatcctcgaatggaatcaaatggaaacatcgaacggattagaatggaatcatcatcgaatgaaatcgaatggaataattgaattcaaccgaatggaatcatttaatggactcgaatggaatcatcatcgaatggaatgtaatggcatcattgaagaacgtatccctgtcattcagtgatgcgtgactgtgctgaaatgctcaatctaagtttcaatgacctccataacattgttgtactgtgaaatacaaatctctaacctatggcctgaatatgtttgcaaactaagcagatcatgggaaggagaatgtgctggaatcgctgggaagattttctcacactacctgaataatatctccagactttgc

SEQ ID NO: 470578 - DNA, 604 bp, Homo sapiens
tggactcgaatggaatcattaaatggaactgaacggaatcatcgattgaactcgaatggaatcatcatcaaatggaatcggatggaatcatcgaagggagttgaatggaataatcgaacggattcgaatggaaacagcatcgaatggaatcgaactgaatcattcaatatggaatcaaatggaatcatcactgaacagaatcgaatggaatcatccaatggactccaatggaataatcgaatggactcgaatggaatcatagaatggaatcgaacggaatcatcgaatgcactcgaatggaatcatcatcaaatggaatcggatggaatcaatgaagggactcaaatggaatcatcgaatggactcgaatgggatcatcaaggaatggaatcaaatggaattattgaatggaatcgaatggaatcattatcaaatgaaattgaatacaagcatcgaatggaatcgaatggaatcatagaatggaatcagacagaatcatcattgaatggaatcgaatagaagcatcgaatgaaatcgaatggaatcatcatcaaacggactcgtatggaatcatcattgaatgaactcgaatggaaacattatc

SEQ ID NO: 470579 - DNA, 2343 bp, Homo sapiens
atccgttggaatcatcatcaatggaatcgaatatagtcgtcatctaatggactcgaatgaaattatcatcgaatggaatcgaatggaatcatcagcaaatggaatcgaaaggaaacattagggaataaaatcgaatggaatcatcaaatggaatggaatggaatcatcaaggaaaggaatcaaagggaatcatcgaatgaaatcgaatggaatcatttaacagaatcaaatggaatcatcatcaaatggactcgaatggaattatcatcgaatggaagggaatggaatcatcgaatggacatgaatggaatcatcatcaaatggaatcggatggaatcaaagaagggacttgaaaaggatcatcgaatggacacgaatggaatcatcattgaatggaatcgaatggaatcattgaatggattcgactggaatcatcatcgaatggaatcgaatatgatcatcatcaaaagaaatccaataatcatcgaatggacccgaatggaatcaccatcgaatggaatcatcatcgaatggaatcaaatggaatcatcattgaatggcatcaaatggaatcatcgaatagaatcaaatggaatcatcatcaaaaggaatcgaatggaaccatcgaatgaaatcgaatggaatcaccatcgaatggaggcgaatggagtcatcatcgaatggaatctactggaatcatcagttaagagaatcgaatggaatcatcgaatggtatcaaatggaatcatcaacaatggaatcatcatcatatggaatcttcaaatggacccgaatggaatcatcgaatggactcgagtggaatcatcatcatatggagtcttcgaatgggctcgaatggaatcttcatcaaatggaatcgaatggaatcatcaaatggactcgaatggaatcattaacagaatggaatcatctaatgaactcgaatggaatcatcatcgaatggactcaaatggaatcatcgaatggattcgaatggaatcatcattgaatggaatccaatggaatcatcgaatggaatcatcattgagtggaattgaatggaatcatcgaatggactcaaatggaatcatcatggaactgactcgaatggaattatcatataatggattcaaatggaattatcgaatggacttgaatggaataattgaatggactcgaatggaatcatcatcgaatggactcaaatggaatgatcgaatggactcgaatggaatcatcaattggacccaaatggaattatcaaatgggctcaaatggaaatatcgaatggactcgaatggaattattatcaaatggaatcaaatggaatcattgaaaggaatcaaacagaatcatcgaatggaatcaatcagaatcaatcatcgaatgaaattgaatggaatcatcatcgaatggaatctaatggaatcatcaccaaatggaatcgaatggaatgatcaacaaatggaatcgcatggaatcattgaatggaaactaatggaatcatcatcacatggaaccgaatggagtcatcatggaatggaatcaaatggaatcatcatccaatggaatcgaatgggaatcatcgaatgggagctaacagaatcatcgaatggaatcgaatggaatcatcatatggattcgaatggagtcatcatcaactgcattcaaacggaatcgtcatcgactggaatcgaatggaatcatcatatgtattcgaatggagtcatcatcaactgcattaaaacggaatctggaatcatcatcgaattcaatctagcggaatcattgaatggactcgtatggaatcatcatcgaatggactcgtatggaatcatcgtatggcatagaatggaatcatcatcaagtggaatggaatgtaattgtcaaatggacacgaacggaatcatcatcaaatggaatcgaatggaattgaagcgaatggaatcatcactgaatggaatggaatggagtcatcaaacagaatcagatggaatcatcattgaatggaatcgaagagaagcatcaaatgaaatcaaatggaatcatcaacgaatggacttgaatggaatcatcatcgaatggactcgaatggaatcatcaatggaatcatcgaatgaactcgaatggaaacatgatcaaatggactcgaatggaatcatcgaatggattcgaatgtaatccaatggaatcattgaatggaatcgaatggaatcatcacagactggagttgaattgaatcatcaaatggactcgatcggaatcatcatggaatggaatcgaatggaattatcaaatggactcgaatggaatcaactttgaatggaattgaagggaatcatc

SEQ ID NO: 470580 - DNA, 1553 bp, Homo sapiens
taccatatgagagagttcaacttatgttcaatgtgaatgccatggcaatattaaaagaatggagtcctcatcgaatggaatcaaatggagtcatcatcgaatggaatcaaaaggcatcatcatccaatggacttgaaaggaatcatcatcaaatggactcgaaaggaatcattgaatggaatcaaatggaatcatcattgaatgaaattgaatggaatcatcatcaactggaatggaatggaatcatcatcgaatggaatagaatggaattatcatcgaatggaatcaaacggaatcatcatcgaatgcaattgaatggagtcatcatcgaatggaatcaaaatgcatcatcatccaatggacttgaatggaagcatcatcaaatggactggaaaggagtcatcatcgaatggaatcaaatggaatcatcatcaaatggaagcgaatggaatcatcatcgaatggaatcaaatggaatcatcatcgaatggaatcgaatggaatcatcaaatggaatcgaatgtaaccatcatcaagtggaatcaaacggaatcatcatcgaatggaatcgaatggaatcatcatcaaatggaatcgaatggaatcaaatggaatcatcgaatatattcggatggaatcatcagcgaatggaattgaatggaatcatggaatggattcgaatggaatcatcattaaatggaaaccaatggaatcatcgaatgaacacgaatggaatcatcattgaatggaatcgaatggaatcattgaatggcattggaatcatcatcgaatggaatcgaatggaatcattgaatggactcgaatggaatcatcatcaaatggaagcgaatggaatcatcatcaaattgaatcaaatggaatcatcatcgaatggaatcatcatcaaatggaatcaccaaattgaatcaaatggaatgatcatcgaaggcaatagaagggaaacctcgaatgggattgaacggagggaatcatcgaatggattcaaatggaattatcatcaaatggaatcaaatggaatcatcgaatggacacaaatggaatcatcatcaaatgggattgaatggaatcatcaaatggacacgaatggaatcaccattgaatggaaacgaaaggaatcattgaatggcatcgaatggaatcatcatcgaatagattcaaatggaaaaatcgaatgtactcgaatggaaacatcgaatggactcgagaggaatcatcacggaatggaatcgaatggaatcatcgaatggagtcgaatggaatcatcaggaagtggaattgaatggaatcaccgaatagcatcgaatggcatcatcatcaaatggaaatcatcgaatgaaatcgaatggaatcatcatcaaatggaatcgaatggagtcatcatcgaatgcaattgaatggaatcgtcatcgaatggaatcgaatggaaccatcaacgaatggaattcaaaggaatcatcatcgaatggaaccaaataatatcatcaaatggacttgaatggaatcatcgaatggactcgaaaggaatcgtcatc

SEQ ID NO: 470581 - DNA, 665 bp, Homo sapiens
gagacgtgcctgggggcctgacagtagagttgggaggtggaaagaggctgggttgttgtggcgaaacagagggtacttgggggagaactcgggggagccccgggtcaggtgtaaatgagcaaagatgaatcaggaaggtgggggagatggcagaaggccccgagcttccagtggcggaactacaagctcatcgtggatcctgccttggaccctgccctgcgcaggccttctcagaaggtgtaccgctatgatggagtccacttcagtgtcaacctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactggggcaaggccctgagtgagaagttccaaggctcgggtgcagccactgagacg

SEQ ID NO: 470582 - DNA, 930 bp, Homo sapiens
cttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgctaccatggcctggaaacttgcccattgagtcagatctgcttccctggagacccactggccttcatactcttttcttgggccaggcataacaagtcagctccctcttccacccgaccagaaaatgatacaagatcaaatggacaggacatatttaaaactgtgtgggctgggc

SEQ ID NO: 470583 - DNA, 798 bp, Homo sapiens
gtggttgatggtaaatttccccaactaccactctgctggcctagaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatgatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggtaggtgccacagggctgtcggttagatcgctgtgtgtgtgagagagagagagaaaacagtggtgcttgcatttattgtgtacaagtgtgtgactttattagaaaaacatacaaagaaaatgtcaccatctcctgtcactaccttctagagacattgattgtctgacacacttcaaactgtaccgtcatggtggtttacagaaccccaggctaagctgca

SEQ ID NO: 470584 - DNA, 1228 bp, Homo sapiens
ctcagagtggggcagaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcaggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaaggcaagtcttggcttcttcaaacgccactacaaggaaatgctggaggacaagcctgaagacactgccacattcagtggggacgatttcagctgtgtggccccaaatgtgcctttgtcctaataatccactttcctgtttatctctaccactgtgggctggacttgcttgcaaccataaatcaacttacatggaaacaacttctgcatagatctgcactggcctaagcaacctaccaggtgctaagcaccttctcggagagatagagattgtaatgtttttacatatctgtccatctttttcagcaatgacccactttttacagaagcaggcatggtgccagcataaattttcatatgcttaagaattgtcacatgaaatgaggatgtttatagcacactttccttgcgtggaagagctataacccagggacctgagtgcctctctgggaatagtcgggggaacctatttgtgggcattgaaaaagttttttcactttctatggtgatgggagcctgaggtcatcttttcttgatggggctgagaggtgtgtatcaggggagagggtcaaagagtgtgtgtgtgtgtgtgtgtgtgtgtgtgtgtgcatgtgcatgcacgtgcacgcaggcatgcattggtcatgggtttcttcacacacttcaggttcctctgtaatggtaagtgggcaggctgtcct

SEQ ID NO: 470585 - DNA, 1290 bp, Homo sapiens
ttctttttgatggtttgtgtttggatgttcaagacagcccccgaggcctggggccgggtgctgctcccagactgtgagctcgtggccacgggaagcctgagtgcggcagaggccccacagctgcgccaagtgcggcaaagcctcccgtacagttactccctgagcggtcatctccgaagccctgctcatgagaagcctcccctttgccctgactgtggaaagcgtttcagccagagctcctacctgctgcagcaccggcagattcacccagggccgtcagccctgcaagtgcaaggcctgcgggagggcactggcgggtccacagcgactggcgagagaccttgtcgctgtccccagtgcggcaagacctgctgtggccgctccaacctcatcaagcaccagcgagtccactcgggagaagccattcgtctgcgggagtgcggcaagggtttagcggccagctctgctgctggctcaccaaggagcacacactggccgaagccctgcgtctgtccccagtaccagcaggtttttggggaccggtggaagctgatcggccaccagcgaattcacacaggagagtgtgtcccttctgctgctgcagctgcggtgacagtgtcaatgagaagacctccctctcccagcgcgtccttccgcacccaggggagaagacctgcaggggtgggagcgtggagagcgtcagcctcgcacccagctcagtcgccccggacagcacctctgggctccggccctgtgggagccccgggtccttccttcaacatctgcccccatccacactcctgccccgacctcccttcctttatcctggccccccactcagtctccagcctctggttccatccggccttcccgcagtgcctgcagtgcctctgggaggcctggaagttgcccagcccggaaggcctcgcagcacagagcggccggaccgctcggcgaggccagggccaggcttcagcgacagtgccgagctcctccaccgccctcgaacccacactggagaggagccctaccagtgtttccggtgtggaaggcctccagccggaggtccaacctggcccgacactgaagaaccagcgtgctgcagccctgggtggaattgttgcagccgccggtggactgtggatctgagatgcagtcccctccctccacacagacccgctcaggacggcttttctgtatggcagatctttctcagaagtgctgggggctattttgtttgttttttttcccctgaattctcgctcctttcccttatacattaagggattt

SEQ ID NO: 470586 - DNA, 916 bp, Homo sapiens
ggtacatcacgagtcatatctgttatcagagcgtcgtcggcgtgcttggcacacagatcacctccgccagttgtccgtgtcgtaacgtcggcgtggttatgtggtagagtaaatgcgcgtcacgcgtgatctacgtacatacgtgacatggtccgaacaagcatcgccacccccgggttacgtccttcgcgttcagcgagtgttcagtcgcgtaggcggaggtcgtgcgccgacagcgctctcgccagttgattccgggcacactgcctacacggccatgcctctcaggcgcgccactcacccgccgggttgtcctgagcgccattcgattcattgcgccgctggtgtgactgcaccccagttctcgcggtgcgcgcagttctcgctgtgtgccgacgccgctccgtccactcggctaggttgtgccgcctcgggcaccgttgtgtgtcgtatcctcgatccgcgtcgcctctttaccgactatccctgggcggtcgaggctgcgcgcgcggtcgcctcgctgcgagtgcggcgctctgcattagccttggagtaaggcgcatcggcgcctctcgcgttgccctttttctcttgcgccacagtctatgcacgtgctcgcttccggtgcctcgtgcacgtccgtgtgggtggtcggccatcagtcggctcgtctcctcgtacttcgtgagcgtacgagtgcgagcgctcgctagaccttaccctatatacctcttaatctggctatcatctgtatccttcataatatattttacaataaactagaattttgtgagccattctagaaaatgattgaatcttaggagggggttgtgaaaatcttcaatttatagctggttgatcagaagttttaatgttttctgactgaattcaggaagaaaagaaggaaaccactttt

SEQ ID NO: 470587 - DNA, 2648 bp, Homo sapiens
gtgtgacctcacagttggctctttttccaccaaacgcatcggtgcggggtggggctcacgggttggcgggctcctcggggggcttcctgccgactcgggactcaatgtgtggagctcttgagagcctggtggaccctggggcctgctgggggtcccttagggatggaatcagcggtggcagcagcagcagaggtggcagggaaggtggtcgagctggcatcgtcagggagactcggcgtcctgagctcctgcctgtgagtggcttccacccaccacagggcctttgcacccaccgttcctgccacacgaccactctcctctcacccgaccccttcatccagctaagtcctagtccctcttcaagggcttcagggcagctgtccagtccgtcctccgtggactggcgtcccttggcaccagcccagcacctttcctagctcatcgtccttcgtcacaggccatggtcctggatagtgctggctctgggccccacctgcaccctctcaccctgcccagcagaaccagggccccaggcaagggtgccccagggagccctacgcccctcacctgccagctcctttgcgacggccaagggctgagccccacgctggctgttcacgcggcctttgtacaggatcccatccacgcccaggatgtccacctcggcctgttggatggcccaggtcccgggttagggagcccccgacccgatctgcccccgaactttgtcctgctgacaatcctcctggataccgaggtcctggagctgcagccactgctgttccctgcagcagggcagtgggtcagcagcgacctggagaccctgtaccccagagcccaggacgggccccaagggcctggccagcatcgagggaagaccagcatttctttcagcttgtccctgggcctggaggatgtgtctctgcaggaacagggttcccaggctccagagtggcctccatgcggggcggcctccctgcggggcgcccatcctgctcacctcatctgttgccgctgcaagtactcgcagctgttggcgctggctggccgcagccgggacagcaggtgggctttgcggatggtgatcagctgtctgttggaggacaagggcacagcaggggctgtgggaggcgtgctaggccagcagagggctcgtctcccacccctccaggaagccttcccagcaggaggaaggaggtgcagactcaggtcaccaccctcgaatgccagaagcgtccacagcatagaagtagaaggggcccccccgaaaggcatctcaggacctctgatcatcacaggccggggcaccctgggcggtggtactcacgggccagtcatcatctccacaggccggtcacaggagatgcacttcacgcgcttgaacagcttcctgaaaggcacatgatcatcagccgctgcccctgctgggcccaggccatgtgtgggaggctgcagccagccagagccccagggctgcatccctcctgccagtgcccggcccagctcagccccacaggccctgcagtctccaaccactcttgtggtttctctgccgccccaaacacaacggatggtttttaaagctgtgtgaggggtggtctgaggacaggagccccataaatattgggtccctctgcctggggcactgtctgggtgggggtcaggggtcctggatctgcccagtccccttccctctctgagccttggtttccccattggcaggaatagggctggatcacctctgccagctcaggccagagcttccctcctcctcagtgctttcagccacagccaagcccccatcccctcatccaaaggtctggaatctttcctcccagagcttccagggtgtgttccccacagcctgggcagcaggacccctaccaggaggggctcgggcgggcactcacctcctaaagccagcagcactgtcaggatccagtcttaagccctcaatcagcagcttccggacgattttccagacctcttccatttctttcttcaagggatccagatcactgtggactaactgccaacagccaaggggaagataagaaagaatactctatgaattcacaccctgcctccttccagaagagggttgcagcaacctgggaagttacacggtgtaacaaaattcaactaaaatagtgagggagtccaggaaagggaaaatgacacagcttcgatgaggctcaacccctactagatgctattggtagaggggagctgcaaggggcaggtgacgcagtggtcaaaaagacgaacattgtccgggcccttctgtttatatgggtgggggggggtggtgggattcgtttgcttttcattgaagtgtaatttacacacagtaaaatgccagtaaagccccactggttcccagcctcaagtgcatccccacctcatgcagaaccttcgggaagggccagaaggtctaggtgaggaattctccctttgccagcccttctccagcctacccagtcctcctaaccttgaactcatccatgcgaatctgcaggttctccaccgccttgtccaaagtgatgtagcgatccttcatcatctctatttggttgccccaaattctctcaagttcttcctcctaaaagggggagacacagacaccccaggcctctgcttctgaagtt

SEQ ID NO: 470588 - DNA, 1697 bp, Homo sapiens
gagaaagtgggcacagccaggggccccaccgccctccctgcagaggcctagaggagaggcatcgcaagccagggagccccagggcgctgggtgggggcaccccgtggatgctccccgggcgcagcgcaaggcccgccggccccacgcccctctgcgcctcctggtggagccttccgttcctcagtttccccccggtgggacagcgcagcgtggagggtgcacagagcccagggccgcgtctctcgagcactcagcctgggatgcgcccagggcagcgcccccacacgcaagggcccaggggttggggcgagggctggggttgtcggtggggggtgggggtggccgcggaaccggccgctgcgcggctcctccagctgcaaaaggaactaattagagcggggcgagcgggaggaagcggctgcggcgagggaggaagcgcgcgggggcggccgcggggaccaccgggacggcgggggcttcgggggaccgggccctgcccttcccacccaccgcagggcgggggtcacccggagggtgggctgggcgggccccccgccaccctggccgagacaatggctgctattgtgtgcccgaccgcagcccgagcagacggcccccagctgcagcgctggcggagccacccggccccccgcccgcagtccccggccaggccagagatgggggggtctccctgtgtcatccaggctggtctcgatctcctggactcaagccatcctcctgtctctgcctcccaaagtgctaggattacaggcaggagccaccacgcccagcccgtcatcttctaatttaacagaaagaggaagtgagtccctggtcactcctgaaccagtcagagaaaccctggtctgtgggtgtccctgagtctattactggaaccatcacttcagcagtatggtcttacagatggggaaactgagggctgaagggggaggcatccagcccaggctgcacaagtaggtggcaaacccacaaccagaagccacgggcaagcagcatgaggacagtacccatagccaggtgcgggtactgtgaaggcaggtgctgtttcatccccattttacagatgcaaaaactgaggctcaggggagtgaagtgacccatccaaggtcccacagcttgtccgtggcagagctgggtttcaaccccagggagaaaccaatgcagtgctgcacatccaatcactattgagtgcttctccttcgtccgtaacgttcagcacggagaacagtgcctggcacatagtaggtgcttaataaaacgtgctgaatgaatcgctgggggttccctgcacagcaacttgggcctgccaaggtcacccagataattcaggcagagctgaagctggaagacgggccggagggcttccctggcctgcaccagcccgggcttcctaggagatgccccaccagaggcacttccttctccaacgccagcagggagggtgacaccgggctccgggagccccggcacacacacgcacactcacacagatggccatggcagtccagctgcagggccggcctggcacagaggcctccccatcctggtggctccgggcccctgctgcagtggcctccacccccccgctgcctgcccgctgctgcacctttgcacaactatgtctggtattttcctgtctgcccagctttgggggggtgcttggagctatgatcacc

SEQ ID NO: 470589 - DNA, 556 bp, Homo sapiens
ctgccgaatggatggttcggaagtgtaagctcgtcttcctggacaagcagctgcggatctttgaccccagaacaaagccgcgggcctctcaggggccgggagccttcctgctggcagctccagcacctcgggagggccaggagaggcactacttggcgctctctggacgttgcccagagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggaagaaggggccccacccaggcccactgccaccacccactgcccgccatgacccacggcccgcctcctccctcctcgtgccagagccctcagcagccgctaattgaatccagagcctcgcgtggctgggcctgactcggcactgacatcaacacccgcgccacggggcctgctccctgggtctggctgggctgactctgtcccacca

SEQ ID NO: 470590 - DNA, 479 bp, Homo sapiens
tcatcaacaggaacggaggcaggactctggtgataaagatatgcaaacggccaataagcgcatgtatgaaaagatgctcatcgccccagtcactgggaaaatgcaaatcaaaaccacaagatgccacgttgtacccattaagatggctgccatcaaaaaaccccagaaaactgcaagtgttgatgagagtgtggagaaattggaacccttgtgcaccgttggtgggaacgttaaatggcgcagctactatggaaaacggcccttatctcagccagctttgcactgcttggctgcctgtcacattcaattccgtgccagggcattcatcctgccctggtcgtgtgtgtccccaaatgcaaggttctgggacacggggcctggtcttgatcgtcttcggttcccacaatcccgagcacggtgtctggaacacagcagtgtctcagtacatggcggctgaagagaataaaattagtgagaaa

SEQ ID NO: 470591 - DNA, 521 bp, Homo sapiens
ttggtgtttattccgagtggaatggggagctctatcaccatcgcctgcgggagccaacccactgccttccaattagcagtgagaggaagtggaaagggcaccaggcccaggggcttcaaagaagaggaggtcagggagatccctgacaagagaagcaatcagagagcccccaaggagatgagcacaacgggagaagaaggcctttctagttcccgtgaaagtggttactggactctaatggccccaggcaagcccacagcccacacagccccctcctggggacaaagccctttctcttccagctctcagacagagatggataaggggggtctgcacagcagattgacagacgatgagaaaaaggagtgggtctcactgttacctggtgcacttaatctcattcgttccctcattcattcatcctatgtagaattcaggggctactaggtgttagaatgaggagacatcagaacagttgagttggtgaaatgaaacccgatcacacacatagtgaaataatc

SEQ ID NO: 470592 - DNA, 864 bp, Homo sapiens
gcattgccagcacgcaggcgtttgtgacaaatcttttatagtctagtatatagctctctcagataggcagctgtgatatgattgggccctgtgatttctggctaggccgcctggaagctgctaccgctcaacaccagccaattgtttccatgtgcaaaatttgggtgcagagttaccaagctgtccagtttttaagagattctggacatttggaatatttcatgagaaatcctctcagttgtgaatataaacaaactgtggtacatccaaataatggaatacaactcgccaataacgagaaacagactattaacatgcacgacatatgcaacaacaacagagatgaatctcacatgcactctgccaatagtggctgtgagactgtatacatttgtgacaacttgcagaactgcccactaaaaaggatacattttactgcatgtacattatgcattattaaacctgacattaaaaacgcaaaagctgaaaaaaaaactggggcctattgagattcaacccaggtcttttgattttatctccagagcctttcatttttaacatatggtctccttctggaaggaggcatggaagggatccaagatatgccaaagaagcaatttacaaattaacgtttggagtagcattctcagtaaattgggactgtctccacccatagttttgcctaacaagcttcccgatcacccaggtacttatttctgataaccttgaatatcatgcaggtcacattttattttgtgattagagcagagcaaacactatttactaatgaatttatttgtgttttccgtcactgaaatttgaaagacaaaatgaaaatctaggtctctatgctgttgcaaagta

SEQ ID NO: 470593 - DNA, 1975 bp, Homo sapiens
tgctgcagactctttgacagcaggaggaatgggaatctggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcggtcagtagctcagctcctggcgaggaggacatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaatgtgaagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtgggagaattctctcttctcccccactgattaatttattcaatcatgtacagag

SEQ ID NO: 470594 - DNA, 708 bp, Homo sapiens
ttctccacgtctccaccagactcaggagcccagctggcttcactcagtggatcccgcattggggctgcatggtggagctgcttgccagtcctgcgccctgcgcccgcactcctcagcccttgggtggtcgatgggactgggcgccgtggagcagggagcggcgctcgtcggggaggctctggcggcacaggagcccacggcgtggctggggaggctcaggcatggcgggctgcaggtccggagccctgccccgcggggaggcagttaaagccgggcgagaaatcgagcgcagcgccaggtcggccggctactccgagtgcggacccgccaagcccacacccacccggaactcgtactggcccgcaagcaccgcgcacagccccggttcccacccacgcctctccctccacacctccctgcaagctgagggagccggctccggccttggccagcccaaaaaggggctcccgcagtgcagcggtgggctgaagggctcctcaagtgccgccaaagcgggagcccaggcagaggaggcgcggagagcgaacgagggctgtgaggactaccagcacgctgtcacctctcactaccatgtcctcagcactgttctaaggcctgaggatacaatggtgaacaaaccaaacatcctgctttaatggagcaggatgggaataatgacgataatcataatggttaatactttttgag

SEQ ID NO: 470595 - DNA, 470 bp, Homo sapiens
gccaaaggtttctgttttcaacctggatcctattggaatgatgggaaccttcccaaagtccaagttcgcaggtgacagccaagggccagccttgcaaataggctttcctaaggagagcggtcaggcctgctgtgttctcttctgcccgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgcggctcatgtggaaggtgacaaagcttgcacccaggtatgtctgaatagaaacagtagctttccagtgttccaaaagcctatccc

SEQ ID NO: 470596 - DNA, 1770 bp, Homo sapiens
gtgtaatcccagcattttggaaggccgaggaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaatgtgaagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggatattattcctggaagtagaattgttgggtcaaagagtagggacatttaaaattttaattcattgtcatttacacttgccaaaggtttttaccaatttatgttactgtgatacaaaaattacgtgcttgccaacagtattatcaatgtttaaaactttgccagtctaagtggcaaaaacagattatgtcattgtttgattttgatttagtgaggcttggcaaacattaagtttcttagaaaatcttttctgttggggagctgcccattct

SEQ ID NO: 470597 - DNA, 1220 bp, Homo sapiens
ggaatgcaggacttgggaatgcaaacttcccatggcagggacgggacgcgaggtgggtgggaagagcaatgtacgatgcgggagacgccaccgtgcttgtgggaagggcagcgtcaccatgctaggaggaaggggccttggcaaggaatggggagttggggctccccgtgacagtgagggaggaggtgggaggaggggcctggccgtgcattgtcccttccagcctgagccacaagtgcagcagcaactgggcagtctgttgggagtgccctggcagcccccgggccccccaatacagcacagccctgctgatcaagagacaagcacggtgacccagcagcagtggcacctccagggcctggatgaagttgtggtcaggcagaagagggccccacagggctcctggaaggttggcacactcttccatggaaagagagtctacgctgtggccatcagcggctcaacccaccacgtgtacacgtgtggctctggctacatcagggtatgggatgagagtgcgctgcatgcgggggagaaggcccctcgggcccagctggacttgcaggaccgtgttgttacctgcaagctgttccctgatgagcggagcctgatcacagggggtgcgtcccaggccgtgactctctgggacttggcacccaccccccaggtcagggcacagctgacctcgacgggccccacgtgctattctctggctgtctcctctgatgcccatatctgtttggcttgtttccatggatttgttgagatttgggatttgcagaaccaaatcttgatcaggaagcacgaagttcctgtatacgggtcccgatgtgtggacatcaccggcaatatattctggacaggaggtgaagacaccatcctgtattcctgggacctgaggagctaccagaggctgcaccaacacaacttacagaatgagatcctcagcattacccacgaccccggtgaagaatgggtattggcgggcctgagaacgagtgatatcgtgttccttcacactcgtcggaatgagcagtttaaggctctcatgaaaaaatacacccgccaccacagcctcaagtttgcctcctgtggtgagtgagaagccaggtgacacctctggggagctattttgtgaccgcgatagatacgcgcctcagtggcttggaggcaccttctctgcaaaagttgtttcaggtactggacacagagggatgccc

SEQ ID NO: 470598 - DNA, 634 bp, Homo sapiens
ggaagcgccacaccttctctatggacccctcaagcatgagagtgagagagcgagtgagcaaaagaaatgactagtgaccagttgagaaagtcctgtcttccattgagccatttcactcctgcccatctactctcaactgctcaagagccgctgaaccctctgaacacttcaggaccctcagctgcaggtctgttggaatttgctggaggtccaccccagaccctgtttgcctgggtattagcagcagaagctgcagaacagcgaatattgctgaacagcacatgttgctgcctgatcgttcccctggaagctttgtctcagaggggtacccagccatctgtggtgggctctacccagttcaagcttcctggctgcttggtttacctactcaagcctcagcaatggtgggtgcccctcccccagccttgctgccgccttgcagtttcatctcagacggctgtgctagcaatgagcgaggctccatgggcgtggggccctctgagccaggcgagggatataatctcctggtgtgccatttgctaagaccgttggaaaagtgtagtattagggtgggaattacctgatttcccaggtgccatctgtcaccgcttcccttggctaggaaagggaattc

SEQ ID NO: 470599 - DNA, 635 bp, Homo sapiens
cgtgggtttgatctagctgatatggcttgcagttttcttttgttttttgcatatcgttttatttggcgcttggtgcttcagacctgtttattcttcttggcctctgcagcagcttctcaaccatccagctccatttggctccactctagaatgagtggtggttgtggatcccttacaagtgtagccaggtggaagcccgtctgctttcttcaatgtggtcgctggtcacgagtgttcaggaaggatggaggtgacacagaacagacactccagtggagtgcggatgacactacagaaaagagtgatgaggaaaatatcatcaggtacttctgccctagacttgctgaatcagaaactctaggggtggacgcaggaatctgggttgtaacagttctctgggtgattctgacgaatgttcaaggcaaacaaccaggcgctatgcatggaagtcaaattgcagaacgtaggtcctgtgcccttggtatttctgagctgaccagcagaaccttctctttgtcactgacttttgttcaaggtttgtctccctgctcagatcctgcctcataggctatctagtatttaagtctctttaaaattctggctacccattagtgacccattctgtgttgatgttt

SEQ ID NO: 470600 - DNA, 1076 bp, Homo sapiens
gctgataacgtgagctaatattgactgtggctgggtgccagctccacatgaggcttttccatggactactgtattgatgaactcatatgcttccatggattccctacactgatccagggacagaaatggttctattttatggctgcatcattgtctgtcatcatcaccatcaccaccatcatcaccatcaccattgtcattatcaccatcgtcatcaccactgttaccatcatcaacatcatcaccatcactatagtcatcaccatcttcatcactatcatcatcaccactgtagtcatcaccattatcaccatcactatagtcatcaccatcttcatcaccattatcattaccatcatcatcatcaccatcactatagtcatcactgtcttcatcaccatcatcaccatcactatagtcatcaccatcttcatcaccatcatcatcaccactacagtcatcaccatcatcatcatcaccatcatcatcatcaccatcactatagtcatcatgatcttcatcaccatcatcaccatcactatagtcatcaccatcttcatcaccatcatcaccatcactagagtcatcaccatcttcatcaccatcatcaccaccactatagtcatcaccatcttcatcaccatcatcatcatcaccatcatcaacatcatcaccatcttcatcattactaccaccatgtttatcactatcatcaccaccaccatcactactgtcattattgccattttcactatcttcatcatcactggcaccaccaccataatgatcatcatcatcattgatatcattatatgattattgctattctttaacttgtcctattagcccaggacctcctccaggtctcccttgcttgcgctatgtggccgtttccctaataaaaatcagcacctctgtggctctgaatttcaaactcagtagtaacaatcacagtcatagctactgttcactgagtttcattcattatctgtgaaactaaggtggtaattaaacctcataatgctgttatgaggattcggcgatggagccttatgtttgacagtgtttggcccatg

SEQ ID NO: 470601 - DNA, 583 bp, Homo sapiens
tcctcctcctcctccttctttcccctctctctctctttctttttgagacaggctcggcacctggtacatggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggc

SEQ ID NO: 470602 - DNA, 608 bp, Homo sapiens
agctcccaggtgatgccagtgctgctgcagggtcaggcctggttagcatgtggtgctctcttttggtgctgtttggccccggtgttctttggaatttaaaaatcaaactggcatggaaactgctttaccccaaaattttggttcacagccttcattggattacctactggggcaaacagagtactcaagctatactccatatttattggaagccagttactaagacccgcttacactcaaaaggagtggaatcgtggtcctcatctttcctagtggtctgcatttacctgggagagtttgacctcgaagtcagcagtagatgtgttttagctcccccctggaatcttggctgccccaggagcatggggccagggatgggtcctttatatatgcagagattatatgtcctgaaagaaaaatgcaggaatggtaacctctcattcagaaatgcagccagaaagggccgggtagcaaatatttttggctttgcaggccatatcatctctgttgcagtcacttaactctgctcttttcatacaaaagcagccatggacagtaagtaaacaagtgaacatggctgtattccaataaaacattatttacaaaaa

SEQ ID NO: 470603 - DNA, 549 bp, Homo sapiens
tgtttgtttctttctctctctctcttttttcctacagcattgcgatagatttaatctctctctctctctccctctctctctctctctctctctgtgacatgggacttatatgattgacacacaggaccacccacttatcatttacactagtggaagtaagatggttccaaaagctgggcttcagtgtgggcaccgagtcctaggagctttcctatcttctcaggtccaagggtggtgcctaatgttaatttcagggaggtataagactgcatacgatacgcgcttcttccccaagcactggtgccataaatggggccatacatcaaacccattgattttctacttcagagaccccaagagccatacaaccctaaccctcagtgcccctgctgtctttatatgccagacattgttctgggccccaggaataagcattgaacacaatggacaaagcctcttctctcttggggctgactttctgacaaggaagacaagacagacattaaacaggtaagtacaaatcaggcggatatgtcctaggaggaaaaa

SEQ ID NO: 470604 - DNA, 502 bp, Homo sapiens
cccagaaggccctaaaatgcttgaccccagcttttcactctggtgccatcaccctccaatcaccactcccattttcctcctgaaacattcctctcctttgtcatatgctccaccctgtgaagactttctagaactgcatgaaaccactaatagaaattgggctactgccctgcccagtcagccagcctactcccagaccaagagctggctcagaggtggtcccatcgcacaaagaaagccccacacagccacctggcatgctacacccatacctaccctgagagccagcccagtggtaggcccactctccaagagagcccactacacagcctgtcaacccaccacacctgcagatacctggcccgacaaccacctctatgccctaggccccagaaacattatgttaccattgtcacaaactcccatagccaaggcccctgacacaattgcagacattgcagacaaagattatagctaaataatctgtatggagatcatatga

SEQ ID NO: 470605 - DNA, 596 bp, Homo sapiens
ttgtaaacacaatgcgtaaaattttttccacagcagctggtactgactgcgactatggagaagatatcatgagcgaaggatacccatgtcaactccccggaacctgtaactgtgactctatttggaaacagggtatacgcagtgtccccagaagcagtgtcaatttcagacgtctgggctccaacaccgtgagcaaatgtatctctgctgttttacgtcactcagtttgccgttattacagcagccacaaaaaactagcacagggtcctttgctctgggcaccatgtgagatatattttgctgctaatgggggctcttggcaggaggggcgcctaaacttcgggtactgtggaagtgcagaaagggccacattgcccactgttaccccatctgtacctacttttgaggaaatggtagttcagctctgtagggtaaatgcgcctgacagcaatagcttgagcataccttgagaatgactctctgaagggtatatgtacctgaatgtctgttcctagctagggaatctgggagtggccaatcaggagatacattccctgtctatgaggaacaactgagccccctggcctcacaggccg

SEQ ID NO: 470606 - DNA, 854 bp, Homo sapiens
tgacctgggagatggtggcaattcccttgattaacttaaggcccaggttcctcatcttcagcattttctttcaaatatggtataaaaggtacaatatggagcttggtggcaccaccagggaggtgatgaggaagaaggtgctgcctgtaacagtagcagaagaagtgagaatctccctgacccctctgcctcccctgcagactccaacagcaaaacgggggcccacacaggatatgggatccaagagggatttttctgcctgttgtggcctccaaattctccaaatagcaggcgggggcccccaccagggcgtctctgatgaaaacgttcagcttgatgtggcgtctctggttcctctgaacgcgctcagagacagaggcgttgagcggtgctctctgtgtttgaaggtgtttctctacagcaaacaccaggcggagaagagaaaaacccaaaccacttcaagactgagcaactttgacatcacccatcagtgccagaggtcactgcactgggatcggagtgcaggagccacatcttgtgctctgagaaaggatggtcatggtggtgatggtgatgacgacattgatgatgaaaaggataaagcttccctttctggaggccagaagtctaaaatcgaggtgtcggcagggctgcgcttcctttcaaggctccaggggaggatccttctctgcctcttcccatgtctggtggcggcgggcaatccttgacgtactctggcttctggctgtgtcactccaatctctgttctcatttctcatggtgttttctcttctgtgtgcctgtgtatctaaatctctcttttttaattttgatttttattgttttttgagtcc

SEQ ID NO: 470607 - DNA, 931 bp, Homo sapiens
tggaatcttacaggactagttacatgggtcatcgagtcaatgcccaagatgaagaagccttttctttctgaataccctttgggttcaaaaagaataccgtccaactcccagggcgaatttggtgtttctcaaattgttgaccttgaatcaactgcattagagtcactgaggctggtcctccatgagaaagcaccctcagttaaaaatgcagattcccaatctctacccccaaaatggcctcaaccagactttctgtggatagggtctggaaattccaattttacatgcttcctccgagatgtgatgcttattcacaatgacaatcgaggaccatggggaagaaacactaaatgccccattacgaatgctcgagacccattacaaatcacagaagccctgcttgtggaagccccgcttgtggaagcccctgcatttaggaaatggggccgtcgtctgctggtctgcttcaagctctcttccctctcctacagagcataggagtggagggcagggaggtgtcatgtcaccttgttggttcaagtttccattgtacagccacttttcctctgcccagatctcctgcttttggattctggctctaaagcatgatactctccagcgggtagtggcttcctgaatttccttgtttctgagtctccttaccttttccttttttcctttttagcactcctaagacctttgtaactagttgctcatattaagtttcctcctctgaacctatctgggggtgagttctgttttccagactctactctgacctatgcagggagaaacacagtaaaagttgtcatacaaatgactagccagctacccatgagttattgggtacctctggtgggccaaatatggcgctaaaaactttagatatattatattagatatattatttattcattcaaaagtatatatt

SEQ ID NO: 470608 - DNA, 816 bp, Homo sapiens
cagcaagtttgccacttattccctgctctttctcaaggcatcgtccctagaatgctcttctccgagatgccagcctggctcattccctcatctcctccacatctttactcacatatcaccttattgaggccttcccttactacctttttagaacactgcaacctgcttcacacgctgtccatgggaatgatgcctataaagccttcagcacagtgcctggcacagagaaagcgctggctgaatggagccatttgtaatgataacaatagtgatgaggaggaggggccgaccctcctggggtcagaggagggggcagtgggccataactcacactttccaggcaggggaaactgcttgcactctctggaaaccctgagtccagtcttcctggaatgtagggcaggaaggcaagaagcgttggatgaagggggcgggagatcccatctagggggaccttttatgaactgctccatttgtcctgtagtaaatgaaaatccaggaagagattttaatttaggggagaggagatccagtttgcaccttcgcatggtcaccatgacaagatgtgtcatgagagagccggttcggagctggttgcaggagtctgggtagatttggggtttgtctcatgttttctcatgattagattgaagttttgcattttagggcaagaatatcaaaagcaatgtgcccttctcagtgtttcaaaggaggcagcaaggcatcaatatgtcttattactggtgatattaaccttgatcacttggttcaggtgggtttcacaactgtaagggtactattttatctttcatcatt

SEQ ID NO: 470609 - DNA, 704 bp, Homo sapiens
gttcatctcacgctgaagttgacgttgcaatttcaggtgctgcaagaatgggttttgtccagagtttttccatggtctatgactactaccatcaccaccaccagggctaccaccactatgaccatcaccaccacagcaccaccataatcaccagtaccaccattatcatcactactgccaatgccatcaccatcactacatccgtgctaccaccaccttcaccattaccatctcataactaccaacatcaccaccaccaccatcactaccaccaaccatacaatcaccatcatcatcatcattaccaccagagataccaccactaccatcaccatcactgtcccgccactaccactatcatcatcaccaccaccaataccaacaccaagaccatcatcaccaccagggctaccatcatcatcgccgtcacaaataccatacttttatatatccaatatgctaaactctctccttcaaaaattcaacagtattgaattgcaggtatccatccctttttgccagagaattcgggaagttgcaggaatggaaagtgagttgctcgatgtcacaaaggaagagccaagataagaattcaagtgtttctcagtcccaaaccatgttgcatttttttgtatgctttcactaaaccacttcagtccaaaataatcttattatttaggacatttttccttttccaaagactc

SEQ ID NO: 470610 - DNA, 847 bp, Homo sapiens
tgtgtacaggagctcatgactgctgtagatcgcagcttctagaagccatctgcactccttgactcatggccccctctttcatcttcaaagccagcagcagagcatcttcaagcctccctctaaatcgtattctcctgtctccctcttgtaaggatccttgtgattatattgaatacactgagttcttggaattagaatgtgggcatccttggagcatcattatgtctacccccaagtatctactgtggagtaaaacctgcctatttattatcaccatttcattttattgcctgttgaaagctcctattgaagactttcctaagaagcaatgggccaaacttccagattcccttttcatttccatggcaatggtccaaggatgccagacaccaaccatgacctttcagggcttaattgacagtgattcatctcacttgcatttggactcaggagggccttttgttgggttgaagaagttttcagcaaccaacagaggcatgggactccatcaatatttgtggattaaataagtaaatgaatattcagaaggtaacagcctactttcgagggtcatttttgaagacaagaaatgtcttgtagaaaattatttgtaattgacaaaagagcaacatatttcagtaagcatatactgccagggactcacttatttaaaaaaatgtggtggctcatatgcctttcttcccttgggctgaaacattttcaaacacagtggttgagtccttagtgcctgaagcttgttggtgcccaccaaatacttgtgaaatacaagtgagttatgtaaatcatcaaataattcatggaaaagccaagatctcgtagaagcttt

SEQ ID NO: 470611 - DNA, 540 bp, Homo sapiens
ttaggctgcagacacagatgtaggttactgttcagtgttgatttagcccaaccagcactagagaatgggaccattgcccagagttctctcctcctctaaactttgtgcctgcatggttgtgagtgtggcaggaagaggaggaggaatagaagaggattcacccccgtgtgtgcaggtaaatgctacaaggtggccacagggggacagtagtctctgtccctgggaggagaactactaccatagcaaaggcgtcatcttaaacagcctcgacaactcaaacacaaggataaaaatagaagccccagaaggatttagtgaaaataaaatgaaacctgagagccccagaggcaaccctggatttgctggagaggcaaagcacagtgcaatctggtggaccccaaggtcaagggcaggaagcattattgcaggtgagagcttaggaaggggcctcttgacctggccccggggtggacaaaaggctaggagaactacatgacaataatgattttaacaaggatcaggcttcactcagtggtctcc

SEQ ID NO: 470612 - DNA, 725 bp, Homo sapiens
ggcgctgttcgcgtgcacctactcgcgttcgcgttgcaccgcccggccgcgcgttcggccgtcgatgtccgcgtgtcgcctaccggtatcaggagtcgcgttccgagtcgcggttctccagacgcgataccgtgttgccgtgtccctgtcccctcggccgcgccgggtccatgtccgccgacgcgcgccgctacccagttcgcatccgatgtcccatgcccggtccggttcgcagtccgttccgccgtccccgtacggcccgcagcgtcgcggcgcgccgattccgcgatccaaccgagacggtgccctcccagtcctggtctagcgcctccgcgcccgtttcgggcccgctccgtcgccgtcccgcgctctcccgtcatctcgacgccatcccggcccgccccgatccctttcggcgcggccgccacggcgcgggctatccgccccggccgcgcccgtcgcgcccgcccgggcggtgctcacgttcggtgcccccgtcccctcgtgccgcccgtccgccggcggaccggcccgttccgtccgcccgcgcgcgcacccaccttccggcccgccacccaagcctcggacgtgcggccttcggtgccgccccccctcccaccgccgggggatggtcccaccagcaccccatcctctggctggccccggccccacgctctgagcaggagctgcccacagagcctttgaggtagttgggctgttcccat

SEQ ID NO: 470613 - DNA, 947 bp, Homo sapiens
ccgcccagcctgcagctgagcttgttagtccacagtgatctggatcccttgaagaaagaaatggaagaggtctggaaaatcgtccggaagctgctgattgagggcttaagactggatcctgacagtgctgctggctttaggaggaagctgttcaagcgcgtgaagtgcatctcctgtgaccggcctgtggagatgatgactggcccacagctgatcaccatccgcaaagcccacctgctgtcccggctgcggccagccagcgccaacagctgcgagtacttgcagcggcaacagatgagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgccgaggtggacatcctgggcgtggatgggatcctgtacaaaggccgcgtgaacagccagcgtggggctcagcccttggccgtcgcaaaggagctggcagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagaccc

SEQ ID NO: 470614 - DNA, 606 bp, Homo sapiens
acagatcggagccgtggggccgcgcgaaggctcggtgtagcaacgatgcccggagggggccgagcaagcgccccgccccgagtccccgcccccgcgccgccgggtccgcgttccagcgcgtgcctagcagtccgcgcctggggccgggcgctcaccggacttcggagggtagcgataggccgagttcgcctggatgtcgatgtcctccacccccgcgatgcggcggctgagaatggagcccatggtgcgcggcgctgccgggcagagggccagggccggaacgggagcggcgacagcggcggggtcctcacgcggacatggcccggaccaggccgcacggacgctcgtccacggccgcggaggcgcctcgagcccccacccccggctcggcccggggcccgacgccacggcggccctccgcctcccggtcccggggcacgtcgggaaatggagtcctctcgccgccgaaggcgccgggaagcagcgcgggaagccccgctgcactaacatattaactctttggtcatttcctcatctgttcgcttacagactctcctggagccccagcgccttccacttgccccctctgaaatagctccctgagtc

SEQ ID NO: 470615 - DNA, 1593 bp, Homo sapiens
gccaggcgagcggcgcgccgagccaagccaagccaggccagatggctctgcagccatcagggactgctcccgtccagcctggccccactttagctgtgcaaacatttctttatcccaacaagacaattaaacccagcagcatgaaaaagagtctccatgactgtgttgggagtgaacaaccagaaacaaccacacacatcacaggagttcttgcccccggggaggcttttgggacccaagaatggctgttcaagtacatcaaagatgagagcaaagcagaacatccaggagctgctgtgagccatcaggtttcctgcctacctgtgactctgcccgaccacagtgaaggtcaaggaaagagggcaaagccaagccacgtgtggtcagtgcccagggtccatccctggggaatcacctgtgaagccaggtggatggacaggcaagcaaaccagaatcatctatcaggaaagatgatgcttgacccaaatcgctatatttctgtctataaaaatgcatgtttaaccacaaaagaaatcctgcctaccagtacccagatttaaggaaagaacatgtgtgcattacaccatgtctgcaggcctctctttccagtgggctcacaagtggacatatctgcagattgatgtagtgtgtgagcagggggtggctgcagcagtaaaaactgtcagtgtttccattatacaactgatttcttaatgacctaaaactcagtcataaaaacttctgctctaagtaaaggacacacaccaccattctcatctcccacccccacccaccaacaaaactctaaagctaaatgcttacttcggagtttgactgctgcacttaattaaaacatttaaaaaatattttatgaaaagatatttatatgaagagaactgaaaaatgagtcaaccatatcagcaattaactctaaattttaagaataaatatatatacatatatacacgtgtgtgtgtgtgtgtgtgtatatcaaccatatatggttaatttgggcaatctggcgaaagcactgtatcctatcactctgctcgtctgaacactttctatcctctgtcttttcatatccccataccccgtcactgcccccatctgcccctgaagctttctctccctttggaagcagtcttgtatactgtcactcgattatctgagaaatattacttatttcaaaacggttctgtagggaggacctgaaaggcatctagtgggaataatcaggccttctaacgacccttaaatatgtatttacataaaacagaccataaatattccgacacacgtcggcatatgacaggagccaagaaagctgctgcagactttgtcttagtgcctcttcaacccttccttacagaaaaatacttctcctgccttccaaaaattcgcaatcaaaagcacaaacgctatctagtatgacccagtgagggatgtgctaaccacctaaggtaaggaagggagtaaaaagcacaactccagggtgaccacagggtagcacagcctccttttcactttgcacctttgttttttattaaagattagtcacaaatgcaactctggataataacgagggtgtac

SEQ ID NO: 470616 - DNA, 898 bp, Homo sapiens
aaatgttaatggcaaatccaaggcagtttacaaatctacttaagagagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagattgaagaggggtgccaccgacgtactgaagtgaatgtcatttcattaagaagtgtcggctcctagggaatttggggggcctaaagaaacatgtccacccctcctctctttgctgtcctc

SEQ ID NO: 470617 - DNA, 760 bp, Homo sapiens
cgggtaccctgaccctcaggaagatgtgtttcttaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgaggactctagaggatccccgggtacgtacgacggttcctcaatttttcaatctttttgccctcatcgtgttcg

SEQ ID NO: 470618 - DNA, 686 bp, Homo sapiens
agcctctccattttgcaggtggggaaaccaaggcacagaagggttagataacttgttcaatgtcacacatgtattcattcagtcattcaacagatggctatcaagggcagcccttttccaagaacactgggataatagtgaacaaaagtctctgtggtccccacctcgacttgcctatgggggtcaagttgcttcctgagtacactcatctggatgcaaggctgtccttccttggtgaatggtgggtccctctgatcaatatgttcattcttgctgtagggagagaggattctttgagcccttggtcctcagcctcagcatcactgacttggtggccctcgcctcatgcattgtcagccagaacttttggtttgctcattgcaacccatcaagatcccctgggacgagcagaatggaaagaaaacccttgtgttcgggatcgttgaattggaggtgcccttgagacttggcacagtgcttggagtgtcggaaaagctcagtagagtttagctgttcctgtgtcttgagagaggaagaagcagggaaacagaagttttcagggataacatgcttccctaagcctgcagctgagcatagcagagatgtcagaatgtttcatgaataagagcacagcttctatgttggataccctgaatttgaatctcagcatggccactttgtatata

SEQ ID NO: 470619 - DNA, 850 bp, Homo sapiens
ggcttgtttactgcctggaacagatttccatccggctgaccttaagactctctctctctctctctctctctctctctctctctctctctgtgtgtgtgtgtgtgtgtgtgtgtgtgtgtgtgtgcgtgtgtgtgtgtgtgttcgcacacctttgcacaatgaaagttgagaggaaaacaaataaaaaccacaaatatgctttggcattggcgttttcgatggatgaaatcaacagaaatcctgatcttttaccaaatatgtctttgattataaaatataatttgggccattgtgatgggaaaactatgacaaatacagctgattttcttgatcggaaaaaatataagcgtattcctaattatttctgtaatgaagagactaagtgttcatttctgcttacaggacccgatatgaccacatctttatattttcaaatgttcctggacattttcttatctccacatttccttcaacttacatacggaccttacagttccatcatcaatgatattgaacaatatccctatgtctatcagatggccccaaaggacacatctctagcattggcaatggtctacttcatactttatttccactggaactgggtcggccttatcatctcagatgatgatgaagtgtaatttcatagctgtttttctagttgaatgtatatatgtcttttatgtgactgaatgtttacatatatatgtgaacacgtatttatatttatgtgtaattaagtatagggctgtattacatgggtgacttgggaaagacctggacctctctctgcattagtgtgtctgtgtgtatgtgtatatttctgtatgcattgcatacatgcatttgg

SEQ ID NO: 470620 - DNA, 1058 bp, Homo sapiens
tcttttctgttgctagcagacctaactaagctttcctttggaaatcagatatggatcaatgcgtgaattgtccagaataccaatatgccaacactgaacagaacaaatgtattcagaaaggtgtcacctttctaagctatgaagaacccttggggatggcacttgccttaatggccttctgtttctctgcattcacagctctggtactttgtgtctttgtgaagcaccatgacactcctattgtgaaggccaataacagaagcctcagctacctattactcatgtcactcatgttctgttttctgtgctcctttttcttcattggccttccaaacagagtcatctgtgtcttacagcaaatcacatttggaattgtattcactgtagctgtttccacagttctggccaaaacagtcattgtggttctggctttcaaagtcacagacccaggaagaagattgagatacttcctggtatcagggacacccaactacattattcccatatgttccctactccaatgtgttctgtgtgcaatctggctagcagtttctcctccctttgttgatattgatgaacacactctccatggccacatcatcattgtgtgcaacaagggctcagatactgcattctactgtatcctgggatatttggcctgcctggcacttggaagcttctctgtggctttcttggccaagaatctgcctgacacattcaatgaagccaagttcttgaccttcagcatgctagtattctgtagtgtctgggtcaccttcctccctgtctaccatagcactaagggcaaacacatggttgctgtggagatcttctccatcttggcatccagtgcagggatgcttggatgtatttttgtacccaagatttatatcattttaatgcgaccagagagaaattctacccaaaagatcagggaaaaatcatatttctgaacaaatatttaggaattctgtcaaatgtaaagttggtacataaccaccaaatattgggttttagtgcatgtgtctagttttagaatcagtctcactggttgctct

SEQ ID NO: 470621 - DNA, 963 bp, Homo sapiens
gtcagctgaggaacggtggtaccgggtgaagaaaatctactttgggttcgtgaaagatcaagatgaatccgaagatgatcctgctcctgatgtttgagaccgggataacatcgttcttcctggccagtcgagcgcgcgcacgaatatttggaatctttgtgactcaagtacttctggtgacatgccttatgtttgaatgtaacaggaatttggcactgcagagtctgtctgcagaaggtgccaggccatccacacttcaacagcacatgctgtgctgtgctcagacacccttgctaagcatggacaatgtgatgatcctccagacctcctatggtcttctaaggcatcaagtgacttacactattggggatacccccatgaacactgagagtagagaggccattcagagtgagaagaagaactgcatacgcagcaacagtggcaaaacttttactagcacatcccacctcaatcaacaccggatgatacacactggagaaaagccttttaagtgcagggagtttggcaagtccttcagccaaaaagtctttctcgtgaagcatttcagaattcacatcggagagaagcctttcagtttcagtgagtgttgcagaaccttcaagcacaactgcttatttgttgctcatcagcgagttcacacaggagagacacctttatatgcactaaatgtggcaagtcatacatgaacagatccagccttttatatcattattgggttcatactgaagaaaagccatagaagtatactatagtagtttgaataggtttgggaagttttcttctataattttgttgaagatatttgctgaccctttaagttggaaatcttcatgctcatctactcttattatccataggtttggtattctcattgtgtcctggatttcctggatgttttgagttaggatctttttgcattttgcattgtctttgattgttgtg

SEQ ID NO: 470622 - DNA, 625 bp, Homo sapiens
agggatgatgggggtggacatccctgccttattcccatgctgagacacaagtctagggctcttcggggaaaattcactctcttagtggagccctctatgatttacccaggatatgctaggaattgggatgtcaaaaggcttcaacaaatagaggcagagctccttgattttggccagaagtgcagcccaacccttggaagtaaggagttggagcccgacgctcagggcagcatcagggcctcaaaggtgtcccctgaacaccagcccttacagcctccgacaggatgcttgcgtcggattcagggctgggcctggacgggggctgggcagctccagaaggtgggactcagtgggagcatttatggggcacattccctgtgcctctggcccattctcctctcaatcctcatcttaatatccactttggaagagcagattatttctgtttctggttgtgccccaaccactgaaagatgatcttgctcctagtagttgctcaataaatatttgttgagtgttgagtgcataccagtcactgtgctgagtgacttgtacctgtgcactctcactaaccctcccaggcccattttacagatgaagaaactgggaaacacagaggctgagc

SEQ ID NO: 470623 - DNA, 714 bp, Homo sapiens
tcaggaggcaaggaacttggaggcaaggatggacacctgtgatgatgatgatgatgataatagcaacgataacagcaacagctcctattcgatgagagtttattatgtgccaagcaatgtgctaagcatgacgctggcaggagttgggattcaaaatcttggagttgcgcctgactcctcccactctccagcagcttcctggccatctctgctgcgcaaatgtctctggatcctttccccctgctccctgacgctggtccaggccctcagtgccttgagcctgaccctgtgcttttgcagccaagccttggctgggatccatctctcctccctcatgtggagactctatcctgatctgcactctctccctctcctggctcttcccggcagcctccacatgggctcaggccaccaccctctgtgtctcccagatccctctgctctgcttcgcagccaagatgtggacatatggcccaagctgtgccagtctgatgccctcctggtctattctgaggagcaagtagccagaggctagcaggggtcactcagtggctacactggtagcacccagcgggtgctgtttcctgtgctttttccgggctgagagacaattgtattatactttctgcttcttggcccacagggctctgacaccaacaattccacccttaaatgtctacttaggagaaataaaaacatatattcacaaaagac

SEQ ID NO: 470624 - DNA, 522 bp, Homo sapiens
acgaagaatgatttacaattcttttgtcttcataggaagtgcccaaaaactggagttaagaatcagactcttctgtaggaatgtcctccttgatcattggacacatcgaagtgattctgctttttggttgacgcgaatattaaaaccatggccaatggtgaatcaggcaagattactgtatatcatctttgggccaatatctcctcaagatggacaggtggtttggcaggaaatgatagaagaacctacagatgaattcagtctgaaaggtttggctgatgccattaagttactatatgacgctagcactaaagagtggacagcagatgatgttatcagtcttgtagatgaactatcagaatgtggcaaatgcatttgcatgtgttataatggaaatgctgcaatcaattatgtctggtgagtaggaatgtacttggtgcacagtccaagaatggaaaaaaaaaaaaaagctatttctatgttgactttaaaaaataaaaactaacaataagtagaggaagc

SEQ ID NO: 470625 - DNA, 551 bp, Homo sapiens
tggacctggtccctgaccacctggacaaatgttctgaggtcccatatatgcaggccttctttgctttgcagggtaatctggacctaggccaacattgtagtattgattcaactctcctagtggccaccttgggagaggctggaagggtcaatcccagggaactaggaaagcaaacctcagaggacttagggcaaattaaaagggatcttgacaagtattcagaaggccctgacaggtatatagagactttccaagtatttgaactcttctggaaggatgtcatattacttttaaatcaaaccctgactaccgttgaaaagcaggccaccctgcaagcagcaggcaatttgggggatgagctttctatctcatattgggccagggaagggaatgagtcttatctgattggaagaatagcaatatcattggaggactctaaatgggaccccaatgatgaaataggagagtggaagaggaaacattttcagatgtggatactggagagcttatgaaggactaggactaagcctctcaattacaccaagctatcc

SEQ ID NO: 470626 - DNA, 604 bp, Homo sapiens
cgacggcatggtcctgttgaggaggataaacttctctggctccatccaatatttacagcattggttgtcacatgggatgggttgtcaacaaggacagtttgctcctgcaggcaaggtctgggctgttgcaagcttatctgatcttctgatcttctattttgcattgctattgaaggacaaaggatggctggaatcagagaatgtagggaagcacaagcttgaaaagacatgtgccccagtggctgagaaaaaggtgaatgcaaaggctgtgatgcaagaattagcttggcaggcacttaattttcttggtagctcaggactgagagcaatctccagaagttgcttcccaaccagtgagtttgaaggcttttcaaccaagaaatttgttactggacaatcaagaaatatcgttgttctaggccctggaggaaatcaggagcagcagaaagtgggaagggcctctgttagaacacttcggtactctggatcctgtctctgggaatcagaggtacctttgaaaaggttgtcaaacacgtacatttcaaaagtcaaactagaggttaattaagaccaaaatctggaggaaaactgggctacccctgtc

SEQ ID NO: 470627 - DNA, 802 bp, Homo sapiens
gccagaagtattggccatttggcacggctaaggttagcctgcccctgggagccctgggagccctggaagccctgaaagctgctgcgatgggtccaggatgagttgcccactggtggaggagcagcctggggcatggagctttggcagcacttcaggagcccagagcaagaggttggagcagcatccacttcggggccctggccagcagtatggccaccatacccacttgttgagggcaccaggttcctgcacttcgggaagaggctctgcttggggccacccagggccacatccccaggttccaccccacatcagggtgactactaagcctgacactcctgatggccagtcctggaacctgcaattcactcctggaggtgcccccacaaggcagggccatgagccaggcaaggtggagccccaggccagccctgagcaccagggccatggaggggagctcatggcaatgtcgcccctgccccagacaccagcccagggccagcaaggacctggattccccaccccaggctgtgaggaggcacagctgaagctgcatgctccatggagccagcgggagccagggacaaacaggagccccaccccttctaagttgctgcagctgccctgccgtggctctacgctggagcgtgtctgcactctgtcccttcaggggcccgggaaggtgcctcctgtccccacaggatccaccgcactaattcatcgacggcatggtcctgttgaggaggtatccaacttacactaataatggagcaatgaccatctcagtctaaggcaaggtttg

SEQ ID NO: 470628 - DNA, 843 bp, Homo sapiens
ccatctagagatggttggataaactatggaatactcttcagctactgcaaatgattctatgagttcgttcagatctgaaaatgaaaaacctgtcgacctaaaggaaggagaagagaatatagttttaaagagtttacttgaggcaaagtgtggacagctgcccaggaaacacttccaagttgccttggaggtaggacaaagaacccagggtactagttcagacaatgagaaagtctacattaaggtgcattgttatgctaatgcagctcaaaatagctttcaaatatcaaatatgaatttaacttggaaaaataagatagactatgtcaatgagaatgttctcgaacatcatatggtagttcctttaccaatctaatatacaatgttaatgttgttttccccttgggtcctttagacagatccaagttgaatgagccttctgacagtaataaattcagaaagaactaggatgaaagctttatcgatctataaatataaaggttttgtaagccacatgtacatcgttcacgtttcatccagagttctgggaaagagtaggtggttcccagaaacaatgtgagttcatgagtctttctaagaagaagggaagaaagtttttgtcaaggccacaatgtatagaccttgtgctaagcactgatttataaataatccagataggagtaagaaaatgaaatgaagtctccttgaggtgaattttcctccagttgatagtagtagaaagctattatgggctgaaaatatatctcccccaccattcatgttgaggtcctaattcccagcacctcagaatgttactgtatttggagatagcctttgatacgg

SEQ ID NO: 470629 - DNA, 537 bp, Homo sapiens
cttcattagttctagtaatggtcatggtaataaaaaagaaaaaacttatcaccattatcatcatcattactgccaacatcgtcatcatcaccatcatcatcaccaccatcatcaccaccataaccatcatcactgtcaccatcactatcaccatcaccatcatcatcaccatcaccatcatcaccatcatcaccatcaccatcatcaccaccatcactgtcaccatcactatcaccatcaccatcatcaccaccatcactgtcaccatcactatcactatcaccatcatcaccaccatcaccatcatcaccaccatgatcaccaccatcaacatcatcactgtcaccatcactatcaccatcaccatcatcaccaccatcaccatcaccatcatcatcaccatcaccatcatcactgtcaccatcactatcacatcaccatcatcaccaacatcaccatcaccatcatcaccatcaccatcatcaacatcatcaccatcatcattaccgtcatcaccatcatcatcataaccatcat

SEQ ID NO: 470630 - DNA, 1055 bp, Homo sapiens
agtaaatacaagaggattgattgagatgaaagaaaacaacaatgtgtttttggaggtgatcagataacatcattgaggttgatctcaagatgtggaacagtgggctgggagtgctgggctggccttctgttctccagttgctgggacaatggtggaggtgaggaaggtcagtgacttcaacagtcctctaagtgggtctgactgaggtacccactcaaactgggaaaacaagcagcttggctgacgccgtccagtcagtggccggcatggctatttacacggggcattgcaaatgtcgtgagacatattcattaccaggagaacagtatgggagaaaccacccccacgattcagttatctcccaccaggtcccttccacaacacgtgggaattatgggagcacaattcaagatttaggtgcagacacagccaaaccgtatcagctacccacccactgccactgctaccagggttatcaagaagccatgaattctgctaccatcaactcaccaggacctccccttgctttggctgtgctgttctttgtgactttgatgcaaggaagccaggatggtgcaaaagtaattgagggttttgccattattttcaaaggcaaaaaccgcaattgcttttgcaccaacctaataccgtattttgcagatgaaaaaacttagggccagagagattaaatgactggttcaaggtcacacaattaactagtaacaaaggcaaggacaaaatgctcagttccctttttggtgtctatatttaactagcaaactacaaaaagtattataccaattaactaattttaggaaagggattttgtataacatgcctttttatctgacattggaatagggggttttcatatgttattgtggtgggaaattgaagcgtatcccttcatgcctcaaagcattatttttattttaaatattttcaatgaaatattcctaagacacattaaatgagactcccccaaagatttttacctcatcagtattagtgtgtgcattttgtgttacatccttttcttcctatagaagacattt

SEQ ID NO: 470631 - DNA, 571 bp, Homo sapiens
agataaatactcagtagacatgtgtaagcgtggtgtgtccttgttgctgcaggagaggggcaggtttgcagtcagcaacaatggctggcccatggcagatggctttcaggctctcggagcactcacttcagcccccagcaataatggcacatggggagagcctttctttagggcatatgctctgggagagtatgctttggtgcccagcagcactggcagtgggaaaggagagactgtcctcaagaagtgtatggtggaaatgtggactgctggggatctctcacttgccctttcccttcactggggagcctctccagactcccagccagttccatccgagccagctgcctcacatccctatctttctatgcatcaggtgtttcctgtcacttatctgttgaattccagtgttctctctcagatgctctatttcaaatgtggtaatctacttgccattttggctcttcttcatggaggaggtgagtaccagacgtttctagccggccatcttgaagcctcctcaccaagatgagtttaaaggctgatagagacatacaggcaagagattgac

SEQ ID NO: 470632 - DNA, 598 bp, Homo sapiens
ataatgtgttcgctgctgtttagttctttaattagaacacttcatggtggggattatacctgagctgggccccaaaggatgggaagggcttttgaaatgcagaaatgggaaaaaccacatcaaggagatggaaatgctcaaaataagctcggagatggagcagtgtccagcgtgtttgaacatgtcagttaatgagatgcaactgaagggaataaagcctaatgctgataaagtaaagttttgtgaattattcaaggtggaaatggaattttctgatttcgtatgtgcacagcatcataatttccaattgctctatcaacagaaagatatgagaatcactgatctactatcttttgtgaaaatggcttccgcaaatccaggacttgggtcatggagaagcagtgaacctttaacttgagttattactacatttaaatctgtgtaattattaccctgaatttactgagcataagctagatgacacaaaataacatattttcatttttcagcattttaaattgaataacaaatatgttcatttgttggtaatatcaatctcaaacctataccgaaacaatcaaaatgtaaaatgtaaaat

SEQ ID NO: 470633 - DNA, 1514 bp, Homo sapiens
tttttttttttttaaatgaaagaaacctcatgttggtgttgagtgcctatagcttttcgaggcacatggggtgcaagctgttggtggatctaccattcttaggtctggagaaccatggccctcttctcacagctccactaggcagtgccccagtggggactctgtgtgggggcttcagccccatatttcccttccacactgccctactagaggttctctatgagagttttgctcctgcagctaacttcttcctgaacatccagaacaattcagtggctgctagctttcagtatggttttgactattcacgtccattccagaagacacatgcatgtagtgatttttcattttcctggtgttcaaatttgaaatgtgtgaattatgacgccgaagttcagggagagtcccttggtcagagagtgaacctggatgagcacttggactccaactcaacatccatttttgctgtggcagcatttaatcactagttcttgctgaaaatattgattaatcaggaaattcttgacttaacgtagaaatttttatgttccatttctctctgaaaacaattattggaatttagaacacaagtttcttgtatattgaaggcaacaaacttttaagaagagctggcttcatattttagttcttatgtcctcttgtgtcacagtgggaaaacttgtgtcccaacctttaaatataaacgttatatttttcttttcctttctttttttaaagatcctctagtctttgcttcttaatacttagcatggttattagttgatattttctaatatagcagcagagtatcaatcattataaaacatgtctaacctagaggtttttaaaagtttttttctgaaatcgctacactgtctgctgggaatccttaatccgatttcaacgggttaacattctttttaaagtctaacacttcttataagacatggggtatagaataagaaagtcaaatcaaaaactaaaaattaatttatcactttaatatttcatttttcagatatgtttgttttcacaaaagtattctaatttttaaaatctgaagaaaacagaccctctactctttatatgtgttttccactgacttacaaggaacaaggaatctgctctttcaaagcaaagcaggccctctagttgtctatagggattttgctgcataaagattatttatttttcatcccatcattttgttcccaaataaattctattctatgatatagaaacttgtggtctgtgcataatcactcttttgggaaaggggaatcaactccaaaggagaggtatcactgcagtggagtcttctgaaatcacaggaaaaatggtgttaagtactcatagggcatctctttgttgggctggaaatgtagatgattgggttcaagtattctaactgaaataaaaggataaagcactgattccttacttgtctttcaagatatcccatattttctcatcttttccgaacccatctcccactcttcaacttatatgttttc

SEQ ID NO: 470634 - DNA, 1076 bp, Homo sapiens
ccatctctcttttctctctcttctttcctgctttccttcttttcttatttcttaaggcagcaggccttgttgagctgcggtgggctccacccagtttgagcttccctggctgctttgtttacctactcaagcctcagcaatggcggacacccctccccctgccaggctgctgcctcgcaggtcgatctcagactgctgcgctagcagtgagcaaggctccatgggcgggggacctgccaagccaggcgtaggatataatctattggtgtgccgtttgctaagaccactggaaaagtacaatatttgggcggaagtgtcccatttttccaggtacaatctgtcacagcttcccttggctaggaaagggaaatcccctgaccccttgcgcttcccggatgaggcaatgccctatcctgcttcagctcaccctccatgggctgcaccaaccgtccaaccagtcccagtgagacgaaccaggtacctcagttggaaatgcagaaatcactcatcttctgcgtcagtcacactgggagctgcagaccggagctgttcccatttggccaacttggaacggaatccctgcatttcttataagatattgggttatcagagcatgggcccatcagtcatgatgatggatttatgggtgaagagatatcttggaaggagatatgcatctctggacattggaaccagttctttcagtgtgcatagcagtactgtggtgcatgacatgtaagagaaatcacaatcaatatttttgaattaatggataaaaaactaaatagtaaagtatttgaagatgagaaagattttcaaataaaaagctgtcaagacattgaaaggcaggatctagtacattatatggaaaaacagtggatattgtctaaggcttttccaagggtctgaatcgttccacacattgcccctctgattagccttggaaactataagtggtctgttcggacatcgggggcatggtacagaaaaaagtttcatgcatgcattctttcaggtcaaaatatcattggggcagctgtgttgattgtgtttttattatgtatgtgatgtatatc

SEQ ID NO: 470635 - DNA, 633 bp, Homo sapiens
ctgggggaggcatagggttaggacaaatacctaagagatgcaagaatggttgtgatacaccacataaacagaattacaaacaaaaatcacataattgtctcaataaatggagaaagagcatttgacaaaatccagcatcgctttatgattaaaaccatcagcatagaagggacatcccttaatgtaataaaagctatctatgacaaatccacagccaacataataccgaatgagaaaaatttgatggtattccctctgagaactggaacaagacaaggatgcccgttctcaccacttctattcaacatagtactggaagccctagccagagcaatcagacaagggaaagaaataaagggcatccaaattggtaaagaagaagtcaaactgtcactctttgctgatgatatgatcgtatacttagaaaaccataaagactcctccaaaaagctcctagaactgataaatgaattcagcaaagtttcaggatacaaaattaatgaacacaaaccagtaacttctgtatataccaacagtgaccaagcagagagtcaaatcaagatctcaacctcttttataatagcttcaaaaaaaaataagtaaaatacttaggaataaacctaaccaagaagg

SEQ ID NO: 470636 - DNA, 631 bp, Homo sapiens
agacagctatgactatctccaaaatgcacctcctggattttttccgagacttggtggacatggatggatctggaagccattatcctcagcaaactaacacaggaacagaaaaccaaacaccacatgttcttacttcccctcatggttggaaacctgctactctagaggggtcaaggagttcctggaccactggccaccactctgaacagtggttgcagccaaagagctttgttggactgtggcagcagaatctgtgctcattcgcccatgccagcagcagcgacagcacagcagggtgcaagtttatcagctgggaaggggctctagcaggcccagggctgctggcctccatgatataccctgtttgggaatctgaggctggactgcaagcacgcatgaccaggataaggccctgggagaggccagcagacagaagagcactcagatcagactggccccatctcataggcaagatcaccctgctcagttcaggtctgacagttcctcagttcacgtccgacagttcctcagttcacgtctgacagttcccctaaggctagagtctcctagagaaaggcttgctcttccaaagcaagccttcagaaatgggtaactttggctgtggtccctg

SEQ ID NO: 470637 - DNA, 716 bp, Homo sapiens
gcaaatgcctctccaggccttcaagagacctcatgtggtcacatgagactcccaaagtccccttagggcactgtccctactctctgcaggagccacgtgagggcgaagcttggggcatgcatggaccccttggtcctggtactcagggctccagggtccccaccagaggaagccttcaccagttcacaaccagtgccacgggcagctctgacccctcctgtggcccagctatctctgggccaggaagctgtagatctgtggctgccaagcctgaccagcagggggggccagcgcccgtgtagagaccatcagctcccagagctgccctggggaagagctgccctagggaagggcctggtcctggccacccacaacaacagtgcccttaacgacaaggggcacctattggttcaccacctggctcttcggctgccagaacttacccggtaccaccctttgaaggatgaattgtctcggcttcacagacttccaaggccaaagtcagacaggaacgggcaggaccaggactgggccccacgtttgactaacatcactgtctcccttatcacaaggaggaagaggccctttgaagatgtcctttcgcacgggctccgaaatatctgctaaatgtaggtcattatgactgaaaatgcatttttccccttgtccttgaagcaggcagctgctctgtaagtttcggctgtagcctgatgttt

SEQ ID NO: 470638 - DNA, 2361 bp, Homo sapiens
aattacctaccttaagtgtagccatgcctacaactctcgtgctgtatgtgcttctgactgagtcaattacctttgcttttataaagatccgagtttggtttcttgcaatcaaaagagtcctgatcaatatggaagctgacttggttaccaagggtgcctgctgttgtgttgacatcaccctcactcataggggctcagtctctttcatagatgaactgcaccatgagaaaagggctgaggaccaggtggtgaaggggcaggagtatttgccttggaggattggagctggctatctgcaagctgaggagcaaggaagccagtccaagtcccaaaacctcaaaaatagggaagccgacagggcagccttcagtctgtggctgaaggccctagagcccctggcgaaccactggtgtaaatccaagagtccaaaagctgaagaacttggagtccaatccacactggcagctgattagacccacccagattgagggtgggtctgcctctcccaatccactgactcaaatgttaatctcctttggcaacaccctcacagacacacccaggaacaaaacttttcatccttcaatctgatcgagttgacactcaatattaaccatcaggccgactattcatcaatcagcattgtggcaatgttcagcaatgtttttctttctgctttgcgcagagttctctgggaagttaaaggaactagaaactttcttcctcataaccgactggtaaggccctctgatgttttcttcttggagctgggctttacagaaataaatttctacagagtctggagaaaatgctcttaaaaaaaaatagctgaaatctccattcctccattgaaaacccactcattttggtggtgtactgcacagagcaaactctgggggtgtcctgcccaggtgactttgctactcacaggtcccacctctggcttcttactgcaaagaactgcagctacctgaggtcattctcaaggatcaggagggtgaccagcctcacacaggcaggcccatagcaccggggagcagggcgcccttttggatggccatcacgggagggtgagcccatgcctcatctttatcacccgtcaggtgggttacctcttaggggtggcccagagactggttgggattgaaccattttgcgaacagctgtaaactgccccttcctctagcctgtgttagcttccttcccctcccatgtccttccccactctcctgctggtacctcctaggaccacttccctaatctgctgcttgccctcacatccttgtgtgagggcctgcttctggggaacccaacctgggacatggggtgtcaggcctccttggcttctgagtgagattaatctgaccgggttgaagccacatctggtggtgcttgttgttttccctcagggcttggcacagcatgagggacacatcagggttccaacatctggttgatgaatcaaagaacgtgaacatttaaatataaggaagcagggctgaaagctgacggggagacagggatggacctgggtctacaggtgccatgtcctcccaggtctgcacatccagcctcctctctcctgagccccagacctgtgcattcaaccagatgtcttcacctgggtcctcaagctcaatgcaactcatcatccctccccaccccctccataggtaacctgcctcctctcctgcgtggctggtgtcaggcaatgaaggtaggcacaggcttcaactccgcttgccctcagccacacagttcttgtttcatcactgtgtgcatctttctcgacgctctccactgtgtccagctcccctggcacctctctggcccctgccagcctcatctctcacctccagtcttgcctccctgcaatccctcctgtggccctgagtgaactttctgaagcggccttgaccgcgtggcttgctgctgaaaatccttggctgtggctccccactgcggtaaagaggaaatccaaactccttgtgatggcctagcaaggccctgcaggaattgcttcctgccagacctccagcccctacgagttctgttctccttaacaccctccccacacctgcagagccaagctgctttcagtcccttgaacctatgatctctcaccttcaggcctccgtgcatgctgttctctctgccccaacactcttccctcccctccttcctgggccaacaaccccatggagcagatgcttctgaatcccctgtctgggttacaaaagcctgcttgtaaccttgtgctttccctgtggctatttggatgctcctgaattatgacctgttatttaaacccatgtctctcctgtgaaaaataaactctcctagagcagggctgatttgttc

SEQ ID NO: 470639 - DNA, 1629 bp, Homo sapiens
ccatcttccaggctctctgctgaaggcccagcagactgagctttctggaacccaaatctgaccacgtcccacctccacttacagtatgtcactgggtcccactgcccgcaggctggcatccaagcttgctctcgccctggcattcaggatcagctgccttggatctaccccctgccaacaggtccccaccgaaccccacaatctgacccagatgagccatcatccccaacactccctgtcgtgtcccggaagcctgaccttgaccctggtcagctgtttcccacaccccgaatgcacttgctgtccttcccatcaacatgggctcctccttcaaggtggcccgggagctccaaggctgtccccaggcccacctggatgtccgacatgaaggctccaagcagctcagcagcatcccctgggaaggaaggggggctgtcaacagtgacagctgggtgctctattggggtcaaagtcttcagacccctagcaatggggatgccccctttcctggcatcacaggaaaaagtggtggcacatacctggtgagtgagatcccatctccaaaaagaagaggaggaagaagaaggaagaaggaaggaggaggaggagaagaggaggaagaggaggaagaggaggaagaagaagaagagcaggatgaggaggaagagggaggcaaagaaggaaaagatgaggaggaggaagaggaggagttagaggaggaggaaaagatgatcatcatgataatgactgatgatgaagagaaagaagaagaggaagaggatgaagaggaaggggaagagaggaagaggagaaagaagaaaaccatgccagtgctcgcagctcctccagggtgctccagggcctttgcactggctgttccctctgcctggggtgctgtcaccccagacatccatgagttcccacctctcatgacagatgccatcaaggcccaggcagacggtgcgctgcgccaatggattttggcagcagttactctgaaaagggctgttcccgcttgggcagattggcaggaaaagccccaagtcaataaggggtgggagataagcatgttcgagagaagccactgagattgggtgggctccaggctgttcctgtgaatctgcagggcaacccaagtccgaccaaacctgtcaattttacctgctgaacatgttgcaggtcacccacttcagctgtgacctgtccccactgccatgggctcctcttgatcactcgtcacctgcagctccggccatcttcttgccagccacatccagccaggcggttttttttgtgtaaaacacttcagtgtgtgccattgccattggtccctcggccaagctctccagtgtagctttgaaggcctctgggggctgcccaggcaggccctctggaaacaccctcccagtcacacttggaaatcatgtcatgccgctatctgggcaccccttagcccagtcaggctgacacataaactgaatcatcacagctgcctctgaggatcagctggggaccttaaaaaattccagggctcagctgtaccccacaggtgctggctttgtacctcagggggtacatgtaactgagggggcctgggcctgggctgaagcctgtttttctggctgggcc

SEQ ID NO: 470640 - DNA, 847 bp, Homo sapiens
gcgcggtgcatcactgcttaatggatacactagttagtgtggtgtatcaatacttcaccaatgcactagtcagtgcggtgtatcactgcttcacggatgcactagttagtatgatacatcactgcttcacggatgcactagttagtgctgtgtatcactgcttcatggatgcatgggttagtgtggtgcatcactgcttcacggaggcactgattaatgtggtgcatcactgcttcatccattcactgatcctgccagtcttagtcagcccactggctgctggcatccagctgctcctgcatgcttggggcttgctgagcctgtgtcctgggcccgaggctccaaagggcagggagctggccccatgtctctctcttttctccccctgcaatgcctggtacattgaacaccctggatccagcagccaagggtccctctcaggcccttgctctgcccagcggggagctggggctagctcacaatctctgtccttcttgcgggttccatgtctctcctggcttgtggtcacctgtggggcagcgggaaggagcctgaagaatgaggtgcttggaaaagtcccaagcataaggcctgcagacagtaaatgagttgtgggtgttgggtgggttgggagagatacgtgtttaagctgtacgtagacttgtgaaaaaaagacctgggtttgagtcctgacttagtcccttactagctgggggacatggaggggtctcctcagcagacctgtgacggaatcctggaaggcatcccaggtgtggcagccggtcctcctggcatccctcgaggcagagcacatgacttcccaccactttttccaaacacaccctgc

SEQ ID NO: 470641 - DNA, 778 bp, Homo sapiens
ttgctgagttgttactgcgtggatgaatggtaaatgctacgcaggtggccaagaagtccagggaacgtcactcctggatacagagcagagcgtaagggcagagataagacccgatatcaaacgggcaggtgactggcacaggaaattcacatcactaaggaggatccagcactaagggtggtaacagcaatcactgattaatggcatcactcggggctttccctgcagtggtgcccttgcacccgggagaactcgcttaccggacaatgctaggaggtaaattttattatcctattttacaaatgaagaggctggggctcagagaagtcaaagaactagtccagggtaacacagcagaaccgggaaatgttatttgcatgcatatacctgaaaagcgttcctatccatactactcaactaacctaccaaatgtgaaaaagatggcaaacaactccatgggaaacaaattcgactgtgattatgacggagtcatgttgcagctgtgtaaatttggtttctggtggtttgtctggaagatggtcccaggaaacgccagcaaaggcataggagcgtgtggtgcccactttgaacgtgtggcctttgtgcctgcctattcagggcggcctcaggacaatggggggcaggcatacaggggaggacaatgacagggacatcgctgccgctttgcattccctttgaagtggctctgccctgggcccccgctggctccaaaaagaatgcttttgttgcccgctccaaagatgctgtaagatgctgc

SEQ ID NO: 470642 - DNA, 454 bp, Homo sapiens
tttctgcctgctgccattcatgacctcccaatctgctgaaatgatcgttgaaacagcagtcgttggcttttccatctccactgccacccttgcctgtgtttccagagaacagaaattagaccttttcatctgtgtcctctcggagcctgacataatgtctggcacagcccagatgtccctgatcgtgagaaagcctcccctggcaaggctggtgcaggatgccagtgacggggcctctggccagttctggtgtgggttgtctggtgaggagcttgactggatgctcgggcgggcaaatttcagcctggactcggaagacctgcccttgcccaaagcacctgaggagagtgggatcagtgtcagccacagcaggttccagagagacacaggtgaggaagactgttgtgagatgtatggaccctggacagagtttgttttgtgacctgctacataa

SEQ ID NO: 470643 - DNA, 587 bp, Homo sapiens
cacccttcctgagaagcaggggcagcctggctgcggctatggagtggcggctgcttcaccgcttctttctgcctgcagctctattgaagcccaagttcaacggcgtggagaagatcaagaccatcggcagcacgtacatggcagctgcagggttcagcgtcgcttcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgcggcctgatcaacgtcaaaggcaaaggcgagctgaggacttactttgtctgtacggacactgccaagtttcaggggctggggctgaactgagggctcctgctggattcc

SEQ ID NO: 470644 - DNA, 728 bp, Homo sapiens
aagacctggggtggaggccagggcctgggagccagctgtctgcctccccagctgtgggagatgagagtttctataatgctggcaatggggctctcagaccctcatgttttgcttcacattgtgattgatggccctgaggaagggtgcagctggtgcaaactcactggagtccagaaaggcgatctgggaggggaaaaacagcatcctacagaccccagatatggatctggtatcagtcatctacatcttaggggcagtttcttagacacttgggggtctggaggggacacagaagctcttactactgatattgcaaaccactctcccatccccaagcatccagttttgacatggaaacctcttgaggccaggttgttttgcaagaaagcaggagctgctcaaatacaagttggtgtaatcacagggaaagccgagctttggccggcacgatctgaagtttctgctgcctgggccgtcagctcagagccggtgctgtttgtcagcaccaagctcaaccactgagtgggactttctggagcatcccaagagaaaagattctaaatttatatgtctactgttttaatgttttagtactggcactgaatttaaaaaagcattcttaataaaataaaatgtctgctggcaatgatgagttatggtgatgacaatggtgattaatgatagctaacattagtgagcgctcatcatgtatcagggtcagttttgga

SEQ ID NO: 470645 - DNA, 862 bp, Homo sapiens
agatagaggtggtgatgacacaatgacacagcactgtgggtgggctcctttatttgggtcccaaccaatgcatcgtgagtggaagggacctgggccactcattgcttttcatgcagagaacgtggaggctgtgaagcaggattccgagcaggacctcagcgaggccactgtcacaggacggaagcatcagggagcccgagtcattccttggagggcagccgtccaggagaggcacctgagggcatcagtctgtgacggaacacagtgtcagcagcagagcccagatgcaaatccagaacattggacttcttcagtattccacttcttccacgtttccaagtttctagcagcttctcacctcatgatctttcctttagatctgtggatatccttggattgtatcatttgtcctttgtccacctgaatctgaaaccagtgattttcttgttcctttctccaatggtatatttgttgaatcgtgacctttcacttttgtttgactattaaccacttccattgctgtctcggtcttcccctcacttttaactaacttctcttgatgtaggaaatagttaagttgatgctgagccttttcagcttgctgtaaagcctgtttcaattgctcctgaaggactttttaagtgctgtgagatgagtttttaaaatttaaacacatctatggactgattcggttcccaacccaccaggcacaccctctgctgtacagtattagaatatctgaggtagggacgtcactgagcctctaaactgtaagccatccccacacggcccgctctgccatgaccaggaaaaggagaagtctcctggcagaaatgacagctgacatcgattgtttgaaatc

SEQ ID NO: 470646 - DNA, 1547 bp, Homo sapiens
ctttcccagaacccaaagggcttccacactttagggatgtgttgtttttgaacctgagcccatcatggccctggacattgatcaaagagagtggcttgtttttcctaaaagtgtgcggatgggtccgatcagcagaatttcaggtgcagtgactcagcttttcctctgcggctaccacctacccgacatggcccccatggggtacgaggaatggcctggcggtaaccagggagatataacccaagaggtggcgtttgctctggaccctgaagaggtcaagtgcaaggacttcagagaggacttaagaatctgcactttttcccggcatgctgagagttgtggggctggaggcagcaccgtcataattgagattggcagtgagggccaactactcttcccaaagcaggagtgggcctgctgcagctggagggtctgtcctgctccctgggctgctggcctccctcacaaggctgtggactggcctcacttcaatgacatggattgtctcgtgcatgagtgcacatcggatttccaagtctgctattgattttcaaactgcagacaaaaatgcattcattccccgggcctcgccatagtcttccattatccacttagcgtcacgttacaaaaatagctttaaacagttttgcttgaaatattggacacatacactcactgacagcgaggttttgtttggttgtatgactcagcttcagggcataacttttcacacgaagagcgtacacacccgtcactttgacacaagcggagatgtcggtatttatttttgcctcgagaaaatgatgggggaacagggaggataaaaagaatttccagaaaggcccatgccaaactctccccacatctgtgcaggccgtggacctccttcctgggcccttgaattcctttggtttgagggaagagtcatcctctagtccggaagagcctctgaggctgcccgacaaaaacgaggtctggctggaaaccctgacttctctggctcctggttgcccattggcatcatttggggagctcttaaaaatgccagtgcctgagtcccacccaagacccattacattgtcctctcctgggtggagcccagcactcctatttttaaagctccccgggtgattttgaccagcagccaaggttgggtagcactgccctggaaccacccacggagtgacatggtacttctgctctttggagagagattgagatcaacacgatggctgggaaacagtgcttctgggaagaagctttacctggggtggtcactttcgggaaccaccatgggttcccatctaccagggtgctaccaccctgaagggacaggcactgtctcccacccagtgaccccatcttactggtcttgatgcctggtctctcattctccccgacaatgttccttttgcaatgcagccctgcccatggcaccaccttagtaacttctctgtggtcttaagacaaaaggcaaagttcctgctgccatgactttcaagactgtgtcctggcccctgtccaagtccgccatgtaagcaggtgcc

SEQ ID NO: 470647 - DNA, 3443 bp, Homo sapiens
gaggaagtgggcaccagcggacagggaagggcagagaaggccaccatggcgacactcctctcccatccgcagcaggccctcccttcttgcgccaggccatcaagataaggcgccgcagagtcagagatctacaggatcccccgccccaaatggccccggagatccagcctccatcccaccacttctcccccgagcagcgggccctgctctacgaggacgcactctacactgtcttgcaccgcctgggtcatcctgagcccaaccatgtgacggaggcctctgagctgctgcgatacctgcaggaggccttccacgtggagcccgaggagcaccagcagacactgcagcgggtcagggagcttgagaagccaatattttgtctgaaggcaacagtgaaacaggccaagggcattctgggcaaagatgtcagtgggttcagcgacccctactgcctgctgggcattgagcagggggtaggtgtgccagggggcagccccgggtcccggcatcggcagaaggctgtggtgaggcacaccatccccgaggaggagacccaccgcacgcaggtcatcacccagacactcaaccccgtctgggacgagaccttcatcctggagtttgaggacatcaccaatgcgagctttcatctggacatgtgggacctggacactgtggagtctgtccgacagaagcttggggagctcacggatctgcatgggcttcgcaggatctttaaagaggcccggaaggacaaaggccaggacgactttctggggaacgtggttctgaggctgcaggacctgcgctgccgagaggaccagtggtaccccctggaaccccgcactgagacctacccagaccgaggccagtgccacctccagttccaactcatccataagcgggtagaggcctcattgcagagagccacttcggccagccgctcgcagccgagctacaccgtgcacctccacctcctgcagcagcttgtgtcccacgaggtcacccagcacgaggcgggaagcacctcctgggacgggtcgctgagtccccaggctgccaccgtcctctttctgcacgccacacagaaggacctatccgacttccaccagtccatggcgcagtggctggcctacagccgcctctaccagagcctggagttccccagcagctgcctcctgcaccccatcaccagcatcgagtaccagtggatccagggtcggctcaaggcagaacagcaggaggagctggccgcctcattcagctccctgctgacctacggcctctccctcatccggaggttccgctctgtcttccccctctctgtctcggactccccagcccggctgcagtctcttctcagggtcctggtacagatgtgcaagatgaaggcctttggagaactgtgccccaacaccgccccattgccccagctggtgactgaggccctgcagactggcaccactgaatggttccacctgaagcagcagcaccatcaacccatggtgcagggcatcccggaggcaggcaaggccttgctgggcctggtacaggatgtcattggcgacctgcaccagtgccagcgcacatgggacaagatcttccacaataccctcaagatccacctcttctccatggctttccgggagctgcagtggctggtggccaagcgggtgcaggaccacacgacggttgtgggtgatgtagtgtccccagagatgggcgagagtctgttccagctctacatcagcctcaaggagctctgccagctgcgcatgagctcctcagagagggatggagtcctggccctggataatttccaccgctggttccagccggccatcccctcctggctgcagaagacgtacaacgaggccctggcgcgggtgcagcgcgctgtgcagatggatgagctggtgcccctgggtgaactgaccaagcacagcacatcagcggtggatctatccacctgctttgcccagatcagccacactgcccggcagctggactggccagacccagaggaggccttcatgattaccgtcaagtttgtggaggacacctgtcgcctggccctggtgtactgcagccttataaaggcccgggcccgcgagctctcttcaggccagaaggaccaaggccaggcagccaacatgctgtgtgtggtggtgaatgacatggagcagctgcggctggtgatcggcaagttgcccgcccagctggcatgggaggccctggagcagcgggtaggggccgtgctggagcaggggcagctgcagaacacgctgcatgcccagctgcagagcgcgctggccgggctgggccatgagatccgcactggcgtccgcaccctggccgagcagttggaggtgggcatcgccaagcacatccagaaactggtgggcgtcagggagtctgtcctgcctgaggatgccattctgcccctgatgaagttcctggaggtggagctttgctacatgaacaccaacttggtgcaggagaacttcagcagcctcctgaccctgctctggacccacacactcacagtgctggtggaggcggccgcctcccagcgcagctcatccctggcttccaacaggctgaagattgccctgcagaacctggagatctgcttccacgctgagggctgtggcctgccacccaaggccctgcacactgccaccttccaggctctgcagagggacctggagctgcaggcggcctccagccgggaactcatccggaagtacttctgcagccgaatccagcagcaggcagaaaccacctctgaggagctgggggctgtgacagtcaaggcctcctaccgcgcctctgagcagaagctgcgtgtggagctgctcagcgcctccagcctgctgcccctggactccaatggctccagcgacccctttgtccagctgaccttggagcccaggcatgagttccctgagctggccgcccgggagacccagaagcacaagaaggaccttcacccattgtttgatgagacctttgaattcctggtgcctgctgagccgtgccgcaaggctggggcatgcctcctgctcaccgtgctggactacgacacgctgggggccgacgacctggaaggcgaggccttcctgccgctgcgtgaggtgcccgggctgagtggctctgaggagcctggtgaggtgcctcagacccgcctgcccctcacgtaccccgcacccaacggggacccaatcctgcagctgctggagggccggaagggtgaccgagaagcccaggtctttgtgaggctgcggcggcaccgggccaagcaggcctcccagcatgccttgcggccggcaccgtagccgtagagacacccggtgctgggggtgcggctgctcccctccgcccactctgccctcccgcccctgctgcatctctctctgtacagaacaatttttaaaatggaagct

SEQ ID NO: 470648 - DNA, 789 bp, Homo sapiens
gggaacttgtagaaccttctctttgttgctgatcttcacaatgatatgctttgataggaatctgttttcatccattattctggcttcctgcacggacagaggggatggtggtcgtttggctgagggctcctggtgtggaactgactgccgggggcggtctgcaggggaagatcccaggcaagcagaaggctgtaaagacatcccctactgtgctcctttcaggcactttgaagcttggccccatgactactgggccataacacccactgagaaggtctgcggcttcactcctgaagtcagcaagaccacgaacccagcagcaggcagcaattctggacacatccaaacatctggaagaacaaactctggacacaccatttttaagaactgtgatactcatggggaggctgtgtgtcgagccttacacaagcacacatgtggctgcgtggctgtgggccagtgttattctgcagctcatgctgtttctcatgactctgagcatcatgatctatccctggagctgtgagcaccccgaattcactgcttctcactggcctatggaaccccaaaaggggcacccatcacattctcatttacgtggtgatgggaatctagaatgggagaacatgtctgtaaattatgtcttataagggtcagatatccagaatatataaagaactcttacaactcaacaaaacgataaacaacccaattcaaaaagggtcaaaggacttgaatatacatttcttcagtaatacgtacaagtgactaacaagtacatgaaaagat

SEQ ID NO: 470649 - DNA, 731 bp, Homo sapiens
cacatggttctggaggctgggaagtccaagatgaaggcaccagcagatttggtttctggtgccatgggcagacaggagcagagagaaatggaaaactctggagagaagtttgtccaacatgcccggggcatctccccaggtgttttctagagcacctctagaaaaggaggaaaaggactatgcaccacctagacccaccagtgtaagattctacaactgcaaacctgttctccagtcccctctaaagcgattcttggtagaggacgtcctgcggaaagaccacccagctccatctctcaagtcctcaggctggctgtggagggtcccctctgaagagccttgtgctggaacaacagtgatgcctccagccagccagaaatccccaaccagtgcctatcggcttgttagccgcacctctttgctgcaccaccaaatcgctggcaaacgcccccaacaagggctgctgtgcttggggttccaaaccaaatacgcgtggtgctgccctcaagatgctcacagcatgggaataaagactcaaaatgccataggagctacgctacagaacagatggacaggcattgaggccactgccacaatcattgggtgacttaatgcttaatctccacattttagtaaacacagaaaatattcatcagaccgtagaatgctcatgcactgtgagtgggccaaaaggaggcacgagctatgattcctacccctgaggagttcac

SEQ ID NO: 470650 - DNA, 724 bp, Homo sapiens
ttgtttgcagtcgttatgttccgtaaagtaaccaagaacactggattggaaaacactgaacaaattactcctgggggaatcacagtacaattagtttcttgcaagcctctgactagtgatggtctcctctctttctccccccatttctgcatacaagaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggtgatttccatacgatttctttatgcaagaaaaagttcatttaaaaaaattaatcactcaaaataattgttgtaaatccaggaaaaaaatgttagaaaaacaactacttgaaataagcagaaagtaaccaaatgttggcagaaactgcccatgtgtttacagcaaagacaatatcccagatatagagataggattgaaaattaagcaaaatt

SEQ ID NO: 470651 - DNA, 1682 bp, Homo sapiens
acaggggatgaatgctggagagtcctattctgccatcgtgctctgcccctttcttaatgactggcagttaaataaggcaagaaatgggagaataaatgtagtagacattggatcaactgaacatctacctgacttttcaagaaagggagatttgttgacctatgaagatgagagaaacggccaggaaggtgggacatatagaggaagattagtttcagcacaaaatcggtacagatgtgggagtctaacaggtcatataagctgtaatgtcatggataatcagattaaggccttcaacaatgagttcattcatcttccctgggtacctgcagtctactactacgtgacaggtagggtgatgtgcattcaaaacacaatggtgaaaattccaaggacaggagagaagaaactactattaccacctacttgagaggctagaaagaaaaatatgtgacagattttcttctctttttttccatatgcaacatgccagttttatatgatttctgtagattattgcattgttgttaaaactttttcttataaaccattgcaaaattatcacacgatacaaaaatgttaattcaaaagaaacgaaaagcactaatattacccagtccataaacttcctagttgatctctttttattcatttaaacaaagtcaagtgttttttttcttccttattattagttatatggttaataagtcagtcacacagttctgaaaaggtccatagaaaaacattccttcatgttgaaggtgatgcactaattatatgtacttcttgccctccatctgaagcagctacgtggatacagattttagacccttaggcttcaattaaaatattcagtattcaataatatttattgaaacaattttaaggtaagaaagtcccttttaatgtctttctgtaaatgggagataaaatgtatcagctcagttattaattggtaaaccacaaggtagttaactctatgagattcaattttttttttgcacaagaatagcctaatagtttgttccgagggctgtattaggcaaagagttctcagatatgacactaaaaacacaatccatagaagaaaaatgactaaatctgacttcagactttaaggagtaagacaagtaacagataggaataaactatttgtaaattgtttatctgataaatgatttgtatcaagaatatctaaagaactgtcataactcaacaatcaaaaaaccaaaatattccatttaaaaattgggggagaaaggaaatggagagtgactgttaataggtacatggttttctggggagatgataacatgttctgaaaatagattatgacgatggttgcactagtatgtaaatgagttgcatacttaatggatgaactttatcatgtaaataacatttcaataaactgttagaaatgggcaaaatatttgaatagacatttcataaaaaagatacgtgaatgacaaataaatatgaaaagatattaaacaaattagtcattagaaaattgcaaattaaaactgcaatgaaataacactttatattcattataacaagcattgacaagcatgtggagaaaatggaattttgaaacattacttttgaaaatgtaaaatggtgcaactatttagtaaaatagtttaacattttttaaaaagttaaataagaggttgagc

SEQ ID NO: 470652 - DNA, 2166 bp, Homo sapiens
aggaaaaaaatctttgataggtggcatgaccttagacttccaccaacaagcctcagctggcccgtcagcctctggcgcgctcgaacttccggcccttggagtggacgtagggtttggtgtggctgtgcggggttcccggggccttgccaaaatgcccgtacacctttcggcccttgagaggaccggagagcaggacggtgctgcagcccttgcgggagtccacggccagctggtcgaaaacttcactcttctggatcatctgggaaagggacagaggtggccggttggtacgactcataaacaacctcttcagcacaacctggttgaatgtggagtcggttcgtctggccagaaaactgcacagcttgaccaacagcctcaggtagatatcctggctcttgggctccttgcgccgaacctttcggtccttgttgtggcagatgtcagctcccatgatggcgtctcctgctcggccagataatagcttcactaatgcattgctacatgtggagaatctattaacttttaagataaaaagttcatttgctaaattctccccatatgttcaaactcataaagtacttgttctgattgatatgatacaaacaaaaaatcatattactcaatgtagcataattttaggaatacttttgtggtcctgcattagcaccgatttttgaacatgctttattaaattctaaaatcttgcacactacatgtcattgtggtagttacagtatatatcaagatttttaggttaaaatcttaaagtaaggcatatttgttcctaaacgcagtaagaggaataagagcactattaatattactattgtgattaaaattgtttatgttaatattttcataagacttatctcattcaattctcataataattctatgaggtagggcccactgttattttgctttgctgaaatattcgtaagtctgctgaaatatatactacaaaataggactgaaaagaaaaacactcaaatttaaaacttattaaattgttaactatttaattaagttctactcatcacaacggattccaaatagacattagataaacctaaaggcttctagtgaagtaaaatattattaaacaattttcatatttcaattttataaaatacgcatgtaatctaacatagtactatataactttttttaataggatttttattttaaaaggttttaacatgattttttttggtctatttcagtaattatttggaaagggcatctcaacaaagtaccaaacagtttttcacatatggtggccttgctcttactgggaaagcttgcaaaacaatggtgtgtgtgcatttgtgtgtaaatttttttttaaataatcatatatataactttcttgaagctacccaatccagaattttttttaaaaaaaacatgaactgctgtctccaggtaacaaatataatttgaaaagaagctttaagattaggattcagtgactaatttctgcaataaaaatgaaatccatccattttttctcctgcattttaatatctgataaaaatttttcattttaaatactaactattcaagtcttttcaagcttctaaaagactggaaagttaattttccaaatgtgctgatgagcaattgcaaagattagtttacataatctatgttcctgctggcagaagcattactttctatttaatacaatgaaactggtatttttaaggcattttttcctttataaaatctgaacttaacacataccctgtgtgaatataaaataaaaacaattgtttgtttctgcaaatttcatctgaagtagaagttttaactgccaactctgaatccaggttcaatagtgaaacatggatacatgctcacaaatattaagatttctggcatttaaaacttccaaagaaacaataatttcatagtcttttagggagctgagtagaaggagtaatataggaactttttggatttggtaatgtttaatctataactaaatgtggaactatatcatgtcttctccaaaataacatattatatcttatttcttaataggaataagaaaacatttttgattttgaaaatgatatctaggaatagataaagtggatacagaagtgttcaggtattttaaaactactattttttcacaatgtaaaaagttgcagaatt

SEQ ID NO: 470653 - DNA, 711 bp, Homo sapiens
agcacctgctctctctttgccttctgccatgattaagcaatttgagaaagagaaagtgaatggcacatattctactgtattcctcacaggggagatagctctaccacaatttgctatgcttctacaaagtgtaatctcagtggaatttagcagctaccccacggagccaatccccctaatgcttcagcttctgctgggttcagctaatgcggatagaaagaggggagacactactcctttcttggactttttggtaagatccacatgggacattgccaggaatgatggaggctggagcaactgtgaaattgctgggagggcagtattctgggtatctgctcaggcagctcagctccaactgtggatccccaggagcactgtgctgtgtgctccagataatctttgccctcccatgaatcatgactggttcctggaaaaatggctgaaaatcttgaggttcaaatatgggtgatctaatctccccttttcagtatttttgaattttaagcatattgttatctctgtttaaggggttaagtgttttgtcttatgctaaatgtatttaaaaccttttggtgaaatcaatgatttattttctcattcctgaaatcttactccaattttatgtatgcattctttttatgtgttaagttaaaccttgatttagtgtcacacttatttttctataccaaagaagacacctaaatcaag

SEQ ID NO: 470654 - DNA, 1296 bp, Homo sapiens
tcgaagctgggaattccttcagggtggtgaggtacgatgataaatgtgtcgcaatccctgctattcagggacccacaagcaaatggagaagacaaaaagggggccggtgttcttacaggcaatgtgctcagaggctgtgctcttacagctcaccctggcttaaagctcagctttgccacttcctggtcctgtagaaaaacagcacagtgtgggatcttgggtgatcctagccaaccagctttcccagggatgaattttccacttcagttcagtttgggccaaagttatctgaatgtgaaagatgtgcttagggtacgagcttggagaaaagactgcctgaacaaagaaaagtcacgaagtcattctgttgctgccatgtggagattgccatgtgacaagaaccccttatcagccccagagggcattccaattactgctgtgctgaaagatgtgcctcacattggtttgccctcatgtcattcctctgcttggaaggctccaatccttcactgtggccttccagtgtcccaccctggaacccaagtgaaatcgaaagtaaagaaaaatggctccatgaaagatgctgaaaaaggctggtcagggaagtttagaaaaaaacccaagaagttgccatgtcctatcgagtcacagaaggaggagcttgcccgaagtgacagaattttggtcatgacttctgatctagatgtttttgctgatgagttttctctcagttcatttattgacgtagaaggatattctacagatgcactggaagcactgctttattatgactcagtggatcaatatacactgggaaccatgaactgtgataggtggcctgacaatccgatgaaaggcctcattggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggattgaacacaaaattcctcaacatctataataaaaaggttctcttcagtttattgtacatgattgaaaaagtaaacataagttggggaagttactgatatatttttactatactattattatatatttagtttatacatactaacgataaatgatccaaaaaggaaatttaaaacatagtctcatttagaatagtatcaaaaagaataacatacttaggaataaactttaccatggg

SEQ ID NO: 470655 - DNA, 677 bp, Homo sapiens
acagacttttaaaaccactaatttcagaaagcatcttttccatgaggggcctttttcttagagggaccctcggtttactttctgtgactcggagcagtgtggagacacatgctgacagcctgcaacacgttttcaggttgcgatccccatgtaaatttactgcactgtgcagtgaaactgaggggggcaaaaatcacactttcaaattgctgctctttgcaaaggagtcctctcagtctattgaaaagcacaccgtggagctggggccactcagctgcccaggtctgagggatcccagctgttctccctccaagcagcgtctggagactcatcagaccttcgaagccccctggcatcccattctttcccccgagtctaagggcaacaaaggctatggtcatgaaatagcacatgacctgtgctacaaaccatccctgcagatctgtggccacataatagacccagttctcaaatcaggctgatagggaccattgggtttcaacttggacggatggctttttaaaaggctttgtgtgtcaaagcttctctaatatttgtcaaatgggagataagtgttatttattgggggagtcttgtagttttctcattttatatttccatgtctgtttttttcaaatttaaatattatcctgttaatatgagaaatgaatagagct

SEQ ID NO: 470656 - DNA, 509 bp, Homo sapiens
cttccacatgtaccaggagcatgtgcagaggcttctggtgatcaaggaaaagagctgggtcaggaggagaggaacgggcggctcccgcgtaaatccccgcgtaggcaggagctctgggccagagcggcctggagacgctgagcggcaccccaggaatgcacagaagccccggaacctggccacagaggagggacagatacagataaatggaggagtttccctgcacaagctgcctctctcatcggccgccacgtcagacatgcgcgactgtgagacctgcccggacacatggaactggctgtacacacagcgtgggtgcctctcccaggctgctaagcagagaagggagcagctgctgggtgggggccctggcccggagcacgagggcagccgaaattcttctgtgctgtgagaaactaggaaagcagctgcccttggggaagggggtgaccagaggggcctgagggggcttctgggggctgcgatcttctgttcttcctcagggtgcc

SEQ ID NO: 470657 - DNA, 1989 bp, Homo sapiens
aagctcatgtgagttcacgctggtgcaggtggagcggggacagtgctaagctcatgtgagttcacgctggtgcaggtgggccggggacagtgctaagctaacgtgagttcacgctggtgcaggtggggcggggacagtgctaagctaacgtgagttcacgctggtgcaggtggggcggggacagtgctaagctcatgtgagttcacgctggtgcaggtgggccggggacagtgctaagctcatgtgagttcacgctggtgcaggtggggcggggacagtgctaagctaacgtgagttcacgctggtgcaggtggggcggggacagtgctaagctaacgtgagttcacgctggtgcaggtgggccggggacagtgctaagctcatgtgagttcacgctggtgcaggtggggcggggacagtgctaagctcatgtgagttcacgctggtgcaggtgggccggggacagtgctaagctaacgtgagttcacgctggtgcaggtgggccggggacagtgctaagttcatgtgagttcacgctggtgcaggtggggcggggacagtgctaagcgaatgtgagttcacgctggtgcaggtgggccagggacagtgctaagctcatgtgagttcacgctggtgcaggtggggcggggacagtgctaagctcatgtgagttcacgctggtgcaggtgggccggggacagtgctaagctcatgtgagttcacgctggtgcaggtgggccggggacagtgctaagctcatgtgagttcacgctggtgcaggtggggcggggacagtgctaagctcatgtgagttcacgctggtgcaggtgggccggggacagtgctaagctaacgtgagttcacgctggtgcaggtggggcggggacagtgctgagctaacgtgagttcacgctggtgcaggtgggccggggacagtgctaagctcatgtgagttcacgctggtgcaggtggggcggggacagtgctaagctcatgacatttagcctgggcttggggcatcggggattaggtgtctagaccaggggtcggaaggtttgagggtcccgtgtttgaagccctcctcctcctccttcctccctcctccctccttccatctcccttctccaccttcatcctccttcttccctcctcccttctcctctctcctccaccctccctcctctattctctctccccaacccccacttccctccaccctccacctgcctcctccctccttcttctgtccctcctccctcctcccccctcctcttctgtcctctccccttctctctcctccactctccaacctcctgttctcttccctactccctcctcccttctccaccctcctcttctgccctcttccctcctccctccatcccttctcactcctccattctccaccctcctttattctcttctctctgccctcctcccacttcccctctgtccccagcctcctctcttcagccccactaggttcctctcggcttccctcagcatgttcacagtagggtttgcgctcctgcgagggtctaatgcagccgctgctctgacaggaggggcagctcaggccgtgacgctcgcccggccgccgctcactcctgctgtgtggcctggtccatggcgcggcaccagcccgcttccccgggaattgggaccctgtggtggcaggtcctcaccgcagacggtcccctccacagtggtggcaggtcctcaccgcagacggtccccctccacagtggtggcaggtcctcaccgcagacggtcccctccacagtggtggcaggtcctcaccgcagacggtccccctccacagtggtggcaggtcctcaccgcagacggtcccctccacagtggtggcaggtcctcaccgcagacgtcccctcaacagtggtggcaggtcttcactgcagacggtccccctccacagtggtaacaggtcctcatcgcagccagcagtgcatgggagctcttgttctgcct

SEQ ID NO: 470658 - DNA, 796 bp, Homo sapiens
ctgctcagaaggttccctctgtcttctcccatgcggacagtctacactggctgcgacgagtacaagctctcaggccaggtggaaatggaattgagaaacctaggcgctgcccatcagaccacaggcaccgaacagcagatctgttcactgggatggcaacacgtttatcagctcagacgtgttccggtcccctgcagtacatggcagcaccagagcacacatggccatgttcctacatggtggtgccagcacgggatgccacccagggctcatctcgtcctcctcctcctcctcctcctcacaccaggaccagcctggctcactagtgggcatgggccgggcacaccatccccccaggtcagcctggatcaccagcgggcacgggccgggcacaccatccccccaaccagcgtgctgcctcatgccaggaccagcctggctcaccagcaggcacgggccaggcacaccatccctcccgaccagtgtgctgcctccacatctaggcgccttggctgacggctaataccgttccggttacaatgaaggaaatctcgccacttttctcctgtgcagaagaaaatgcacacagtccccatggctataacccaccagcaggcacgggggacctctggtgtctcatgttggtgcccagtgcctcagcctggcctccccacgcgacctgcaggggcggcttcacggcaggccagctgtggtgccctgcgcagtggttactgcaggaggtgatctcttcactgtagctggacaagggtggccctctaccgacttctggtgttct

SEQ ID NO: 470659 - DNA, 662 bp, Homo sapiens
gatgggtggatgggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggccagagacagccttgaggtggagtcaccggtgacggagggtggggcgctgatggccctgctgcagggagaggttgtgtgaccttgtaatgctggatcctagcaaagcaccggcctagacagagtggggagggataaaaagctcccttgctagctctcaacgcagtgttgtcccctgtcctgggctggtggcttaagttctggcaaggccttgtagagcaaaagcaact

SEQ ID NO: 470660 - DNA, 1377 bp, Homo sapiens
ggaccctgggggtggcgagaatgctgctgcgggtggaggattatataacagattatataactgcctggccttgggcaggtcacgaaacctcagtgtccatctacctccccatctgtgaagcagagatcatgacagcatctgtggtgaattctggaaactctatgaagggagagtttccaagagcacagcgttcccagccagtggaccctcagaaaatagaagttgaccgagagtctaagatgggcttgagcaaggcagtttatcagggctttcagctggagcagcaagggggacagtacaggaagagacctgcagctggctccccaaagctgaaacatctccatggtgaggaaatggctgtggccattcgggtggtggagcgggagccctacaggcccaggtttgtgtgtcagggcaaggagatgggagtgttccttgcagaccagagagagaatcacaaggggctacccaaggaccctaccagtggggccgtctggaaggggatggggcagtgcccagaaggatgctcgggggggcttctgctggacgtcacatgggactactcaggatttgaggagcatcccccagggtcacagggacccagagcccagcagggaaccttccaggagcccttggaagccaagaggggaagctgtccaggcgagcaaacagagggagtgcagagcttcctgcacctgcttcttcttaactgcccgcagctcaacagcctgatgccaaaaggtgcacattttggggcggcacatttctgatcttccacaagctgaatattctgaagaccaaattaagactgtgtttgcaacccagcgtggccacgagctattacctaagagaaggagctggggccatgcatttgctaatgtttgcatccagggccccaagcacagagaaaaattgaaaatcaaatttaccaagaagggataaaagagaaagctgacttgcattataatgatttctttttttttttttttttgccacagctaaaatttcccttttaaatagcgagcacccctggggcagtggaaatggaattcaacttacaaaatcaggggccttgggccaggggagggggcagtaaagggctctgcctgctgggagccgagcaggatggaaggtctagtccagtgaccaggggagacaccatgaccaggagcgtccttgcacccaggccctgcttgggccccacactggagagggccctgtctgactaggcctcaccttgaggctcctggcaaccaccattctactgtctgtctctaattttaactattctaagaatctcatataagtggaattatatagtatttgtccttttgtgaccagcttaatttatttaacataatgtctccaaggttctcc

SEQ ID NO: 470661 - DNA, 595 bp, Homo sapiens
tatttcatgagtttacataagaatgaaaggatataattgtataatcagcttaactggagtaaacaggtttgtaaacaacgcaagtggcttcaggcaggcattgggctcacctggttggagcagaagccgggtgccccaggaggggagcctccaggtttcttttgtgtgggtgatccccgtcagtaccacttggagtgggagagggacttttctcaaaggaagcaggggtgaaggcgtcctggacaggcgaaaactacaggcgtctactacatggccctacctctgccccctggtggtggctcttggtggcgctgctgaccacagacgagagaggatgaatcccccggagctgggagggctgcaggaaacagagatacacatctccttcctggccagatgcttgctacatcacagaccctgccagcaggtcctggcactgctgccagagagaatgtgtttctatttggtttccatgtcctctgcatggacttcggtgtctaaatgttagtgtgaaattttaaggtcccagatgtcccattctgtcttaaaagcagaagtttcccccagaatggtcaaataaatgacagtacattcc

SEQ ID NO: 470662 - DNA, 730 bp, Homo sapiens
caacatcctgacttggcagctgcctaatccgggtgaggtggcagctccatcggttaatcctgccgggggcgggaatgtgtcctgccacgatgcttctgcccacctgtcggtgcctatgcaggtgtgaccaggctgctgacactgcgtcctgaggtcagctcgaggcggccaagtggaacggcagcttcagactcaggctcctaatgggggcttgtctgagcaactcacagtgtcttgctatggactcttgggaatcctgtgcttcggtcccaagggcacctggtatgtgtagcctttacgcggcacccatcaaggcttccattcaccaaatgagaggcgacaacagacagcctggtgaattcatgtctagcaaggacaccagtggccctcttattaccgaagcccaggagctatcttatttctcgttctgttacccatcttttggctctattgaccccataccacttgacactgttggggagcagggcatcacttctctctcctggttctccttccacctctctgcttatcagcatccttccctggttcttgttcacatcctgactcttaatagaatattagactgtaaaccaatacgtgctttcactgtttgcctcaacaaattcctgaaaaagcatttattgtaacaaaagattgcttatctttacatataacccccttctctggataacagtataaccacccaaggggttcaccttccctgctgcct

SEQ ID NO: 470663 - DNA, 1519 bp, Homo sapiens
gctggcctcctgcctgcatccccctggggaagagccggttctgctccctgaccgggaacgggtccctcagtgctgaggatggcagttaatgagcccgccgaggggctgcccaccgggtgcacaggcaggagcagtgggcatatcccctgcttgccaggccctgcagaggggctgccttctcccccaatgccttctgcccccttctaggactggtttcgtggaaggcaatttttccacggacccgggtggggtggggggtggtttcgaggtgatgcaagcacgttacattgatctggcttgccgtggcagccctcgacaacaaatacagggtctgttgaaccaaatgaatccaaaatgtatgcccaaagatagccgccaggtctatgaaaacacctgctctgatatgaggggacgtggaccacagaggagcttggaggggacccaggtgctggtagtgaccttggcacattcacagggtgacggcagagacaatggtggtgacgatagttgggatagtaactcagactcacagctgcaaggttttgtgatgatgccaacaaccaggactgcccttgccttccttcagattgccagagcagtcaggaatcttctgcccttagagtatatcgcggggtcctccctccacatccttgctgatagagctctggagagggcctttggggagcgtgtgactatccccggcatatctccggtatgtcattatcagcagtgtgaaaatggactcactcccaccctgtctggatctggacaagagcccaccaccccgttggcagtagtcaggcagctctgcttctaagaacctgcagcttttggaagaaaggcaccctgtggtttcagaagcccaagagtccctgcagctcagcacccccagcctggtgcttggcagatgactgcctcctcacttagcagagggagcagaaaactgtgtattcttcagaacatcatgataacctggcactcatgggtctatggagagaattcagggggtctgggagcttggatggaataaatttgcatctttattttcaggaaagttttactgaagtttagcattttctttcattataaatggaatcagtataacccaatagtatgagcagttacttctccgcaacatcaaagtggctgcagatatctcaaaatagtatttacatttatcataacttagaaatttgggtggtaattaaaccagcaactattctttgtttaatgcattaagaaagaagtatgtatactatcatatctcaattaaaaatattttaagaactggattttaactttattggtttcctttgtaactctctgtatttcattttaggcatttaaaaatattattttgagaagggcttccgcagatgtcagaggtgtccatggcagagccatgattaagatccgctggtgtagactacagcagtttcctggatcctcttcaataaagagcccccctccacggttctgccccttaccaatgttgtttctagctccatcccatccttct

SEQ ID NO: 470664 - DNA, 2979 bp, Homo sapiens
gagggggactcctctccatggtgggattttcagctcagctcagcgtccctcacgcaccaggcaatgcaggttcacacctgggctgcctgcagtgacaggttccagtaacccatgctcctatcagatcgccagacagaactggggccaagagcacgaagaggatggggagtgggcgggagcgctgttgctgggaaatgtctgggacacttgccctgcctcacagagagtgtccggccacctctgatgcgggacaggagcgctcaggggaggaaggcgaggaccttagggcctgtgcaccctcctctccaggcataatcttgtctacatggaagatcatccctgagcaatgagctgcctgctgagggggtgtggtgagttgcacagagttgaggcaccaaggtcgggggcagagccggaccagccaccccagccctcttcaaaacacagcaggtctgggcttctcgcatagatcggctgccttgttagaataacctgaatataaaccaaggtcttgtggggcccagtctccagacactcaaagaggctggatctggcagccccaagaggattaaaggggattcatgtcccagcatccttcctctcctccctggctctcttagatgttgtagcatctaactcaccaatggcaaggatcaggctgtgagtccacttggccagtctgtagcacccagttatttgatcagacatgaagccaggtgttactgtgaagctgctgctgctgctgctgctgctgctgctgcttcttcttcttcttcttcttcttcttcttcttcttcttcttcttcttcttcttcttcttcttcttcttcctccttccttcctccttcctcctcctcctccctcctcctcttccctcctcctccctcctcctcttccctcctcctccttcttcctcttcctcttcctcctcttcctcttcttcttctcctgctttcttctttcttcttcttccgaagacgaagatgaagacaaagacgaagacaaagaagaaggaggaggaagaggaggagaggaagaggaggaggacaaggaacaggaggaggaggaggaggaagggaaggaggaggaggaggaagaggagtggcagcagcagctggttgtaaagtttgtggcagatgaactgataaaatgcaatgaaagacaagaagccagtgtcagcacgtaacacgcatctttgatgtatgatcaggaacaaaatcatgggcagcccaagtggctgttttaactcagtgtggggacagctgtaaggagcaaaggtgattgttttatgtattcagccatcggagagccttgctttcaaatgctcactttctaattaagaaacaaagtatcctgtttgattggcagccacagtggatgaagtccccaagagggaagtaaatgccacctgtgatctgggagagaaagagaatcaaaggacacagaagctgctgcctcctgcccttaccacagccatcctgggaacatcgtttgtttgtttagtctttagatcattcactggctgattcagtcattccctggttcattatacattcattcattcattcattcataactcattctttgtttctctcatacatcaactaactcacaacttgccttactcactgtgacagctgacattcattgagatgctgtgtgacagacacaggcattgcagatgaattttgtagtttgtactaaaaactacaaacattactgagagaaaatcaagaaggtctaaataaatgaagtgatagactctaattttgaattggaagacttaatatcttactatgtcaattccttttaaattgatttgtagataaaaatgtaacccctattaaaatcctagcaagattttttttaaaaattgataaacgtattataaaacatttatggaaagccaaagggcctacaataaccccaacaatcttgacaagaacaaatttgggaaacattttctgatgtcaagattttttcaagatttgctaataggttgagtacttgtgtgtagcctgttgctccacaggagtccctacaagctgatatggcagaaacaatgctgtatgtgaaataaagatcaaggcaacagtcttgccctcagtaggctcccagaaatttgactccgatatgcctagcagaagttccttcgtgtttatcctgtttgaagtttgttgagattcttggatatgtggattgatattttaaatcaaatttgaaatttacagttactatttcttcaaatattgttttctgccccattttttttatcctctctgtttgggactcctgttacatgtattttagattacgtaacattgttccacaaatcacagcgattctattaatcttgttcactcccacttccctttgtacttatgtttggagagttcctattggcctgccttcaagtttactgatgctttcttttgcaatgtatctgctgctgttaagcccattcagtgaatgttacaatttcagatcttttatttttaagttctacaagttccattcagtttatatatatataatatatatatatatagtgtctatttctccgttgagattccccatctgttcactttttacatatatattcattttatttatatatatattttacatatttattcattttacatatattcattttattcatatatattcattttataagtcatgaacacatttataagggctgttttaaaaatcgtgtttgctaattcccatatttatattatctctgggtttgtttctattgacttggtgtttctcttgggtattttgtcacattttcctgcttcatatatctagaaatgttttactatattccaaatattgctgacacattattgatcatttggattattttgtctttatttaaagagtgttggatttttttctggcaggtagttaatttgctggtggatcggctgaatcttgtcttggcttggttttaagctttgttaacgtgga

SEQ ID NO: 470665 - DNA, 1308 bp, Homo sapiens
ggaggggatgaggacggaggacgtttccctggcatcctgcctaatatgtgtcggggctggggacacaaagacagtttagggatgatcgtcctgcccatgaggctcttggtcttgcagaggaggagtcgtggaaatgggataattgctggagggctctgtgagcaagagctgcacagcaaaagcaaaggggatgcagcagttctgcccgtgtggggggatatacacccggatacatattaccatcgagtacagccccatggccaggggacacccacccagatacatgttaccattgggtacagccccatggccaggggacacccacccggatacatgttaccatcggatatagccccatggccaggggacgcacacccggatacatgttaccatcgagtacagtcctatagccaggggatatacacccggatacatattaccatcgggtacagccccatggccagggaacacccacccggatacgtgttaccatcggatacagccccatggccaggggacacccacccggatacatgttaccatcgggtacagccccatagccaggggacgcacacctggatacatgttaccatcgagtacagtcctatagccaggggatatacacccggatacatattaccatcgagtacagccccatggccaggggacacccacccagatacatgttaccatcgggtacagccccatggccaggggacacccacccagatacatgttaccatcgggtacagccccatggccaggggacgcacacccggatacatgttaccatcgggtacggccccatggccaggggacacccacccggatacgtgttaccatcgggtacagccccatggccaagggacacccacccggatacgtgttaccatcgggtacggccccatggccaggggacacccacccggatacgtgttaccatcgggtacggccccatggccaggggacgcacacccggatacgtgttaccatcggctacggccccatggccaggggacgcacacccggatacgtattaccatcggctacggccccatggccaggggacgcacatgcagatacatgttaccatcgggtacagccccatggccaggggacacccacccagatacatgttaccatcgggtacagccccatggccaggggacacccacccggatacgtgttaccatcgggtacggccccatggccaggggacacacatgcagatacatgttaccatcgggtacagccccataaccaggggacacacacccagatacatgttaccatcaagtacagtcctat

SEQ ID NO: 470666 - DNA, 536 bp, Homo sapiens
cagaagtgccctgagggaatgcatggtctccaagtgccttccattcactggccaggcaccgctgtctcagatcacatccccaacttacctcttaaatgttccctctggaaaggtaaaaactccatgatgtcagagtccactctggtttactggtgtggcccacacctcctagggttcccttacatccacacctgcgttggcctggacgatcatgccctgaacaacctcgccctgaacagcacatcagggagctgctcaccagggcctctgcggctgctgtggacactggtgcgcaagtgtgtgtttgagtccctgctgaagtctccttcatcccagggtggctgggagcactgccctcccatcctctcctccatggggtgggatcttcccttcccctgagatctgtcaatgactctggccagctccgtggactctcctaaagagcgccacttgtaagctgcccaaaaacgaaacaaaacaaacactagccaggagcaaaagtaaagcttcattccaatgtttaaaaaactctgaaa

SEQ ID NO: 470667 - DNA, 1333 bp, Homo sapiens
tgctctacccagtgccccatgaacagtaaaaagttcctgttccaatctgactagccgatggtggagcaggctcccgaccgggccctgggcctgggtccctggctgtatacagcccatgggtggcactggccagagatgatgggcagcgaggcaggtcggctgagaggcctctgtcaacagcgctcagccggcatcggcttttcggcagggctgagcggaaatcctggctgcagggcactgcaagtgacagctaaactgagtgccagcgttgggggaccaagcccctacccccaccaacctgccgccagcggccgcttccctgattgggtctcctcccctcctccccgggagcctgctgtggagccgcggttccgaaatgatgatgtatttttggcaccctggctgggtcttgttcagttcttgttcctggtatctgccctgtgtctgatgttcagctggggctctgggaacactgaacactgaaatgaacgagtcctggtagcagttgcgggtgcatattttggggacttgacgcgaggcctggactgctggtgaagacacagcttcccttgtggaatctgcagggctgtggatccaggtgcccccccgccgcgtccttccccttcctgggcaccagacgtgcagatggagggtggtagggcactcctccacatcacctaccccagccccatctcttgaagggcaactggcagaacaggacaagagccacccgacccttcaattccataatcccgccccgggaccatatccctgagaaataattcaaaagatgaaaaaagctggacgtgccaagatatttatagcagcagaagaaacccctctggcatcatcttacctgtccgccgtaaagggatagttacgtgaagtatgcggcgggcactcgatgggatattgtgcggccgtgagacctgatgggtaggaagtccccgtacaagggaagccgtctctgtatatcatcaagtgaaaaagcaggacccctgattacagcgaggtgaaaactataaccgcatggagatgaagagcagatgcagccagagagaaatgaagacggtggcattagcgtgaagacgccgggggtccaactctgaaaaaacactgaagaaataaaaaaagttcacaaaagaatagcctccctccttgaccaggcacctgcccattgccctaaccgggtggccccctgcactccccactccatatccctccccccaggcaggtacactcttccctcgggctccagaggttatctagccagggcagaagctgagcctgtgtgtctgttgtttttgcaggatttgctaaggcgcctctgtgc

SEQ ID NO: 470668 - DNA, 1201 bp, Homo sapiens
aaattcacatgactcatcactgcttccatgccctgggctggaggccagcttcggggagagaacagggatggcctgagggaaagggccctggcactgggtgtaggggagtggatgaggaataagactggggaatcagactcttacacgctgatggggactccccagaacccactcgccactggaagctcagcctccgggtggcatgactttgccccttgcatggggcttccctggttggggaccaggcagctgaccagggtggcaggtgttggctcagggaagaggctgctcactcttggcatcttgacccctttgtccaggatcctgctctgcaacatccacttcctgctcccgatctccctgaaggggctgctgctcgtgggcctgctctgcactgtgctgcaagtgagcagtgctaagggggcctccagggggaaataaagtcacagcctgagccggggaaccgcagctcccacaccatcaacaccctcggagggggcaagcagaacctctggcctcctatcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatcccccacccggctcagaactggcacagccaccaccaaccactcctgattcaacccaagcttcgccctttccacctctcgagctgtgcaacaacaaatgcaggatgctcagccctcatgtgtcagtcccctcaattcacttgtaattaaataacaacacacctctttttctaattttcaaaggtgtatatatttcccctcaataaagttgttaggattatttttctcttccacttacattcttcctgaactctgcctgctcttttttcttccatattttactttaaatacttttttttgaattactatatttcttttcttagctcctttttttggagagatcttgttgtcttaacttctctaagaaggaggggaattttccatctgaactcttcctctattgccttgagcacttcctctcctgagacgggttcttcaactgccatttgct

SEQ ID NO: 470669 - DNA, 1098 bp, Homo sapiens
ctctgtttttttttttttattcactcgatcttgagttctgagaatgcatctgcagagctccacccacggagctggctttaggactcctcgactgttttttttttgtttgtttttttcctcctccatgcttttgtgcaaactgatgggactttagctgtcaggggacagagggcaaaggactccagaggtgtagcaggagagccccaagagtgaagatgctgggaaggacctttgggggcattttgacccgtggcctgctgtccccgctcaagagcacccacttcctgttcctgttcctcctggagctgcctctgctcctgagcatgctggggaccgtcctctgggcactgttcaagtacaactatcaccgaaataaagaaaaagacctgggacatgagtccaccatctctttggtttgctggcttgtaaagccatcttccttgccccaacagcttgtctctcgacttactggctgttgcttggcaagcagtttgagctttggactcggctacactagaaggactcagaactcagaaaagctgttatatgcatggttatggtttattacactgaaaggatatggattaaaaccagtaaaggtaaaaagtgcgtggtgcaagctgccagctgtcctcttccagcgggattttgcagacagtgtttaattctcccatcctagcaacaatgtgtgacaacacacacaatgtgctccatccagggatgctcacccaagccttggtatccagagagttcactggggtcagtcacatagtcatgaaacacctgtagaactgacctcagtgcctaagtcgccagagatcaaattaaaactacatagctcaaagttccccctacccacccatgaattacattgatagcatcaaccatctagcatggctagaagcccccaccataatcacatggttaacatgagctatccagcatggcatcaaagcccccagataaacaaagacactctaaccaggcaggatattccaagggtttagagcttatctcctagaagcaaagcaagggctaaactttttttgggaaggtgcaggctttggacaacctaagcctgctgagttaatatttttc

SEQ ID NO: 470670 - DNA, 947 bp, Homo sapiens
agtcccccggtgacactgcctgatgaactaggggtggcgttgggctttggctgactctgtgcctagctgacccctgaccatgcatgcctggtgtctccagcctgactgtgctgtccaggggttgtggtggctgaagtatgtcccccacccatgtgggatggctctgggaccccagcaggagttgtgtaactctggacccttggtccccccacagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggcaatccagagctgagtccattcgccagctctgggtctcgtttgaggggaggtgctgccccctggtggtgatgaactttaacttaccagccacacctcacact

SEQ ID NO: 470671 - DNA, 1247 bp, Homo sapiens
gggtccgcactgcctttatgagctgtaacactcaccgcaaaggaattcccagatgtttctgtgccaagcattgccctaggtactgaagacagagcttgggcaaaacgaggacgtctctacggcactgagggtccgtctgttggcagagacagacgacagcatgtgtcatgtgtgtcacctcatcggcctggctcctccctccgcggcggttctgatgccgcctgccagggtcgcgcgcctgagccgggcctgggtcgccagcgcccgcagcagaggagccagggtgtctcgcaccttgaccccgggggcgggtgtccccaggcggcgcgtgactccgccccggcccgccccgcctcgcctgcaccgcagacacacgccccagtcctccagtcctccgtgcgcgtcgggcccgagcccacagagtccatggaacccacggagccgatggaacctacggagcccatggaacctacggagcccatggaacctacggagcccatggaacctacggagcccatggaaccggcgcggacgcacctgtgggggcgaggcgctgctgcgggagctggaggtgctggtgcaggacgtggtgaggacgagctcctggtgggagcgccacggctggactgcgccatcctcgcgctcagcctcttcgccttgccggcaggtgaggaacgcggggacccggcgtcccggccggctgcgggtgggggcggggtgcggcggaggtggcggcgcggggtctgcaacagcagccgtgggagtgcagcctgcgcagtggactggcggcggcagggaggcggaggtggtcggggccccgcacccaaggatggagggccacagtgggacctgcctcactccggccagtggcagcccccagagcctagcccactttagcctgggctcccagggcttcctgtgcctgcgctgggagaatgccctggtctttgcatccggcatcaccatcttgggtgtgtgccactacacactcactgtcaagggcagccacctggccactcatggggccctcaccgagtccaaacgctggagcaagatctggctgcttttctttgtggaggcagataaacccaagtttgccaacaaaggcagtaaccccagtggccagctgctgctgctactgcacagtgaggaggaggtggggcctggtgggaggtgactggatcatggaggggtttctcatgaatggtttggcagtatccccttggtgttgtcttggtgagagtgac

SEQ ID NO: 470672 - DNA, 1227 bp, Homo sapiens
gtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagagtcggtcagttacagaaggaggaaggatgctgaatggaaagaacagaaagaccaaatacacaagaaagaaagtgtgaggcacactggagaaatgatcagcgtgtatcagtgttaaactaagagtgcactggaatcgcttggaggcttgttataaacacaggttgctgggccaaatctcttagggttcggatttagtagggctgtgtgagactgagaatttgcatttctaatgacttctcaggtgcagctgatgcttcttgtccagggatccactttgttgggagcctgtggtgtatatgagagcatcctctggaaagccccacagc

SEQ ID NO: 470673 - DNA, 986 bp, Homo sapiens
ccagtttaatcatgaaaacagacaaacccaagagcacatgctgctatgcaatgtaatgcccaaagtcgcagccacattccgtctctgaattcactcttgggtgcctacatcatgacccgtagatgtctggatgatcaaatttggctttgtcatttttatcctccacctcccaaagatcttgatactcattccccatggtgggcatttgccaagaaggctaaacaatccgcaatgcacaggacagccctgaagagcaacaagtgttgcaccgaaaatgccaacagcacctcctttgataacactagagaatgccaagaaagagatgtgtttgcatctgttccacggggctgctgtgaagactcagtgggagatttaccctggcaggagctccatcagtgagatgtcactctttcctgaaaaactctggggtcttcacagatctatgcaggtaatgctcctgctctaaaactgaataatcttctcagagaggtccatcagaacaaatgataagttcaactcagctcctctcatatgactggttcttcccatctgaacacatgggctcgcttcttgtttcatattagttgctgttcaccttttatatctgaaacaatgtcaagtacaaaaatcactgatatttggtgagcgccttaaaagcccctccttctccctgaatcccacacaattctatctccttgcaattccaatcactcttggtttaatcatttcatccatatcgtgacaagttagaaaatcttgaaagtgctatggggcaatgtataatagttggtgcattggcacagaacggggactttatataaagacatatcatctttccagagtgttccaaaagaactcgaatattgatatgtgtgtgtggggtggcgaggggggaagggaattaactaggatttaactagctaaggcttgaaagaatatttgcctttttcatccttttcccattcctctccatttggcctttctgc

SEQ ID NO: 470674 - DNA, 923 bp, Homo sapiens
agcatggtaatgagaagatttagaaaaaaagtgacaacacgaaaccaagcccacctattaatgaaaagtccaattggtgaaaatctgacagattctcccagagctccccattgcaccgctgtaactgtccagtggggttgggagtatccacaaggccttttggagagagagcaagtcccacctcacagggacttgagagtgcagaaatctcagacggtaagaataactgggccttgcctctccacctgttcccggcctctgctgccctctggtggcagcatgcagccctactccattattactgccctcgcggggactgttttggaagcagaaataaagagcgagaaccagggaggtctagaaagggagaagttggaggagcagtgtaaggttgagtatgtgaggttctcctacagattctgtaagggcatcttgagaagcacagagaaaatgtatcggaattgtccaataggacaggaggctggagcatttatcaccagcttccactcctatggtctaactctgcccttatagcctgacactgaaatgtttatcttaaaggcctggaagaacaatgctttctttcactataccttgattctgtactcttggctactcttgatgtgtctgaatttttgccagaaaacttcccatcctgttgctaagaatcacctattccccttatcaaggaaatgtcctttcattctgcacagttctctctgctttcttctaaaaggttccttgttttacattttacatttaaatctctgatccattcaggcaatttttgcatagaatatgaggtttaggtgaagttcatttttttgttcagttactccaccaccatttgaacaccacctatctggcaaaggattaatatctagaatatttaaactctcaaaactcaagttttttaaaaagaa

SEQ ID NO: 470675 - DNA, 1046 bp, Homo sapiens
gtcaggagctatgagcagcacggggcatgcatgatcgtagggagtcaattatggttgctttaacagcatggcctggctactgtactgagaatggactggagggggcaaacatgggaagagggagactagtcaggatgccatggcaaatgatccacacaagagacaacagcagctttgaccagggtggccgcagtggaagtgtcataactcttggcctcaagccgcagaaaacaactctacacagaaagggaatattctggaagaagcagatgggcgtcaagggcttggaaaatgatcaggaaacaggactgcggcagaggactagggaacaggaagataaccactatttttcagcagaagccatttggtcaggatgctactaccaatgccaccacagggtacctctgctggacaccaccatccctgtgaatgatgcccaactgtttgtctttgtgccacttgttcaagattctgtgccccaggaaggagaaaagtgagaccctgtctcaaaaataacaacataaaataataacataaaattaataataaaattttttttaaaaattaactactgtacagaattgggccatatatattttttttaattaagtccaaactttacaaattaagcaatatatatgtgtgtgtgtatatatatatatatgtatatatatgtatatatgtatatatgtatatatatatgtatatatatgtatatatgtatatatatgtatatatatgtatatatgtatatatatgtatatatatgtatatatgtatatatgtatatatgtgtgtgtatgtatatatgtatatatgtatatatatgtatatatacgtatatatatgtatatatgtatatatatgtatatatatgtgtgtatatatatatattgcgtttgtggtacacagatgtcacaatcaatttgtttcattgtagtatttttgtaaacttttttccatgatctttcacctatagagatatgaagaaatagaagagtagaggtaggcagttgaaggatgaacgagacagtcacctgcagatg

SEQ ID NO: 470676 - DNA, 1727 bp, Homo sapiens
ccaagaagcagcttctctgctccttctggaatctccacttggttcagcctgcctacctccactctgcctccactatgtccatcaaggtgacccagaagtcctacaaggtgtccacctctgacccctgggccttcagcagcctctcctacacaagtgggcccggtgcccccatcagcttctctagcttctcccgagtgggcagcagcagcttccggggtggccagggtggaggctatgctggggccagtggaatgggaggcatcaccatcatcacagtcaaccagagcctactgagcccccttaacctggaggtggaccccaacatccaggccgtgcacacccaggagaaggagcaggtcaagactctcaacaagtttgcttccttcatagagaagagctacatcaataaccttaggtggcagctggagactctgggccaggagaagctgaagctggaggcagagtttggcaacatgaaggggctggtggagaacttcaagaacaagtatgaggatgagatcaataagcgtacagaggtggggaatgaatttgtcctcatcaagaaggatgtggatgaagcttacatgaacaaggtagagctggagtcttgcctggaagtcctgactgacgagatcaacttcttcagtcagctatatgaagaggacatccaggagctgcagtcccagatatcggacacgtttgtggtgctgtccatggacaacagccgcaccctggacatggacagcatcatcactgaggtcagggcgcagtatgaggagatcgccaactgcagccaggctgaggctgtgagaccatgtaccagatcaagtatgaggagctgcaggcgctggctgggaagcacgggggtgacctgtggcgttcgaagacagatctctgagatgaacgggaacatcagccggctccaggctgagattgagggcctcaaaggccagagggcttccctggaggccaccctcgcagatgccgagcagtgtggggagctggccgttaaggatgccaacgccaagctgtccaagctgggaggctgccccacagccggccaagcgggacatggcacggcagctgcgtatcaggggctgataaacttcaagctggccctggacgtcgagatagccacctacaggaagctgctggagggtgaggagagccggctggagtctgggatgcgtaacatgagtatccattcgaagaccaccagtggctatgggggcctcacaagctactgcctgagctccagctttggttctggcgccggctccagctccaccaaggccgtggttgtgaagaagcttgagacccgtgatgggaagctggtgtccgagtcctgacatctgccaaagcttaatgtgctggaaacttaatatttgtagtatgaggacaaaataacttatgcagttcatttgaccgcagtttgtttttgattactgtgaaagctctgaaagttacagctataagcaaccttaacctgttttgcaagttactcttgcttgttacttgatttctggggggatgttttgtctttgactttgagaatctgctctctagacttacataaatatgacagcttgtgttactaatgttaatagattagttaggtaatatggttagttttaataggtaaaacacaacccaaagagcactgtctgtggtcttaggcagatctggactccagtcctggccctgcagcttcaaacctgtgcagcctt

SEQ ID NO: 470677 - DNA, 3399 bp, Homo sapiens
tgaagagcagtgcagcagcttctccccttgtttcctcctcagagtccatgccgaggtggcgcagggtgcgcccgcaggccttgctgactgccacccatagcagcacactggtggaggtggtggtggcactgctgtgcacgctgcactccctgactcagtggaatgggctcatcaacaagtacatcaactcccagctccgctccatcacccacagctttgcgggaaggccttctgaaggggcccagttagaggactacttccccgactccgagaaccctgaagtggggggcctcatggcggtcctggctgtgattggaggcatcgatggtcgcctgtgcctgggcggccaaattgtgcacgatgagtttggagaaggcactgtgactggcatcaccccgaagggcaaaatcaccgtgcagttctctgacatgcggacgtgtcacatttgcccattgaatcagctgaaaccagtaggtgaacttgtgctcagttactgtatgataagggaaattggctttacactaggacccagcaccaacattagcacttgaaagaacttgattctggtacttcaagtttgccttctaggaagctgtgtgagcttgcgcttctgtggtgagcagggcctgtctcacagggcacctaaagcagtggttcctgtgtttttcagcctcagagacatgaagagggctttagcaacctagaagaaggatgccaagaaaaaaagtgaataagtatttttggttcatctattacatcatttcatttcattatttcatttcttttcatcatttcatttcatttcctcatttcatcctttcatttcatcatttcatcatttcatttcatcctttcatttcatcatttcatctcatcatttcatctcattttatcatttcatttcattctttcatttcatttcatcatttcatctcaacatttctcatcatttcatcatttcatctcatcatttcatttcatctcatcatttcatttcatctcatcatttcatcttttcatctcatttcatcatttcatttcatcttatcatctcatttcatcaattcatcatttcatctcatcatttcatctcatttcatttcacttcatttcattgtttcatttcatttcatcattgcatttcatcacttcatctcaacatttcatttcgtcatttcactttatctcatttcatcatttcatctcatgatttcatttcatttcatctcatcatttcatcttttcatctcatcatttcatcatttcatctcatttcatttcatcatttcatttcatttatttcatcattgcatcatttgatttcatgtcatttcatcatttcatatcatttcatcatttcatcttttcattccatcatttcatcatttcacttcatcatttcatttcctcatttcatcatttcatttcatcctttcatcatttcatctcatcatttcatcctttcatttcattatttcatttcataatttcttctcattgttgcatttcgtcattccatcatttcatcatttcacttcatctcaccatttcatcatctcacgatttcatttcatctcatcatttcatctcatttcatcttttcatctcgtcatttcatttcatcatttcatttcatttcatcttttcatctcatttcatttgatcatttcatcaattcatcatttcatcatttcatttcattacatcatttaatcatttcacttcatttcatcacttcatttcatttcatcatttcatatcatttcttcatttcaccatttgatcttttcatttcatttcatcatttcatcatttcatttcatcatttcacttcatcatttcatcatttcatttcatttcctcatttcatttcaccatttcatttcatcattccatttcatcatttcatttcacttcatctcatcacttcatcatttcatctcatgatttcatttcatcgcatcatttcatcatttcatttcattatttcatttcatttcatcatttcatctcaacatttcatttcatttcatcatttcacttcatttcatcatttcatcatttcatctcatgatttcatttcatctcatttcatctttccatctcatcatttcatttcatcatttcatttcatttcatcttttcatctcatttcatttcatcaattcatcatttcatctcattatttcatctcatttcatttcacttcatttcattgtttcatttcatttcatcacttcatctcaatatttcatttcgtcatttcacttcatctcatttcatcatttcatctcatgatttcatttcatctcatttcatttcatcatttcatttatttcatcatttcatcatttgacttcatgtcatcatttcatcatttcatatttcaacatttcatcttttcattccatcatttcatcatttcatttcctcatttcatcatttcatttcatcctttcatcatttcatctcatcatttcatcctttatttcatttcttctcattgttgcatttcgtcatctcatttcatttcacttcatctcatcatttcatcatctcatgatttcatttcatctcatcatttcatctcatttcatcttttcatctcgtcatttcatcatttcatttcatcttttcatctcgtcatttcatttgatcatttcatcaattcatcatttcatttcatcatttaatcatttcacttcatttcatcatttcatttcatttcatatcatttcttcatttcaccatttgatcttttcatttcatttcatcatttcatcatttcacttcatcatttcatcattccatttcatttcctcatttcatttcacaatttcatttcatcatttcatttcatcattccatttcatcatttcattacatttcataatttcatcatttcacttcatctcatcatttcatcacatcatttcatttcatctcatcatttcatttcatcttttcatctcctcatttcatttaatcatttcgtttcatttcaccttttcatctcatcatttcatttcatcaattcatcatttaatttcattttttcatcatttcatcattcacttcatttcatcatttcatttcatcatttcatatcatttcctcaattcatcatttcatcttttcatttcatttcatcatttcatcatttcatttcatttcacttcattatttcatttcattatttcatttcatttcatttccccatttcatgtcatcatttcattatttcatttcatcattccatttcatcatttcgtttcatttcatcatttcatctcattatttcatttcttcatttcatcatttcgtttaatttcatcatttcatttcatcatttcatcatttcatttcatttcagtgatacatgtatttaattgctaatgc

SEQ ID NO: 470678 - DNA, 671 bp, Homo sapiens
ctgcccaggctcgccttgactccaaatggttgaaaacagatatacagatgatagtgtcaaaccaagtggaacaaagaaagaagatctggatgacaaagagaaaaaagatgaaactcctgcacctgtatatagggccaagtcaattctggagagctggggatgttcacggaacgccagacaccaaaaggccagaagcatgcccctgcaggaccagcacttggctctggccatcctgctggagctggctgtgcagagaggcacgctgagagagtcattttttacagttcagaactgtagaaataatgaggaagtgacacttatatgcaaagctgatttggagaaccataataaagatggaggcttctggattgtgattgatgagaaagtgtatgatataaaggacttccagacacagtcgttaacaggaaatagtattcttgctcagtttgcaggggaaaacccagtggtagctttggaagctgctttcgagtttgaagtcacccgggaatccatgcacgcattttgtgttggccaatatttggagaaaagaggttaaactttggtcttatgtagaaatttggaatggcttattatcttgagagtttgatttttgttagaataaatttcatttcctctacctgtgtggtcacagtccactaatacttgtcatc

SEQ ID NO: 470679 - DNA, 4506 bp, Homo sapiens
gactgggcagtgggtaggtgaagggtgatggcagggcagggcagggcattggcgcagccgctcctttcacctggtgtgccagcttgcagtttgtgcatttgtcccttttggctgcacagagaaggcagggaaactgcgtgggaatgcaaggtcgggaacggccgggggtgcgaccaaggggacttggagaaccgccccacctccccaggttcccctggcagagcgcaccaccccccgcccccgcgatttttcacaggcccaggccctgtggagctgggcctctgtggaaggggtgggggcagggcagaggcaggaggacagaaagagctgggcagggaagggggccaagagagcctttctcaacatccagatgatcaaacaggtcttcatcctcatccttttcatgggcagggtgtggagaaggatgtagaattcttggttttgctaagtggacctgcacagttcaaacccttgtggtgcaaaggccatctgtatagccattgaatagcaatttatttttagaaattaaactcactaaaatactcttagaaggatgccaagaaaaaaatcaataagtatttttggttcatctatttcatcatttcatttcatttcatcatcatttcatcatttcatttcatcatgtcatttcatttcatcctttaatttcatcatttcatcatttcatttcatcatttcatctcattatttcatttcatttcatctcatttcatcatttcatttcattctttcatttcatcatttcatcatttcatctcatgatttcatttcatctcatcatttcacttcatttcatttcatctcatgatttcatttcatctcatcatttcatctcatcatttcatcttttcatcttgtcatttcatcatttcatcttttcatctcatcatttcatcatttcatttcatcaattcatcatttcagttcatttatttcatcatttcgtttcatcatttaatttcatcatttcacttcatttcatcatttcatataatttcatcatttcatttcatcatttcatcttttttcatttcataatttcatcattccacttcatcattccacttcatcattccacttcatcatttcatttcatttcatttcatcatttcatttcatttcatcctttcatttcatctcatttcatcctttcatttcattctttcatttcatcatttcatctcatcatttcatttcatcatttcacttcatctcatcatttcatcattttatctcatgatttcatttcatctcatgatttcatctcatcatttcatcttttcatctcatcatttcatttaatcattttatttcattttatcttttcatctcatcatttcatcatttcatttcatcgattcatcatttcatcatttcatttcattatttcatcatttcatcatttcacttcatctcatcatttcatttcatcattttatatcatttcgtttcatcatttcatcttttcatcatttcatttcatttcatcatttcacttcatcatttcttcatttcatttcctcatttcattgcaccatttcatcacttcatcatttcatcatttcatttcatcattccatttcatcatttcatcatttcatttcatctcatcatttcatttcatcatttcatttcctcatttcaccattacatttcatctcatcatttcattttatcatttcatttcatcatttcatttattcatttcatcatttcgtttcatcatttcatcatttcctttcatttcatcatttcatttcatcatttcatctcatcatttcatctcatcatttcatttcatcatttcatctcatcatcatttcatctcatcatttcatctcatcatttcatttcattcatttcatcatttcatctcatgatttcatttcatctcatcatttcacttcatctcatcattacaccatttcatctcatgatttcatttcatgtagtcatttcatttcatctcatcatttcatttcatcttttcatctcttcatttcatttcaccgtttcatcttttcatctcgtcatttcacttcatttcatcatttcatcaattcatcatttcatcatttcatttcattatttcatcatttcgtcatttcacttcatttcatcatttcatataatttcatcatttcattttatcatttcttttaatttcatttcatcatttcactttatttcatcatttcatatcatttcatttcatcatttcatcttttcatgtcatttcatcatttcatcatttcatttcattctttcatttcatcattgcatttcatcatttcatcatttcatctcatgatttcatttcatctcatcatttcacttcatctcatcatttcatctcatgatttcatctcatcatttcattacatcccatcatttcatgttttcatctcgtcatttcatcatttcatttcagttcatcttttcatctcgtcatttcatttcatcatttcatttcatcatcatttcagttcatttatttcatcatttcatttcatcatttaatttcatcatttcacttcatttcatcatttcatttcatttcatatcatttcatcatttcatcttttaatttcatttcataatttcatcattccacttcatcatttcgtttcatcatttcatttcctcatttcatcatttcatttcatcctttcatttcatctcatcatttcatcctttcatttcattctttcatttcattatttcatctcatcatttcatctcatcatttcatttcatcatttcacttcatctcatcatttcatcattttatctcatgatttcatttcatctcatcatttcatttcatatcatttcatttcatcttttcatctcgtcatttcacttaatcattttatttcattttatcttttcatctcatcatttcatttcatcatttcatcatttcatcatttcatttcacttcatttcatttcatcatttcgtatcatttcttcatttcatttcatcttttcatttcatttcatcatttcatcatttcatttcatttcatcatttcacttcatcatttcatttcttcatttcatttcatttcctcatttcattgcaccatttcatcacttcatcattttatcattccatttcatcatttcatcatttcatttcatttcatctcatcatttcatttcatttcctcatttcaccattacttttcatctcatttcatcattttatcatttcatttcatcatttcatttcttcatttcattttgtttcatcatttcatcatttcctttcatttcatcatttcatctcatcatttcatctcatcatttcatctcatttcatttcattcatttcatcatttcatcatttcatctcatgatttcatttcatctcatcatttcacttcatctcatcattacaccatttcatctcatgatttcatctagtcatttcatttcatctcatcatttcatcttttcatctcgtcatttcatttcatcatttcatttcatcttttcatctcgtcatttcatttcatttcattttatcaattcatcaatttatcatttcatttcatttcattatttcatcatttcatcatttcatcatttcacttcacttcatcatttcattatttcatataatttcatcatttcattttatcatttcttttaatttcatttcatcatttcatcatttcactttatttcatcatttcatatcatttcatcatttcatttcatcatttcatcttttcatttagtttcattatttcatcatttcacttcatcatttcatttcatttcctcatttcatcatttcatttcctttcatcatttcatctcatcatttcatcctttcattatttcatttcatcatttcatgtcatcatttcacttcatcatttcatcatttcatttcatcatttcacttcatctcctcacttcatcatttcatctcatcatttcatctcatcatttcgtttcatctttccatctcatcatttcatttaatcatttcatttcatcttttcatctcatcatttcatttcatttcatcatttcatttcatcaattcatcatttcatttcattttattatttcatcatttcatcatttcacttcatttcctcatttcatttcatttcatatttcttcatcatttcatcttttcatttcatttcatcattttatcatttcatttcatttcatcatttcacttcgtcatttcatttcatcatctcatttcaccatttcatcatttcatcattccatttcatcatttcatcatttcatcatttcatcatttaatttcatcatttcaccatttcacttcatctcatcatttcatttcatttcatcattttatcatttcatttcatcagttcatttcttcatttcatcatttcctttcatttcattatttcatttcaccatttcatcatttcatttcatcatttcatttcatttcagtgatacatatatttaagtgctaatgtga

SEQ ID NO: 470680 - DNA, 649 bp, Homo sapiens
ggcttgatgtggggatgtcaacatggctcagattgataaatttacctctgaggcaggtatggctgaagctttatgaaaagagatggggcctgtgccaggccttagatgtaggagaaggaggacgtgtcaggaagcagaaacagtatcatcaaaggtgctgctgtgaggcatgtgggcagtgtttggagaagagccagggactttctgtgtcaaagctttatgaaaagagatggggcctgtgccaggccttagatgtaggagaaggaggacgtgtcaggaagcagaaacagtatcatcaaaggtgctgctgtgaggcatgtgggcagtgtttggagaagagccagggactttctgtgtcaggtttacagcatctgtgggaggccgcattggataggctcatctgtacttttttgatagaggatgatattgatgatgaaatgtcctacaatgatcatttagaggtttattttgaacaactggcaattccaggaatgatggaataaaacatatgaagtagaaggactggaacctccagaaaaaatactttaagttacctgcaagtgatcctagtcagaaatgtttttgttactttcctttttgatttcttcactgaccattaccattatttatataccatgtacttggagag

SEQ ID NO: 470681 - DNA, 503 bp, Homo sapiens
aacaacagcaaggtgggtgtcaatggcatgccctatgtgactgtgcttaggttagctgctgctgcttgtcaggagcatggggatggcatgccgatgctccacttcactaaactctaccatcattatagaagttttggagtagcctatgaaagacagaatcatgtcattatccaagagacaaaatcctctagagctgcagagctcaccaggggatcagctttagcaggcaggcatccttctcagcactgccatccaggactctttcccttggacacaaacagcaaaatgccaggaagacgggaccaggaacacagtgtggtcagaagcaagactgatgcaagaagcaaccacttggaaatccaaagggagcattttggccctctcctgtgggcagccctcaactttggtgctcacttcctaacctcagtgacggtttctgagcttcatcctgcctctggagtccacatgggctccaggtggtgaacagtttcactgaatcctga

SEQ ID NO: 470682 - DNA, 751 bp, Homo sapiens
ttcgtgttttgtgagtttggttttacctacgtattatgattttggatgtaaatctgcaactctatgtacatgttaagtcaatgtgatgtttaatcaaaatatgaatcagccatatctaccaccaataaaatcgtgtgtttgtttgcctctggtgaatgcaggaataaaagacaagagacaaaggggtatatttggaaaaaggggtcaggggcaccttgcctctagtgaacaagtttctcccaaggtcacagaattatccagaccaaccaataacaacttcctgtgggaaccaggtgcatctcaccctcttgatactacaaagccttccccaacaccccctgtttgttctctctgctcccaagtgcaatccctgtgtgggaaaggcccagggatggttttttgtaaaattgcaaaaaacaaaaaggacttttactttggagagaattatgcacgtcactcagttgctctaacaagtgctaccgtcatgggagcaagaacagtgaccttgtctttcctgagctgccgcttcctttgctcctgtcacatgcactctcacgatgaggggctcattccttgtgccttatggttcaggcactgatgagaaataaaaaagagaaagataacttaatattagtccctcccaaaacttactgggtaattctctcatcctaaatcccctactcatcgtgtaggcttttagcactgctgcttaccagtatgctaaaggtgcagacttaggatcagaagtttg

SEQ ID NO: 470683 - DNA, 973 bp, Homo sapiens
gctgcctcaaccctttttggattcttttctccccagactgtcccagagttcaggtcttctcgctttttgcggctttttgcccccgccgccgcccctttttgccgccgcagatttttgctcccgccaccgcggcttcttgcccccgccgccgcggctttttgcggctttttgcccctgcggcattttgctcccgccgccgccggtttttgccgccgtggctttttgcccccgccaccgaggctttttgtccccgccgccccagctttttgcccccgccgccgccgctttttgccaccgctgccgcggctctgagggcgggagcagcacactcggctgccggctctaccggcgtccttgttcaggcggcgccggggggcgctcctggtccagctctcccggctcgggggttccttgcctaggcgcccgcgccccgggctccccgccttggccgctgcggcctgcatagagcggcgctgcgcgtagcggccaggggagagaagaaggagggcggtggcgggggtgatgtggcggcctctttgggaggcgcaggggccgcagccagccagacgctgcagcagtgtgggcagctccagaagcttgtgggcagctccagaagcttatccgcatctccattggcagcctgcgccggttgcgcaacaagtgcgctgtgtccaaggacctcacccagcaggagatacggaccctggaggtaagggggtcgtggacccaggctgggctcgaggagcggcccagacacctccctccgtgcccaagttcactcctggccgagttgcatccttgagccccagtcgccccgttggaggcttcccctccctcctgcactcgctgatgcggcagccggaggacccgggaccagccctcaccttgggcaggatctgtggggcggcggacatccccttaccccctgaatttccatctggtccagccctctcatcttgtgggtgaggaaacc

SEQ ID NO: 470684 - DNA, 1144 bp, Homo sapiens
gaggcggacgcggcccggacccggtggatgtggagcagtcgccgctgccggcgcccaagccgaccccagggccgacccccgcaaggagctgaaggaggtgggagccccagtcgccgcgggcgtcggcgccgagggcgacccactcttggtcattctggaatgcggcaggcacgcagcgtttgcgtgggaatcctgagcacggcagaacccccacacccaccatggttcctgggcctgtgcactctgggcttttctggctttgcccacccagctgctccatgccaggaggaggaggagacacctagagcctgcgacaccacgacttgcctcactgcgggccctgcccctgctgctgccctggccctggcctggaacctggtcctgtcaaggacctgccctgactctgtcatggccctggccctgctctgccttgtcctggccctgaccctttcctggctctgcactggcctttccctggccctgagctggcagtggtctacccctgctctggccatcaccctgccctgctgtgctctggatgtgtcctcaccctgccctggccctactctgcctttgaccctgccctggccttaccttggccctcaccctagtgaccctggccctgcccctgcccttgtctttgccctggcactggccttggacatgtccgtggtcctaaccctggccctgccctggagctgccactgtcttggccctgccctggctctggccctgccccggccctggccctgccccggccccagccatagacctgccctgccctggatctaccctgactctgccttggtgttgccctcccatctctatggcctggctctggccctgccttgcacaggccatgctctgccctgcatgtcccagcctgggcccagcccttgccctaccatatttctgaccccacccgtacccttgttctggccttgaccctgccgtggcattctcctggcccttccttggtcctgccctgcccttccatgccctggcctttccctcaccctgcactggtcctgccctgccctggcagtgccttggccctggccctgcctctgccttctccctggccttgctctttccctgccctggcctgaccccaggcctaccgagtccatgaaatgaccctgga

SEQ ID NO: 470685 - DNA, 1588 bp, Homo sapiens
ccgtagccatgacttttgcaagtcctcctagattaacactgaacttgggggtggttttagggaccctgacagtggccgcaaacccaaaggtgcgggagcaagtgcggctggagctgagcttcgtcaactcagacctgcagatgctcaaggaagagctggaggggctgaacatctcagtgggcgtctatcagaacacagagtatgactccctcactggggttctggtcagccagcagaacctgctgctggagaaggccagtgtcctgttcaacactggggtcctctacacccagattgggacccggcgctatcggcacacgcaggctgggctgcagagtgccatagatgcctttcagagagctgcaggggttttaaactacctgaaagagacatttacccataatccaagttacgatatgatccctgccatgctcagcgtgcttgtcaaaatgatgcttgcacaaacccaagaaagcgtgtttgagaaaatcagccttcctgggatctggaatgaattcttcatgctggtgaaggtggctcaggaggctgccaaggtgggagaggtctgccgacagctgcacgcagccatgagccaggtgctggtgaaagagaacatcccctactcctgggccagcttggcctgcgtgaaggcccaccactatgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccaacagctgggtgcatgtccctctgcacccagatgtgggtcccacttggtgaccagctggtcctgctcacagacagccacagagaggtccctgaagagggcccgggagaggggggtgttccaagtcatcgtggccactttgggttcggaagtcatgaggcacagtcctgagcctcagagggcttcccaggctgtgttctcatgggttccatagcacccaggcctccccctgtggagccaggactttaaccatctcccttggggtccacagggtggcctgtatcatgctaacagggaaggagacgtttgttgatttccttatgcatggctgaattcccaagaacacctaatgactggtaatgaagtgtcctggtttggtctctgccatgtctcagtgtgaatatctcttcccatgtgcagacctcacctccaccaccctaatctgcccccacgcacacatacgcagcttccccgtctcagtgatggcaactcccacccctctaggtgctcaggccagaaaccttggactcactctccagtcttcttttctttcctcctctttcccctcccctcccctctgctcccctctcctctcttcccctctgctcccctcccctcctctcccgttctctcccctcctcttccctcccctcctcttccctcccctctgttaccctcccctcctctcccattctctcccctcctcttccctcccctctgttaccctcccctcccctcctctccccgtctctcccctcctctcttctc

SEQ ID NO: 470686 - DNA, 7973 bp, Homo sapiens
ctctgcgcctcccaggcagtatggcatggcagtgggaaattagatttcaagtgaaattaaggttgcaaaggtggcgggagcaaaaagccgcagcagcaaaaatccgcggcggcaggggcaaaaatccgcggcggcgggagcaaaaagccgcggcgggcaaaaagccgcggcggcaaaaagccgcgtcggcggggtggggggcaaaaagccgcagcgaggcaaaaagccttggcgggcaaaaagctgaggcggggtggaggcaaaaagctgcggcgggtaaagagccgcggcggtgtggggggccaaaagccgcggcggcgggtgggggcaaaaagccagggcgggcaaaaagccgcggcagcggagggcaaaatagtggagatggggtagaaggccggcacagcttggcgttgctggagtgtgatgtgataggaaatgtgcagccaaagacaaaaaaagatgtaagtaggcttgactcattgcagctaagaacccagatgttatcttgagggtattaactaataagcagtttaaatcagaatggcacattctgatttgttgtttgacaagaatgcttcagctcttaatttaaaattatgcttctccctcctaggttgagtgaacttagaatgcattctctgacatatccaagtttttgttaatatgaatttggggaaaaaagcatacttaattagctaagacttcttattctaggcttgaccctgtgtttgacgtcttttgaatttctagttgcatgggctgctctctgacactgagttaaacctttcttttgattcagcaatttggaaacactgtttttgtccattctacaaatggacatttgggagcttgatgagggcaaaggcaagaaagccaatattgaaggataaaaactagaaggaagctatctggaaaatatctttgtgatgtgtgcattcatctcacagagttaaacctttcttttgattcaattgtttggaaacactgtttttgtccattctctgaatggacattttgaaactcattgaggccaatagtgaaaaagtgaatatctcagaataaaaactagaaggaagttatctgaaaaaccacctggtttggtgttcattcaactctcagagttataacatacttttcattcagcagttctgaaaaactgattttgtagaatctgtgaagggatatttgggagcgcattgaggcctatggtgaaaaagaaaatgtcttcagataaaaacaagaaagaagctttctgagaaactgcttcatgaggtgtgctctcatctcaaacagataaacctttcttttgattcagcagtttggaaacactgtttttgcccttatgcgaatggacacttgcgagctccttgaggccaatgccataaaactgaatatcacaggacaaaaactataaggaagctatctgagaaactgcttcgtgatgtgtacattcacctcatagagttaaacgtttattttcactcagcagttgctaaacaaagtttgtgtagaaactgcaaaggtatatttgggagcacatagaggcctatggtgaaaatgaaaatgtcttcagatataaattataaagaacctttctgagaaactgctttgtgatgtgtgcttttatttcacagaattaaaccctcctcttgactcacctgtttggaaacactgtttttgtctattgtaagagtggacatttgggagctcattgtggccaatggagaaaaagcaaatatcccaagataaaaactagaaggaagctatctgagaaactgctttgtgatgtgggcattcatctcacagagttaaacctttcttttcattcagcattttggaaacactgttttgtaggatctgtgaagggacattttcgaccacatataggcctatgttgaaaaaaaatttttcagatactaactagaaagtatgttactgagaaaccagtttgtgacatgtgcattttctcacagagttaaacccttcttttcattcagtagtttggaaacactgtttttgtacattctgtgaatggacatttaggagctcactgaggccaatggcaaaaaaggagtatcccagaaaaaaaacaggaaggaagctgtctgagaatccactttgtgatgtgcattcacctcacagagttaaacctttcttttcattcagcagtttggaaacactgtttttgtagaatctgcaaagagatatttgggagggcattgagagctaaggcaaaaaagcaaacatccgaggaaaaaaactagaaagaaattatctgagaaatggcattatgaagtgtgcattcattttacagtgttaaacctttattttcattcagtagtttggaaatgctgtttttgtcaaatcagcaaagggatattttggagtgcattgaggccaatggtgaaaaagaaaatatcttcagataaaaagtagaaggaagctttctgagaaactgctttttgatatgtgcattcatctcacagagataaactttccattgatgcagcagtttggaaacaccagtttgtcttttctgtgagtggacatttgggagatcatagaggccactggagaaaaagcaaatatccagacacaaaaactagaaggaaactatctgagaaaatactttgttacgtatgcattcacctcgaaaagttaaacctttttttcattaagcagtttggaaacaatgattttgtagaatatgtgaaggcatatttgggagaattttgagactatggtgaaaaagaaaatacagataaaaactagaaagaagctttctgagaaactgctttgacaggtgtacattcctctcacagctaaacctctcttttgatagagtagtttggaaacactgtttttgtccattctgtgaatgtacatttggaatctcattgagaccaattgtgaaaaagtgaatatccctggataaaaactaaaaaaaatctatctgagaaactgctttgtgatgtgtgcaatcatcttgcaaagttaaatctttcttttaaatcagcagttatctgcaaatggatatttgggagcactttgaggcctatggtgaaacagaaatcatcttcacataaaaactagaaagaagctttctgagaaactgctttgtgacgtgtgcattcatcttacagactttacctttccttttcatacagcagtttggaaacactgtttttgtccattctgggaatggaaatttgcaagctcattgaagcccgtggtggaaaagcgaatatcccaggatataaactagaaggaaactacctgataaataactttgtgatgtgtacattcaggtcagagttaaaccatacttttgattcagcagtttgggaacacattttttgtccaatgtgcaaatggacaattgggagctcattgaggaaaatggaaaaaggggaatatcccaggttaaaaactacaagaaagctatctgagaaactattttgtcatgtgtgcattcacctcacaaagttaaacctttcttttcattcagcattttggaaacactgtgtttgtacgattggtgaagggatatttgagaagttaaactttcttttcattcagcagttggcaaacactgtttttgtaaaacttgcacaggtatatttgggagcctatgatgaaaaagaaaatacctttatgtaaaaactagaaagaagctttctgagaaactgatttttgatgtgtgccttcatctcacagagttaaacctttcttttcattcagcattatggaaacactgtttatctagaatctgtgaagggatatttgggagcacattgaggcctatggtgaaaaagaaaatatcttcagtgagcagttttgaaacagtatattttagaatctgcaaagggacttttaggagtgcattgaggactatggtgaaaaaagaaatatcttcagataaaaaccagaaagaagctttctgagaaactgctttgttatgtataaattcctctcacacagttacacctctctttacatacaaaaatttgtaaacactgtttttgtccatttctgtgaatgtatatttgggagctcattgaggccaatggaaaaaatgaatatgcttggatcaaaactacaaggaagctatctcagaaactgctttgtgatgtctgcattagtctcacagagtgaagccattcttttcattcagcagtttggaaacactgtttctgtagaatctgtgaagggatatttgggagcgtattgaggcctatggtgaaaaagaaaatatcttcagatgaaaactagaaagaagctttctgaaaaactgctttgggaggtgcgcattcatctcacaaatttaaacctttcttttgattcggcagtttggaaactgtatttctccgttggataaatggacatttgggagctcattgaggccaattgtgaaaaagcaaatatcccaggataaaatctcgaaggaagctgtctgagaatctgctttgtcatgtgtaccttcatctcacagagttaaacctttctattctttcaacagttggaacactatttttaaaaagtctgtgatgggatatttgggagtgcattgagacctattgtgaaaaagaaaatgtcttcagaaaaaaaccagaaagaagttttctgagaaactgctttgtgatgtgtgcattcctctcagagagctaaacctttcttttgattcagtagtttggaaaaactgattttgtccattctgtgaatggacatttgggagatcattgaagccaatggtcagaaataaaatctcccatgataaaaaatagaaggaagctatctgagaatccactttgtcatgtgtggattcacctcgcagagttaaacctttctattcattcagcagtttggaaacactgtttttaaagaatatgcaatttgatatttggaagctcattgaggactatggtgaaaaagaaaatatcttcagataaaaactagaaggaagctttctgagaaactgctttgtgaagtttgcattcatctcatagagttaaaccattcttttgattcagcagtttggaaacactctttttgtcaattctgcatatgaacactgggatctcggtgaggccaatggcaaaaaagtgaacatcccaggaaaaaaactagaagaaatatatctgagacaccgcttcacaaagggtacgttcatcccacagagttaaaccttttttattttccattcagcagtttggaaacactgtttttgtataatctgcaaagggatatttgggagcaccttgaggtctatggtgaaaataaagtaaattcagataaaaactagaagaagctttctgagaaactgctttctgatatgtgcattcatctcacagagttaaactttctttgattcagctgttttgaaacactgtttttgtccattctgtgaacggacatttgggagctcattgaggccaacatcaaaatattgaatatcccatgataaaaactacaataaagcagtctgagaaaccgttttgtgatgtgtgcattcatctaacagagaaaaacctttcttttgattcagctgtttggaaacaccgtgattgtccattgtgcgaatggatatctgagtgctcattcagtccaatagcgaaaaagcaattatcccaggataaatagtggaaggaagctgtcttagaaaccactttgtgatgtgtccattcatctcccacagttaaacctttcttttgatacatcactttggaaacactgtttttgtacaatctgggaaggggtattttggagtgcattgaggtctatggtgaaaaagaaaatacgttcagttgaaaactagaaagaagttttctgagaaactgctttgtgaggtgtgcattcatctcacagtgtaaaacctttctttagattcagcagtttggaaacactgtttttgtccattctgccaatggacatttgggagcacattgaggccaatagcaaaaaagtgagtatcccacagtaaaaactagaaggaagcaaactgagaaaccagtttgcgttgtgtgcaaactgcctcccacagttaaacttttcttttgattcagcagttggagacactgtgtttgtccattctgtgaatgcacttttgggagctcattgaggccaatggtgaaaaaagcaaatatcccaggatgaaaactggaaggaagctatctgagaaactgcttcatgatgtgtgcattcataagtcagtgttaaacatttctttacatttagcagtttggaaacactgtttttgtagaatctgtgtaaggatatttggaaatgcattgaggtatatggtgaaaaagaacatatcttcaaataaacttagaaagaaactttctgagaaactgctttgtgacatgtggatttatctcacagagttaaaactttttctcatacagctcttttcaaacactgtttttgtccattctgcaaatggacatttgggagctcattgaggacaatggcgaaaaagtgaatatcccagaataaaaacaagaaggaagctgccttagaaaccataatgtgatgtgtgcattcatctcacatagttaaacctttcttttgatacagcagttcagaaacactttttgtccattctgcaaatggacatttgggagctctttgaggtccatggcaaaaaagtgaatatccaaggttaaaaactggaaggaatctatctgagagcctgctttatgatgtgaacattcatcttgcagagttaaactatttttgattgagcagtttgtaaactctgtttttgtccattctgtgaatgaacacttgggagctcattgaggccaatggtgaaaaagttaatatcccaggataaaaaccagtaggaagatatctgagaaataacttagtgatgtacacattcgtttggcagaattaaacctttatatttattcagtagtttggaagcacggtttttgtagaatctgtgaagggatcttagggagcacattcaggccttcagtgaaaaagaaaatatattcagataaaaaccagaaagaagatttcagtgaaacagcttagtgatgtgtgaattcatctcacagagttaaaaaaattctatcattcagcaatttggaaacactgtttttgtagaaccttcaaagggatatttgggaacacattgaggcctatagtgaaaaacaaagtatattcagatgaaaattagaaagaagctctctaagaaactgctttgtgatgtgtgcattcatctcacagagttaaacttttcttttgattcagcagtttggaaaaactgttattgtccattttgtgaatggacattttggagctcactgatgtcaatgatgaaaaagcaaatatcacaagataaaatctagaaagaagctatctggaaactgctttgtgatgtgtgcattcacatcacagagacaaacgtttcctttcattcagtaatttggaaacactgtttttgtccattctggaaatgaactattgtaagctcattgaggccaaaggtgaaaaagcgaatattccaggataaaaccttgaaggaagctatctgagaaaccactttgtgatgtgtgcattcatctcacagagttaacctttctatatgtttagcagtttcaaaacactattttgtagaatatgcaaagggatatgtgggagcgcatcaaagcctctggtgaaaaaaaaatcctcagaaaggaaccagaaaaaagctttctgagaaactggtttttgatgtgggtattcatcttaaagagttaaacctttcttttgattcagcagtttgcaagcactgtttttctcctttccacgaatggacattttggggctcattgaggccaatggcgaaaaagcaaatatcccagtataaaaaggagaaggacacagatttgtgatgtgtgaattcatctcacagatttaaattttcttttgaatcagcaatttggaaacactatttttgtaaaacctgtgaagggatattt

SEQ ID NO: 470687 - DNA, 685 bp, Homo sapiens
tgatcgacgcccccagtgttgttggtgagtaacctagactgtgttccctctgtgggggtgcctgttctcgcatgactgctgtagcatgtatgcccccagatgtgtcatttgtccctgaacaaggccaagtggcaggagcccgggaaggagattatattgtctccattcagcttgtggattgtaagtggctgatggtgagtgaggttatgaagctgctgaagagctttggcgaggacaagatcgagatgaaagccgtgagcctcctggactccacatcatccgtgcataataagagtgccacatactccgtgggaatgcagaaaacgtactccatgatctgcttagccattgatgatgatgacaaaactgataaaacccagaaaatctccaagaagctttccttcctgagttggggcaccagaaagaacagacagaagtcagccagcaacttgtgcctcccatcgctgcaggctgcccagagcctgcaatgtgtgaatgtgtgtcataattgttcacaaagggctccatcatgttaagcatttcctaattatttgaccatagaacttcttttttcatggcaagtctactaatagctcctagaacagagttccaacgatcattatgtgatgaacactgaaggcctttttcaaaagctttgaaggttcttgtcaaaagtacatgcatt

SEQ ID NO: 470688 - DNA, 711 bp, Homo sapiens
gtggcctcaatatggagggcagtcaccatctcccagtgtctctgactgctgcacgcacacttggcaacctgtgctcagaacctaagaggacccctgagagccttgtggaggctgggcaaacgtggtggagtctgggacaggaggggaaccagagtctgagtggaggaggccacacagcacaacccgggccagactgcagctctctgctccagggcccacctggagctgccatctgccagccctgctttcctgtagaagatcccacccataccagccccaggaatctaggcaaggccagagcacctcaggagcctcctggaaatcgcagcacagacaacggatgcaagaagaaagggagtgacagcttcagatgcgagaggaaaggaccctggaacccagggctgcatcctgctcaccgccatgaaacatgggcatgcaggaagccatcctcagtcctatcagcccccttgagagtcaaccccaaaaacactctcggagaaatatttcagcaagaaaaaggaactggggagtatgctgccagattgcggtgagaactaaaagatttatgtatgcagatcatattacctgtcacgtagtaggcactcaaaaattattacttgtcttcttagggttgttatgttaaataatgttatgttaataacatatgtaaaactgcttcttaaattataaagtgctatgcaaatgtgagtt

SEQ ID NO: 470689 - DNA, 530 bp, Homo sapiens
tttttaagataactatagtagtagtgagctccccaggttggtagtactccatgtttattgctgtacaacaatgacagcagcacgggagcttgttactgggcatgaagtgggaagaaaagtgaaaccatgctgtagagttaaagcaaaattatgcttttccctgagccccttatgtcttgaactgctctccatatttcttcttcccaatttcaacgtggggaagtctataatcttactgcaaagatcatgttccagacaagcagcattaacgtcacccaagaacttattacagatgaagaatctcaggcctgctgaatcagaacgtgcagcttcgaggagccacacccccgccccggctgatttattcggggaagagaagttcttttctattttgactgaacatgacattaaatgtgttttgcaaaattacctgtcccagattgttgtccatcctttatttctgtggctatattcgaaacagaatctttctcgtcactggtagcctgaatggggtttgaagcaaagtaatc

SEQ ID NO: 470690 - DNA, 776 bp, Homo sapiens
tggtgcagttcagcctggccaatgtggcaaaaacccatttctacgaaaaatacaaaaattagctgggcatggtggtgcgcacctgtaatcccagctacttgggaggctgaagcatgggaattgcttgaacctgggaggtggagattgcagaaactgaaactggaccccttccttacactttatacaaaaattaactcaagatgcattaaagacttaaaagtaagttctaaatgtgtaaaaaccctggatgaaaacctaggcagtaccattcaggacataggcatgggcaaatacttcatgactaaaacaccaaaagcaatggcaacaaaagccaaaattgaaaaatgggatctaattaaactaaagaacttgtgtgcagctttatttgggagtgtgcgtggggtacctctgagttgtaaaaatgaagaaaaaccctgaatttgcagtgtctcagaagcttcccaagtagaaataagtgttattacctttgtgctatcactgtttttattgacttgaattgtagaaataatgaattgtgtctttctgcttttgtttgtttttataaatttcttttttcacttgataaataaataaaattagtattttattcatattatcagattttccagtatagaccttatgaatttatagacacagaaaatgtttcttgaattactgactgagtagtaaatataacattttctgaagatttctttttttttttttaaataggaatgaaaagcactaccagcaactggacaaaaagcaaatggtat

SEQ ID NO: 470691 - DNA, 1663 bp, Homo sapiens
tccctcgtggcactacgcatcctccaaggtgcctgcattttgggggtcaaagacacatcattcacatgcggaggaaacaccttctttggcccagacatctgctggtgacaactcaggatgaccaaggagccttgcagatggatgacccctacatccctccagactgctactatctcagctacctggaggaggttcctctgtccatggtcaccgtggacatgtgctgtgggggcctcagaggcatcatgaagctggacgaccttgcctatgaaatcaaacccctccaggattcccgcaggcttgaacatgtttctcagatagtggccgagcccaacgcaacggggcccacatttagagatggtgacaatgaggagacaaaccccctgttctctgaagcaaatgacagcatgaatcccaggatatctaattggctgtatagttctcatagaggcaatataaaaggctacgttcaatgttccaattcatattgtcgtgtagatgacaatattacaacttgttccaaggaggtggtccagatgttcagtctcagtgacagcattgttcaaaatattgatctgcggtactatatttatcttttgaccatatataataattgtgacccagcccctgtgaatgactatcgagttcagagtgcaatgtttacctattttagaacaaccttttttgatacttttcgtgttcattcacccacactacttattaaagaggcaccacatgaatgtaactatgaaccacaaagttattgctgccgaagtgactgtcgcttaacaccggggagcatctgtcatataggagagtgctgtacaaactgcagctactccccaccagggactctctgcagacctatccaaaatatatgtgaccttccagagtactgtcacgggaccaccgtgacatgccccgcaaacttttatatgcaagatggaaccccgtgcactgaagaaggctactgctatcatgggaactgcactgaccgcaatgtgctctgcaaggtaatctttggtgtcagtgctgaggaggctcctgaggtctgctatgacataaatcttgaaagttaccgatttggacattgtactcgacgacaaacagctctcaacaaccaggcttgtgcaggaatagataagttttgtggaagactgcagtgtaccagtgtgacccatcttccccggctgcaggaacatgtttcattccatcactcagtgacaggaggatttcagtgttttggactggatgaccaccgtgcaacagacacaactgatgttgggtgtgtgatagatggcactccttgtgttcatggaaacttctgtaataacaccaggtgcaatgcgactatcacttcactgggctacgactgtcgccctgagaagtgcagtcatagaggggtgtgcaacaacagaaggaactgccattgccatataggctgggatcctccactgtgcctaagaagaggtgctggtgggagtgtcgacagcgggccacctccaaaaataacacgttcggtcaaacaaagccaacaatcagtgatgtatctgagagtggtctttggtcgtatttacaccttcataattgcactgctctttgggatggccacaaatgtgtgaactatcaggaccaccactgttaagggatggacagttactaa

SEQ ID NO: 470692 - DNA, 583 bp, Homo sapiens
ggcacaggatttcaggaagttcaggtgacagtctgggtgttacccttcaggaggtttgtccacaccatgaggtctggatctgggattcccttctcatcaccctcaatattatggtcccttgtgaatcaggtccagctgtggctgctcctcatgggctcttctcagttggcttcctctgtgtttgcagaagtcctgaggagagaggagtgaactgcatggtagatgctgctcacaaccaccagggggcgctcaggacacgagggggcggtcaggacaacaagggcgggctcaggacaacaaaggcaaactcgggagcgcaggagatgctcagaacagccgggagcattgagaaccagcaggaggtgctcaggacaccagggggtgctccagacaccagggggtgttcaggacaccaggatgcgctcaggaaacaaggaggcgctccggacaccagggtccctcagaaccaccagggggcgctgaggacaccagggggcattcaggatcaccaaggaatgcccaggaccattagggggcgctcaggacaccaaacggtgctcagaaacaccaggtggccctgagg

SEQ ID NO: 470693 - DNA, 711 bp, Homo sapiens
ctgagaactgggaagacgacaggatgaccagctgcagagaggagctaccatttctcctgagaactgggaagacgacaggatgaccagctgcagagaggagctaccctctctgctgagaactgggaagacaacaggacgactagctgcagggaggagctaccttctctgcttagagctgaacactcaaccagtcaacctgcctacagagaggagctactcactgggggtctcctctgagatgctcgaatgcttcatgaagctagtctttgccttgctcacccaccacatggctgcatacctcattctttccagatgtaggacacgaacttgggcaaagtcgccgctggccacagagggttctggccagaaaaagcaacaccccagtgatcccgaaacaactatgcagtatgagaagaaaaaaatgcactcttttggtaccaccgagagtaaggcactgctataaagatacctgaaaatatggaagcaacattggaactagtttgaggttgtagtacaaaataatatttttctatgtgtctgtctgcctattccaatattaaaatacaaacatatttcaattcgtgttttggcaaaactgaatgtaaatgcaattattggcatatatgttatttaaatgtataatggtatttaattttaaatatcagtctgttattaatgaatagaataataagacaaacttcactttttaaa

SEQ ID NO: 470694 - DNA, 720 bp, Homo sapiens
atcttcaatactatacaacgagtggcacctgctccaggtgggacatcctgaaaacctcactaggcatgtcccacatcgccctggagctgtctcaggggagcagtctcctccagtgtttagaggcacagacacaggttgtctctgtgtttgcaggtgcccagtgtgaggtgcagctggtggagtctgggggaggcttggtacagcctggggggtccctgagactgtcctgtccagactctggattcaccttcagtaaccactacatgagctgggtccgccaggctccagggaagggactggagtggatttcatacattagtggtgatagtggttacacaaactacgcagactctgtgaagggccgattcaccatctccagggacaacgccaataactcaccgtatctgcaaatgaacagcttgagagctgaggacacggctgtgtattactgtgtgaaacacacagcgaggggaagtcaatcaacatattgtcatttattcaattcgtagactgactctgatatgaaacctcaaagttttcacgtacgtatggagagagagagaggaaggagaaagattttatatctgagtcagtccattaagtaaataaatgagaatattttgatttattttcctgttgatgtactttaaatttgtttccattttatgaatattataggcaaagctgtttcaaatatattagtgtaggttttcctatatt

SEQ ID NO: 470695 - DNA, 2849 bp, Homo sapiens
gagaaccctgaagtggggggcctcatggcggtcctggctgtgattggaggcatcgatggtcgcctgtgcctgggcggccaaattgtgcacgatgagtttggagaaggcaccgtgactggcatcaccccgaagggcaaaatcaccgtgcagttctctgacatgcggacgtgtcacatttgcccattgaatcagctgaaaccacctcagagacatgaagagggctttagcaacctagaagaactggaaattgtcaagagaatccgaacccagctaccatatgagagagttcaacttatgttcaatgtgaatgccatggcaatattaaaagatgatcaaacaggtcttcatcctcatccttttcatgggcagggtgtggataaggatgaagaattgttggttttgctaagtggacgtgcacagttcaaacccctgtggtgcaaaggccaactgtatagccattgaatagcaatttatttttagaaattaacctcactaaaatactctaagaaggatgccaagaaaaaaagtgaataagtatttttggttcatctattacatcatttcatttcattatttcatttcttttcatcatttcatttcatttcctcatttcatcctttcatttcatcatttcatctcattttatcatttcatttcattctttcatttcatttcatcatttcacttcatctcatcatttcatcatttcatctcatcatttcatttcatctcatcatttcatttcatctcatttcatttcatctcatttcatcttttgatctcatcatttcattatttcatttcatcttttcatctcatttcatcaattcatcatttcacctcatttcatttcacttcatttcattgtttcatttcatttcatcatttcatttcatcacttcatctcaacatttcatttcgtcatttcactttatctcatttcatcatttcatctcatgatttcatctcatttcgtctcatttcatttcctctcatcatttcatcttttcatctcatcatttcatctcatttcatttcaccatttcatttcatttatttcatcattgcatcatttgacttcatgtcatcatttcatatcatttcatcatttcatcttttcattccatcatttcacttcatttcatttcctcatttcatttcatcctttcatcatttcatctcatttcatcctttcatttcattatttcatttcataatttcttcttattgttgcatttcgtcattccatcattttatcatttcatctcatcatttcttcatctcacgatttcatttcatcccatcatttcatctcattttatcttttcatctcgtcatttcatcatttcatttcatcttttcatctcatttcatttgatcatttcatcaattcatcatttcatcatttcatttatttcatcatttaatcatttaacttcatttcatcacttcatttcatcttttcatatcatttcttcatttcaccatttgatcttttcatttcatcatttcacttcatcatttcatttcatcatttcatttcatctcatttcatttcacttcatttcattgtttcatttcatttcatcacttcatctcaatatttcatttcgtcatttcactacatctcatttcatcatttcatctcatgatttcatttcatctcatttcatttcatcatttcatttatttcatcatttgacttcatgtcatcatttcatatcacttcatcatttcattccatcatttcatttcatttcatcatttcatttcatcctttcatcatttcatctcatcatttcatcctttcattatttcatttcatcatttcttctcattgttgcatttcatcatctcatcatcatttcacttcaactcatcatttcatcatctcatgatttcatcatttcatctcatcttttcatctcatttcatcatttcatttcatttcatcttttcatctcgtcatttcatttgatcatttcatcaattcatcatttcatcattacatttcatttcattatttcatcatttaatcatttcacttcatttcatcatttcatttcatttcatcatttcatgtcatttcttcatttcaccatttgatcttttcatttcatcatttcatcattccatttcatttcctcatttcatttcacaatttcatctcatcatttcatttcatcattccatttcatcatttcattacatttcatcatttcattacatttcatcatttcacttcatctcatcatatcatccttcattgctttatttcatttcatctcatttcatcatttcacttcatctcatcatttcatcacatcatttcatttcatctcatcatttcatttcatcttttcatctcatttcatttaatcatttcatttcatttcaccttttcatctcatcatttcattagttcatcatttaatttcattttttcatcatttcttccttcacttcatttcatcatttcatttcatcatttcatatcatttcctcaattcatcatttcatcttttcatttcatttcatcattttatcatttcatttcatttcagttcattatttcatttcattatttcatttcatttcaccattttatgtcatcatttcatcatttttcatcattccatttcatttcatcatttcatctcatttcatttcttcatttcatcatttcatttcatcatttcatcatttcatttcatcatctcatcatttcatttcatttcactgatacatgtatttaattgctaatgcgatgcccaggaaacaccctatttccctttgtaaaacacctccttcaacaaaaggcaacttctcatggctggttaagtctacac

SEQ ID NO: 470696 - DNA, 710 bp, Homo sapiens
aggacaaggggctcacaggacacaacgatgtgcttagtaaaccaggggttgctcacaaccaccagggggtactcaggacaccagggggtgctcaggaaaccagggagcagtgtccagtgtgaggttcagctggtgcagtctgggggaggcttggtacagcctggggggtccctgagactctcctgtgcaggctctggattcaccttcagtagctatgctatgcactgggttcgccaggctccaggaaaaggtctggagtgggtatcagctattggtactggtggtggcacatactatgcagactccgtgaagggccgattcaccatctccagagacaatgccaagaactccttgtatcttcaaatgaacagcctgagagccgaggacatggctgtgtattactgtgcaagagacacaattgatgcttacagagatgaaaagccctcaaccattgtcaccaggatcagagtattgaggaaactcagggatacctgtaaagaagctatttaggacatttttaacatcctgttgaatatttctgcatagcacatcgatcccctaaaatacttcgctgtattggcatgtgataaatcagagtataatgctgaagaagatatttggcagtaaggacagggtagcattcgtgtgatactgatgacttagagaattattttgtaatttctcctgtaaggtatgcacattgctcactc

SEQ ID NO: 470697 - DNA, 670 bp, Homo sapiens
tcctgcctaaccctcacaaccatcggtgagacggggtctccctctgtcacccaggctggagtgcatgattacagctcactatagcctcaacttccctgggctcagcatcacttcacttccatccctgaaggtagtgaccgtgtcctggagccacaatcttccagtcatcacaggggccccagttgcagtttcttctcctaaagacctctttggagacagagggcagcaacctgtctactgtctgcagggaatgcccctccatgaaatcactgcactcatgacagttcaagatcaagtaacaaacggaactatccgctgcacacctggaaggaggccggcactcattcagccgccagatgcctatccaggatgcactccctgtgaggcactgctcatccactccttggggctggggctctgtctggcaggggagctgccaggacagccagcagacagaacacagacacctgagctcaaccaaggcaggtgctgggagcacacaggaaagaggccagtgacagtctaatttgtctcacgcttgtgtagccaccctagctctcttttaataactcctcacatggtttctttttgcatctttctactttcaactcttgtgtctttgactctaaagtaaatctctcacagatcattttattttattttatccatt

SEQ ID NO: 470698 - DNA, 461 bp, Homo sapiens
ggtcaggcatgtgggtcaccatgtctgtcatgttgtcctcagacgtcctcaccagtgtccgcccaaagaccagggccaggttccggggttccatctgggcagcagggaaagcaggtcactgtcaacatcctgaactcagtcctccctcactctggcccctaaggcctctgtccccaactacatcctcaccagtccccagcttagagggtggacacccccttgtatgggcatggagatgcttgatgagtagagcacaggccagatttcagcccctttcatccccaggcccagcagccatgagcagtgcccaacctgcacacctatacagggcagccctgagtgctaagttggaggatggcaatgcatcggatacggggagccggggttccctgcctctggaaagccctcagaaactcaggagatggctctctgggggaaagcactgaccagcatgtaggagc

SEQ ID NO: 470699 - DNA, 470 bp, Homo sapiens
cagtatgtacattgccacctaccggaatgagaactcctcaaccatgggcaccagcatcagagtcgtgaggaagctcaggggtgcccgaaaagccacaaccttgcacaaaggcaaccacaacaataaaagaattatttctgtgaaaatatctgcacagcaactgcctgtccaaccttacactgatgtcaaccttgttattgatgcttctagcctgggatcattctcatcaaaatgtcattcagatgctgcgtatgacaaaaattgtgtttttcagtgcagtcatgttctagtaaagccctcagagaccctctccttcacctgtgccgcctctggatttctgatcataaccagtacttcctcctggagctggatctgccagcccccagggaaggagctgaagtgggtcaggtgttttccatgtagttgtgcagttttgagtgaatttcttcatcctgagttctaatttgatt

SEQ ID NO: 470700 - DNA, 607 bp, Homo sapiens
agtcttttttattttctagtgtggaccctgttcagggcaatgggctcccatctggcccagggccaggtctataaatgctgtccaagagcctacgcctggacgtggggacccacgagcccacttggaccctcagctgcaggtctgttggagtttgctagaggtccactccaaaccctttttgcctgggtatcagcagcgctggctgcagaacagtgggtttttgtgaaccgcgaatgctgctgtctgatcgttcctctggaagttttgtctcagaggaatacccggccgtgttcaggggtacatgtgcaggtttgttatataggtaacttgtgtgtcacaggaatttggcatacagattcttttatcaaccaggttcttgattctaaaaatgcttcattaggggtattcaatggcaatattctgcaccttttttgccatgtcatgacatgcactatcaatgctcttattactactggaaataattaatagtgtctgaatttaatcaaattattgagcccaatacagaaacttcagaaccaaaaaataagatttatccaggtcattcctataaaaccactcttagtaccaaaatctgtattagccaaga

SEQ ID NO: 470701 - DNA, 1037 bp, Homo sapiens
tgggattaggaggtggggccttcgagaggtgatgaagttaagaagcagagccctcattaatgggattcgtgctttataagaggccctagaaagcccccttaccccttccgccatgtgagggcgcacgtagtcgacatgacgagacctgtgtctataaaaaaaaccacacatagccgaggaatagatgtggagtaaacacatgaagttccttgtcacagagctaaggagtcatggaatccaagttaaaggtatgggaagacatagaggcacatgcatgagaagaaggatgagaacaatgaccatgatgatgatgatgataatcatggtagtgacagcagcaatgataatgactgcgaagaagcaggagaagacggtggtgatgacgatgatagtaatgacggcgaacctggagacgatggttgcggtggtggtgatgacaatgatggtaatgatggtggtgatgatggtggtgatgatgatgatggtaatgatagtgatggtggtggtgatggtggtggtggtggtcatggtggtggtggtgatggtggtggtggtggtgatgacaatgatggtaatgatggtgatgatggtggtggtgatgatggtggtggtgatgatgatgatgtggtgatggtggtgatgatggaggatgatggcgccggtagtgacgccggcggcgacgccggtggcgccgatggcgccgccgtcatcaccatcaccaccatcatcactaccaccatcactgccatcatcatgtgatgactctcaatactgtcctcatcatgtgtgacttggactgtggaccagcccctcgggctctgctctgctgacctatattctttgtctcttgttcctgagaagctgggagttgagacccagtaaggtgttgtacagacacttgtgaccccaaattccatgagacagaggacctcccattttcttttccttattaccgcatgtcatcttcctgcacaaagtggataagaccttgatgtctgtctccgtttcccaaaagagttaccaagggggtgttttcc

SEQ ID NO: 470702 - DNA, 1223 bp, Homo sapiens
gagtctgttctatcagtaattgcaaaagggaagcagcttctccaagagtttgttctccgtgactgattcactgtctagtctgtaggttctctcccaagggtgaatctgaaaaaactgccctagtttactcatcctggggactcagtggcttttgcctagaagggtgggccttaaactgtgctaacattaaataatgacatcgtgttctcaatccgcaagaggaaaatgcaccataagtgtgcctgggtggcccaggggctgttggcacccacgctgtgtccttggagcccagctctgagcagtgtactcacccatggggccaggcttggggtgaattctagggacagacagcttgctgtcctcagaactgccctctgcttcaaccaccaaatattgccagaagcatcctgctttctcatccctcaggatgagtctcctcccagagggtcacagtcccctgaatggagacatattcagctctctcatgagtatgcctgtactccagcagtgtccagagcccagtgtcagatggcagtcacgttacaagcgaagcaagagaaaggcctgtccttggtggaggagtcagggcaggctggggtgtgctgcagtaatgggaggctcacaaatctcagcggctttgcacagtctagaatgttcttgaaatcctaaccctcaatgtgatggtgttggatggtggggtctttggaagagctgccttgccatgctgtgcaaaaaccccgtctcgttggtgagcttgtttattccttttatcctccatctcccctcccactcttcactgacaatcattctaatatattcaatgtaaacctttttatttgtagcattcagctaaaaggcctggggtctgggattcctggatttgaatctcagatctgttattgattagctgtgggacttggagcctcagtttatgtcataacgaaccttaccttagagggtggctgtgttctatttattgagctgggaatgtggggaaactaactctgagttttaaaagaatttgagagtgtggctagagaacagacagtgtctattactcccactggtaaggatcccttgacccttgacagtatattagttggaatttgctgcagggttttgcaagggagaggcaaagtataccgggtggcttgcctgagatgaactaggaagttcaaaaacttaggaaggggccaagtgatgaggggtcctgaatgtaagct

SEQ ID NO: 470703 - DNA, 522 bp, Homo sapiens
aggccacatgaaggggcggagcctgtcatcccacccacgtgggctccctcagttcagcaacagcaggctgagggttggggagctggaaccaagggcacagttcaccctacacctgtgtacatggacaatggcttcacctccgtggttcagcctgttgactgccatgggaaagcagctctgcgtctcaggcagggaggagttctggttaggcaatactgcagcatcagcaggtgctctggtgcgcaccccatggacagattcagcaaggcgcacaccccagcaaccacagatcaatttctatagctacagattagctcaacctgtcctagaacgtcatagaaatggaatcacgcagcatgtaccctattgcatctgacttccttcacaaataataatgttttaaacttcatagacagtgtttcatatatcaggaatgtgctcctttttattgttgagtagtgtcccatgattaaagattgcaatgagtgcaattgcctgcaatgcccataatgtggcttttac

SEQ ID NO: 470704 - DNA, 3294 bp, Homo sapiens
cctccaagatcttccctccttagagcgaatattccctgcaggattttaaacccccattgaccgagggtaactgaaacctcggaaagcaaaactgcagataggcggggactactgtagatttatctttcttggcttttaatttttttctttcttttaatttttacttaattataagttgcaattaaaatgcatcttacatacaggaatagggtacagagtacacaaaccttaaatgtatagcttgaagactgtcacatatgtggacacccagagggtcctccctgcaaatcctgcacccacctcagaatactatcccagagatggccacacttccaatttcgactctcagtgtatttggaaaaacaccagattcctaaatcgtgttcttgacgtggatgccctgacctgctgtgatggcaaattcacagtgtttgccaccgccttcctcctggcagacatcactagtccctccttcagctccctcctgcccaggctcgacaaaacatctaaatcaccggttttcagcctcagctgcacattaggatcacatgggagctttgaagaaatcccgccccggctaccctgtgtggttccaggaccagtgactctggcctcccttgtgctagtcactgatgagaccctcagccccatccagactcgctgaatctgaacctgccctttagtcagatccgcaggggttccgagcacgccgctgggctggaggcattccgaggcccctcgcagccctcagtctgtgatttcggctccacgagctccctccactgcgaatgcataggggttttaagagatgatgcggatcagggactggctgtttttatattaatatggccatttgtgtgtttccctttatttttttaaagtttgctgttaattaattagcagacatgttttctctgtattatctgtaaacaattctcttaattctaatcttatccataaagctattctccccaaagaacttgtgacaattaaaaaaaatcttcatgaactccacttcccagtaaaagttcatgcagattcaagtcagaggcaaagacccatccgtggggtcatttccactgaactgcgacctatagggggctgcctgagtgtaggttctttatgtccgcgaggggaggctccgtaataagtgacactgagctctatcaaggatcatccgatgtggatagccttcgactctcatcactactgggaatctgtcccaatgaaataacccaaaatatggtaaaaagctctacaggggaaatatttctgtaacagagatcaatttaacaacgcgaatgcccaaaaataggaaggaagatggttttgtgttagaatattgttcagcactttaaaatactcatgtaaaactgcatcgaggttccaactacgtgtatatggaaagaaattcacagaaaaagttgaggaagaaaaaacataagacattaataaaagatgtatcacagaaaagaactcaaccacaatcctgccactctatttttcaagttttttatatttgcaaaacgttaatattttaattatgaatgtatagatactttaaatgtaagaatagcctaatgccactgggaacggcatgtttgtttatattacagtgatttttcagtgattgaagattttatttagtaattaaaggaagaaagtaggaagaaaacctatggacaatactgtttcctgatggcagaatttcctccaaagcttgctgtggtgtcactagggaagctggagggaatttaagcccctccaaaatcgagctgcagatgttgtcttgaactgggcgctgctgttcctttgctgggaaaggttttcttccttgagcggctgatctcttccttcatcagaattaccaaggttctggtcagccaggtcctctccaaaaccacagccattttcaggagacaaaagcagcctcggtttataaggcaccactgaatggcttcatggcatgcttgggaattacaaatgtcaaatcaaacaacatgaaattgtgcccttcttttgtgtgcgttcattagaaggacttggaaaaccaaatcatgatgtatcggtatttgttttttatacagaaacaatattgaaaaaaaggcccctcgatgaattcgtaaattaaggcaaggagatgcttacttgaaatgttgaaagcccccacagatctaatactccaaaccaaaaattatatgcagcactgatagcagatgttttcgtcctatctaaatatgaaaaagtattatatgttatgttgacatttaggctaaatctttcccttataaggtgtttgacataaatagcttttgttatgtaactcttcaatagaaggcatacacacacatttcttaaaggtcccagctgctattgttatcactggaggcataaaattggaatcctaacttccaatatcaaatttgagcacaaaccctataaaatgtatcttgtcagaatgtgccagaaccgctaagctcttttcggcggaacaaattgcagctggtgtccttaaaggtcgagaatcaaacttgctgtatcctcagggtttaggcagcaaattggtcccagttttcaccctgccgcagggctggctggggagggcagcggtttagattagccgtggcctaggccgtttgacggggtgacacgagcctgcagggccgagtccaaggcccggagataggaccaaccgtcaggaatgcgaggaatgtttttcttcggactctatcgaggcacacagacagaccatggggattctgtctacagtgacagccttaacatttgccagagccctggacggctgcagaaatggcattgcccaccctgcaagtgagaagcacagactcgagaaatgtagggaactcgagagcagccactcggccccaggatcaacccagcaccgaagaaaaacaaccagaagaaattattcttcagcctgaaatgaagccgggatcaaatggttgctgatcagagcccatatttaaattggaaaagtcaaattgagcattattaaataaagcttgtttaatatgtctcaaacagaaaatgtcttttgaagagcattttaaacctgatattaaaatctggccgagcgcatgtcccggggcgtaattggtgggcacaggaatttgggtcctttgcaagaagtgtggtattctcccttcacaaggtatttcttccccaatgtataaaatgaaagcagaaaggtttttaggtagctatttaaaactgttcatgcaacataataaatataagacaattgacccgtgttttaatgtttatccgtaagac

SEQ ID NO: 470705 - DNA, 579 bp, Homo sapiens
ccttcccccatgagaatgcaggttccattaagcaggtagtttttgcctgttaggtctgttaatggtggagaatccgtatccagaaggtggaccaacgagtgaacctgtgccacccaggatgggcgggggctgctgtccattctctgctgtgcccaagcgcatggctcctccttggagcttgggcaatgtccgcagccattaccccagtgacatcacagcctcaagggagatatttcatctccacttcccagttccaaatacaggcattaacacgaaaggagtgacgcatggaagtttcacatcaaggttccaagctcctggcgggaacttccacatcacccttagaaaggttgtaagtggagaaccttctggggcctggggagttgtctgtagtgcccacgtggtctcaggaagggctgaggagctcatggcttccgtgggttggatgtttgtgaagttggtcccctgtggaagacacagaggctcagtgtctgaccactgcgctgatttgtctgaagtgtcccttggccacaatgggaggaagagacaagggccctaccctgtgaaaaaatgaagaca

SEQ ID NO: 470706 - DNA, 492 bp, Homo sapiens
ccttcaaatgcgattggccctagcatcaggtctgcattcccctcccctgccctttatccttaccaccattaccaccaccaccaacatcatcatcatcaacaacaccaataacaacaccatcaccaccaacaccaacaactttatcactactaactacaataatatcaacatcattaatatcaacatcatcatcaccaacattgccatcatcaacaccaatacaacaccagtcaccaacaccaataacaccatcaccctcaacaccaacaacaccatcactaccaataacatcaccagcaccaacaccagcacaacaacactatcatcaccaacagcaacaccagcactgagctgagagttttaagtgcattattttgtttgagtctcccgaaggagaaccgtgagaggggtactgctgtgacagacacccccattttggagatgaggaactgagttgtagaacactcctgttaatctttccgggctagaccc

SEQ ID NO: 470707 - DNA, 817 bp, Homo sapiens
ccaggtagcagatgcctcacagtcaagttccgtcttctagctaagtcagcttgcccagccttcttgggacatccgtctgttccaccctctgataccatgcatcaaacttcagatctagagtcccctgacttcttcaacacactctatcctggccgccagcatatgagtccctggagccccacagctgcctacactaatacaggaggcttcattgatgacaacagtctgcaagtaggacaggggttgggcaccggagcacgggaggggcactgctgcgctcgcatggagaagaccccagggaagctcgcaggacagaccagcagcttcctggctgtagaggaagggaagtgtgctcagaatgggctggcactgggactgtggaagaaccattcccaccggccgtcacaggcatcattgggctttgctgggcatcactgggcatcactggacatcactgaacaacactgggcaactctggacatctgggtatcactgggttttactgggcatcactgggcttcactgggcatctggatatctctgggtatcattgagcatcactggaccttgcgtcattgacgggctggcctggtatcgggatcatatcaccatttggggagcaatttctatgattatttccttccttcattttactgcatttagtcaaccttcaacctgtttttgcccagtggaaactctcctctgctttctactttcttggtatagctctttagtatagaaaaattaagggtttataaatgtcattgcttgctttcttgtgacataattctctaaattgaaaaaaaaaatgcagaag

SEQ ID NO: 470708 - DNA, 669 bp, Homo sapiens
ggtgcccctgttacctccatttcacagatggggaaactgaggcacggtgactcaaggtcacatgctgaaggctacaagctcactgggctcgttctcggcggctctcatccccaccttccccatggcccctggatttcgccctggtgcagacgcttctgcaaaggtcctcaaagaattgaactctgctcctcactgggagaaagttgcacagcagctgctttgcatggaggaccttctgctcagacctgcagcctggatggggcagtgtctcaaaatgattgtcccttttatggatgaggagatggaggcccaggaagtaatctgccaacagccctaccaagcccaggcagccggctggacctccgtgtctgcatgtgaggtcagagatggtcccactgactccgtcctgctggggccactggggacatctgatagggagggatccgtccacagctctgcccagagtgacctctgacatggttcagtctgcaaagctccagcatgggcagccataaagctgagagagtgcagattccagggaagattgagccgtttatcgcaggaaagcctccatcattgttgtcaacctaaacctctggcaccgtgcgtgacccgcagctccagattctgatctgagcctctaggctccgggatggagaaaggggaccc

SEQ ID NO: 470709 - DNA, 901 bp, Homo sapiens
agtgaaaattagttaaaaggttttccaggtgtggtgctgactcagcgccagccaaatcctttctctgggggcacagaatctgagacagaacgagaaggaaaggttggtagcagaggcaggagctccaggtcgtgtcaggagagacagaggcagagcaggtgcctcatgccatgccggagaagtcaaggggccggcgactttggcttgtggagtggggacaggcacccgccgggggctcctgagtggctgtccagcccctgcctccctgaagccgatggaggttcctgagttgggtgctgtgggggccaccatctggcatcactcaggaccccctgatgctggggtgtcggtcatgtgatgctctgcagccacggcacccagatgaaggcacggcctcatgctgactcacagcccccacagcccatcaggatccaggaactgggcacaagggtccacgtgctttgtccctcagcagacagcctggagggccatcccaggcccagagctccccccggggtcggctgaggctgcttgtgaccacattccagccagctcctccctctgcctggccctgcgtcccccacacccagtggtgctcactcctacttacctttcacacacgagcatcccagaggggacacagccggcattgctgccccctccctgtgtcctcctgagccctgtgcttcctgtgtcagaccttggcttcttgagggaacccaggaagtccctgatgtttacagacacaagagctgagctcccagtaagggaagaaggggacttcccctctgagatggcggcggagccagagtgggcttgttaattcctccgctcaacatcgccatgcttctgtagcttggtctggagccaccatagctgcactcttggtcacagccttctg

SEQ ID NO: 470710 - DNA, 848 bp, Homo sapiens
caatgtccttttctgcaaaatgggcatcataataggagtgttcaacaactctagcatcaaggatactttattaaaaggttttcacagattagaaagtgggttaccagagattaaggaggtcgtgcaaaggattgacgaggatgatgatgacaacaaaggcaacaatcataatgacggtgatggtgatgatggtgataatgatgatgatggtgatgatcaaggggatgatgatggcgatgatgaatgtaatggtgatggtgatgatggcgatgatgatggtaatggtgatggtgatggtgatggtgatggtgatggtgatggtaatgctgatggtgatagtggtggtgatggtaatggtgatggtgatggtgatgatggcgatgatggtgatggtgatgatagtgatgatgatggtagtggtgatgatcatggggatgacgataatagggatgatggtgatgatgatgatggtcatcatggtgataatgatggtgataatgatgatggtgatcatggtgatgatcatgatgatgatggtggtggtcatgatgatgggatggtgataatgatggtgatatgtgaggccattgaacataaagttgggaagcagtgtgcaagctcatcgttattccgtatttccaccaaagtggaaacgtgagtatccttaagggcagggaggaaagtaaaatgtggggaaataattaggaagtgatgacttttgagtgtttattacgtttgttttaaatatagtttactccactctaagtgtgcataatgtaatgtttaacgatggcaaaattctttaagctttaatagttagctcttgccggagttggctccagccctca

SEQ ID NO: 470711 - DNA, 1378 bp, Homo sapiens
ccgccggcggatccagcagctcctcggggagggcgggcgggagcgcgggggcgggcgcgccgcggctcgctcgggagaagtggccgccgatgacggcagaggtgcagccagccccgcgcgcgcagccccctccccttcgccctcctcccccccgtcgtcctcttcctcctcctcctcctcctcctcccggcccgtccgcggcgcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactcactggagcagccgtatctgcaccagaacagccacaacgcccagccgagctgcaagttgagttgggagccgaggcgcctgtccccggaagtcgagtctgatgcagcggaccagctgggcgagccctccacttctgtgttcgaaccccaagctgaggggagcacagctcccaagtgttctgcccactctcccttcgaagagtgactacgctc

SEQ ID NO: 470712 - DNA, 1099 bp, Homo sapiens
cccgatccaacccagcctctctacatgtggaattccacacggcctgcaatcagatgttcaccaaatcacactttttcattgccaaacgccttggcagagacgtcactcccatttcagaaaggattcacgttcccaatctcatttcagacatccaggaactgtgatttgggagttgggtcccctgcccctattttactgcaggggagactgaggcacaaggagatcccgtgtctaactggtacatggaacggaaccagttaatgccgaagaggactgtggtcatgctttcctgaagttcagagcttgccctttccactaggtagaggatcctgggtgttttcacaaaggaagacagagagtggcgtaaagcggtgacttctcaactttcctgatgtcaccccgagggtctggaaggtgggagaccaccttccccagccttcacctcttgccagtagccccgagggtggagtcagctcctgccatgcagataattgtggctgttcttcttgatactagaccaaaactcaacaagtggcagtttcttaaagatgcttctggtccagcaaaggagccgagcaccaatcaagtcacctcccttctcaatgtggtcagatcaatgccagggaatcaagggaagaaaagtgagaaactggagctcgagggagaggaggagccaagaggcagaggacatccagccacttcccagggcatcgactatgacctgcacatgcaggttcagccattctactatgtggtccacaagacacattttgtgcaagatttgaaaggcagaggagcagtcacattcttcctgcttggaaggtccacacaggacgccaggtgctacatccggcagctcgtgcatgccacctgccctgcagactcagctaggtggcttggggcggccaccgccctaagcctcttttctcacctgactccagggggtagggatctgtcctgtgcaagaaggaatggaatcgttgcttgtcaagcacccattctattccagttctgcctctatgcacccataaacctctgtgcctaagtggtttactgcttaactctttaactcttttcagcattcctctgttgattaatc

SEQ ID NO: 470713 - DNA, 965 bp, Homo sapiens
caccttcccccaggtggctgcataacttgctgcctcaccttctcagacaaggtggctcaaaatgtgttctgtgcaggtcgggtctggtttttatagacttctgtggactaaagtgaggactgtgtggggctgggctgctcgttggaggggtgcacggtggttttctgggtgggccgtgcaattcctgctggcaaacacagtcatggtggaagctctgccagaaaagcacagagtggtagggcagagtgttcctgcatggcctcctggtcagaagctcacctcttcctgccataacctggccaaggagaggagagctcagtctttggtaacttccccagaggggcctggaccagccatattctcaggatatggcttcttactgggagcctttgctcttgtggccatgggtcatcaggtctcattagacttaattgttatcacgagaacagcaggggaaagacctgcctccatcattcagttgcctcccaccgggtcccccccacgacacatgggaattcaagatgggatttgaccatcttgatatggtcagccaaaccatatcaggaatggagtgagtacagggacaactgtgatcactggcgctcaccccctgcccccctcccctctccccgccatccccacaccatgaggaggccctctgcacaaagcatgtctgcccagactgtgctcaacaagactttcctcctgttctgcctcctgtctggtctcttttgtctctgccttttgccaagttttgttccacagccttcccagcaaggtgggagctccccagtttcctcctccttcagcagagagtccctgtctgctgaaatgcacccagcctatttctgtcactgccagcactgtctcctgttctgctggcgaactctgcttacctgcctatcaaggccagatgcccctctctggagccctctggattcctttccctgagctgctctaacaaa

SEQ ID NO: 470714 - DNA, 884 bp, Homo sapiens
gaaggccccttccctggtcggtgctggcgccgggtgctgggtgcagactgggaaaggccgggtcgcttggttcagtccaccacagagctcccaaacctcgttcgtgccggcctgttgtggggcccaggagctgggcagagggcgggaagaccggcgaggggctggcagggagacgtctgtggagggggttcagctcgtagaaggcagccatcgttatccaagaatgccactgcgtgtgctccaaaattctgtcttccgagggcgcgtgggaggctcacccttggctgacacgctgggaactcagcggatgatgtcgtctgggctggcacccacagtcccgataaacaggagagagggagggagagatgggagaagggcccgcctcctgcccgatggggcacgaggggttaaccgcaggccatctccagcctggaagtcccctggactctcctctgatccacccagtcctccaactgggggcctccagaaccatgagaaagtaagactctgctggactgtggcacgcacccggaacacccatccagccgccctgaaggatgcaggcctctccgcctttggttctcctgtgcctcttcaggggaccctgcgcttgctatttgactggattctcacggcagctctcagaaatctgcaccatgactccgatttgactgatggagacccagatacccagagagattaagcagctccggccaggccatggcttacattccagctccctctcactgggtgacaactggctccctctgtcccccacgtgacaacttggggaaagtggacaaattgcttgaaaggcacaaactactaagttaactcatgaaaaaatggataacctgaacagtcctatctatgaaagtaactat

SEQ ID NO: 470715 - DNA, 1645 bp, Homo sapiens
ctcaccttgtcttcctaaggacacaggatgagaaaggtgaggagcttccccggtcacagggccaagctcctgctgcagccacggctctctgaaccaccccattcatacctacatggctgtacccccaaaatgccccctggagcctgctacacacagatgccaaatcagaatcgccgagagagtgagctcctcatctggtcattaccacccttccgctctaggcttcagtgtcacctccaccaggaagccctctgctctctgaactcgggacccccattactgggtgctccctctggattgtgtcaacctcatccgctgtgtgaacagctccatgagggcagtgattgtctgtccctcacatcccagcaccttgggctcccccacctggacttcctgaaggtgcccaccagctcctgtccccgctggtcaggggtcggggcagcaggagcaatagggccctgcagtcttgcgagcatccctggtaaaatcaggattgcttcccgggaggaggagacagttaccatccccatgaacccatcagcttctccctgcaatgcccttttcactctggtggaacacgatcatccccttcacgcctcttcctgctccggggcctcctcccagagtcttgcctttgaagtgcgtctgagccctggcagctttcaggtgaagttacacctcttcttatcttcccagtgtctctgggggaaactgcccggatactcactctggaggaggcagaatgcgggcggccgtgctgggaacaaccccggcctgctggctgtggccggcctgcagatccctgaatctgtagggcttgaagggaaactctgcgctcaaagcacttacgcgaaaagcacatctgtcttcaaccgcatccaaagtgctggccaccggtcttccatatggtctcccggagtggggcgtcctggcctgaggaacaggacccgaggctgcggtggggtctctgcctccttttgtgtctgccgcccaaccgtcttccgacaggagcagcacctgctgcatgcccgcagggtgcgtgcacagagggtacatcagggaacagaatggggcgggtccgtgccctcccagcttgtgagggtgggggtgggtaatgaggaaattagtgcgatggcctcggagggcgctgagaaccacgggaaatcaactcagggagactatgggagaagggacatgcgggaacagtcggagactccagctctgcagacaggggttgaagctgggagagagacacatcaatgcatgccggctgtctatacggatgggctcagcaggaaaactggctgttccatcacctcctatgtcaacctccgtggctccgtctcctcagctgtcctgagtgggcacttccccagcaaaggcagcaagctgaagaaggctggaataagattgatgacactggttagtagcttcaatgcatggcggacttactgcatacagggccgaacagcacctgtaggaatatgtcgcgagtaaatatattcagactagaccgaaaagtcctgtatgcaaagatgtttatcagatgctgtcaataatagcaaaattaagtaaattaaacaaatagatgacaacccagatgtccatttgtcccatcagtagacacttggttttgaagtcaacc

SEQ ID NO: 470716 - DNA, 668 bp, Homo sapiens
tgcagtattgttaatttgacatcatcgtgttaagttataagatgtcgggagtgaacactcagggtcttaatctcctctctggggaagaggctggtgtatgtgcagaacaagcccccaggggcctctactattccaagcgacaaggccacccggatttcattcttcctgggagacgggagcgctcatttctgctcctggtggtcactcacctccacgtgacctttggcatccaggctttctgggtctctggctccttgatgatgccatgcagaggtcctgaggttgagatgtccctgcttgtggctgtggctcctgggcacacgtatggcatatttcaggaccgacactggagtgagtggaattttcatggttcagtcattggaataaccaaaatacttattgtgccaactggatcgtcaccaaagtatttctttttagtggactttgttgtcaaaagtttgctcattgacaacctggcagctggcccagacatttctatgtttggcacatgtccgaaagctgggctgccagatttagtaaatttagtataagtatgtgttgtgtagtatttggaacatgcttatattttaaaagtattaatttttaatctgaaattaaaacgtaactgggcatcctgtgttttatctgggcatttcacagaagcattt

SEQ ID NO: 470717 - DNA, 728 bp, Homo sapiens
cccaacagctcattgagaacgggccaggatgacaatggcggctttactggtggagttcaccaccttgtggaaggccaagcagtggacgagttacgcaggtgacacattcctctcagtgcacggaggccacataacccagctgcagatctcctttgaaggtggagacacttccacacgctcaccaagagggcacagaaagaccttccacgcacacagcaagagggctgtgaaagacctctacaaggaaaactgcaaaacactgctgaaagaaatcacagatgacaccagcaaagggagacacatcccatgctcatggatgggcttgggggtaggtgcagggagcatctgtgtctccctaaggggacagggagcctgcctcagcgactgggggctgctcatttgcccggcagaggaggaggaggagcaccaagggcacaacactgttcctccacgatgatctcatttccagatccttgtattcatatgtctgcaaagaatcttttatccaaataaggtcacatgtgcagggggcatacccttcgggtgagggggggcaccattcagcttactacatagggtgagggacagggctgcctgccagggcaggtacttcatagaaaccagctctgagttaggaccccgcccccatgtgagggtgataccggccttggggtcagccagggcccccatgtgggttcagagttctgtggagcctttcacctggagag

SEQ ID NO: 470718 - DNA, 1324 bp, Homo sapiens
tccttcgggctcaccctgcaactgtgggatatgctcatcttggagggcgagcagctgtggcctcctgtgcacagctggaccccagggtggccaagaaggaccacacaccacccagtgggaggtgggcctggtggaaatggggtgcaggcactgatccccccacaagggaatcctcctggcctgatacccgccctgtccctagagtgcctcatgaagctttcctggagcaccatctgggagtttcaggagcgactttttcagagctgggccccggaggacaacgtggtcctcaggaaccttcaaacctccgtgaaggaactcacaaggaaacactgggacctgccacccccaggtgggctccagcaccaagtctcctcccaagtcaccctctggggcagtcagtggtggggagtgccctggccctaccagccctcctacctggccttcctcctgcacctcttcctcctctactctaagaaagtaaaatgggtctgccactcctcagggcaggcactgagcgtgtgtgtgcgggacatgaggtgcagacaggcaggggctgtgggcaggaccccccaacttccctccccctctttccacattgtccccatcaccccctcaaagggccctgaagggcactggggcagtcagatccaggtgtggaagaccccacccctgcctccaagcagcaggatccctcattcttgagtgcccctccaagcctgtcaagacaacaagccaggaggacaagagagaatcagtgtcccagatccagagaggatttgggcagagggcacggggggaagccctgacccagagccagaaccaagagttcagccgggcatgggatttgtccagccctggcatggggtggacggcctggagggcagagggaaacccgtgcccttcacttctcacccactgtggagacagaccccatgcgaggtggcaagggggctgggtgacagtgaaggtccctttcacctgagttctgagtcagggctgctgaacagccctgaggtgagggagggcgtgaggcaggaagccctgagccagcctgaagcctgggagccgtttcaggaccgacctgaggttccctgaaagctcccccaccccaggctgcacacagccctcaccctgggatcagcagcttgcagaggtgtcctcagtgtcaggccagaggacacccggggaccccaggactccagaggcccagggctgtgggcccagccctggagaggcccctgaggcctctgaccccacctgtgggtcagagcctgtcccccagggcctgagtcccaggcccagagggacctggcttcaactc

SEQ ID NO: 470719 - DNA, 1904 bp, Homo sapiens
tttgttctggctggcatggatgccctgctgcggggcctgtcttggggtgcctgaatgtgcagtaggctggcctggagccaggtgctgcctgcagtgagctgagggtggtgctgggaacagagccctcagtgtgggagtgaggtgtggagctgaggtttttggctggagctgctgggggcccgaagggggtggccactcgcactgggaaggcggagtggggagctggcttaggcaagaccagagcatgattgtgggtcaatcagggtggaagcgtcctccagtcacgtctgggggccctgggatgggggtagaggagcctggagccaccagcccagccagacatgctgtcctctctgttccaggagccgccctgcctggagctagcctgggggtgagccagggtcccccaacccccgggatgaccgcggccagccgggccaacccctacagcatcgtgtcattggaggaggacgggctgcacctggtcaccatgtcgggcgccaacggcttcggcaacggcaaggtgcacacgcggcgcaggtgccgcaaccgcttcgtcaagaagaatggccagtgcaacattgcgttcgccaacatggacgagaagtcacagcgctacctggctgacatgttcaccacctgtgtggacatccgctggcgctacatgctgctcatcttctcgctggccttccttgcctcctggctgctgttcggcatcatcttctgggtcatcgcggtggcacacggtgacctggagccggctgagggccacggccgcacaccctgtgtgatgcaggtgcacggcttcatggcggccttcctcttctccatcgagacgcagaccaccatcggctacgggctgcgctgtgtgacggaggagtgcctggtggccgtcttcatggtggtggcccagtccatcgtgggctgcatcatcgactccttcatgattggtgccatcatggccaagatggcaaggcccaagaagcgggcacacacgctgctgttcagccacaacgccgtggtggccctgcgtgacggcaagctctgcctcatgtggcgtgtgggcaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgaaattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagtgccaactccttctgctatgagaacgagctggccttcctgagccgtgacgaggaggatgaggcggacggagaccaggacggccgaagccgggatggcctcagcccccaggccaggcatgactttgacagactccaggctggcggcggggtcctggagcagcggccctacagacgggggtcagagatctgagccaaccttggccgacatgcagcatccacccctggccggggagaggccccgcggtcgctcaggggccctgggtttgagcagaacgggcccagtgccctgggttgcagactcagtagcgttttagtcgttttatgtttctttgcaaaggcctcagaaggttggccggagagggggcagccagagc

SEQ ID NO: 470720 - DNA, 747 bp, Homo sapiens
tcttaggaattcagaaattcagcccccatgactgtggaagattcagcgtggctggtagtgagaagtaaggccatcattttgctgaaattgaggatggaggaggactttctgggtgactcaaggaaactgccatgtgtgagcatggcccatggccctgctgctctggtccgggctgtcaggatctggctgagaaaacattccctagaagcctgggagtgggtgactgcaaggttgcttggtttctcggacgctgcctgtgaccttcttattgtgtggagctctctgacactcaggcgcacagagctgcagccctctgccctctgctgtgctcggggagaagaagaaatcactgacactaagttcctcttattggaccccatggcaggaactggggtgcaggacctgctcatcttcctgggcgaggggtcttgagtcctgtacacctatttctccctccactgctaagggtctctggctgctcttgagtcgatgacagattctcgtcctgtttgctgccctctgtagcctgtgagcagaaccagaagggacactctcacagcctgttcgccacggaatccaggaggcaggtccatgttggtgcaaaactaaataaaaaataaatacatacatacatatataaacattgattttaaaaatatggtcttctgatccttctccaccaatctcaaataaagagttcttttctacatggatttctaaattgtggggcatggaatctcagctgtt

SEQ ID NO: 470721 - DNA, 563 bp, Homo sapiens
tcagagactgcacacagcagcctgggcctggggtgaatgctgaaggaccaggtggtggtcaagatgcagcctctgggtccctgtggctcaccagctgtggaactttgcctctcagctcagttttgccatctgcagaatgggctgctgctgttccctgccctgtcagttaggcataaagcattgagaacgagccctgcacagcatgaggaccacacgagatttgtcagcactgccagcttcttggccagtgacacccataaacagagagtcccttctgggcaggccctccctgccaccaagggggcatccccaagggttcgagccacatgcctcatcctgccaggctggccagccttggctgaggcccacgcaatgagcaaccaggccagggagctcagtgaggggacaccaggttggtgtgtgggtagacgccgagcagtcagtcatgtaagcctggctgtcctctctgccggacttgggtgagcgggtcctacctcaaggctatctcttgtaaactgtggggatgtcccagctgcccactgcctcgccagagacccagtgcc

SEQ ID NO: 470722 - DNA, 693 bp, Homo sapiens
ttgtatgaccttgaagatgtcactgcacctctcagagactcagtttcctcatctgcaaattggggcaggatctggcaggattgcaggtggtttcaacagaaccctgcagcatggaacaggctggcacacatcttgctgggaagaaaacaaaggagatgcagccttcagcttttccttgtcacctggagaggaagcctccaatgtcttccagggtggggcctgccccagaggaagccacagacactgtgggtgtcttctggatggcaggagtgacaatggcagcagcagcagtcacagggacagcaacgtttgccaggcactgtcctggccttgcctctttgaatcctcatcatgtccccaaataggtgttattaagcctgtttcgcagatgaggaaatcaaggcatagaaaggtgaagtggattgcccagattcacacaatgagtaaagatgtagccctgggaatgtctgatgccagcagccctgctgtcttcagcaagttggcagcctcaggagccagtgggtaccaggctcaggagcccagtgggtaccaggctaactgctttgtctatgtcatggccctgaatctccacaaccaccacacctagggctgctatcatctactgtcttggagatggggaaacgggggcacagagaggcaaagcaacctgcccaaggtcacacagcaggtagg

SEQ ID NO: 470723 - DNA, 664 bp, Homo sapiens
atgctaatgggtattgcctaggtgtaagatgtgtgactttggcatcagtggctactgggtggactctgtggccaagacaatggatgccggctgcaagccctacatggcctgccccagttgggtgataagctcatggaccacctctgcggaggacactggtgggctgtgcaggtcccgccccgccctcattgtcaggagggccttaggggcctgctcccagcctgagaggatcaacccagagctgaaccagaagggctacaatgtcaagtctgacgtctggagcctgggcatcaccatggtactgtgtggggccggggcctgcccttggtggtcagtggattggagggatgggaagaccaccaggatgtgtcccccagccagggctaggaagctgtgcaggagacgcgtggaaggacgatgccatcagcagcgccaagtgtttgtgctgaggtctcttccgttcatcatggtgatgacggccggcagtgagggcccttgtgctggagcctcagaattctctgttcttccaggccggggccagggctgacatgacttgttttttccatccagtcatcatgattggagcccagagttggttgtaagctagctagtccgtcccttccatgatgacttcctgccaaccacagggctgggagcttggagc

SEQ ID NO: 470724 - DNA, 731 bp, Homo sapiens
gggaaaaaacggccctcagcttccacctctgtgaaatgggctgtaacagaaccaccctcacagagctctggcaggaagagaaaagacaaagggacaggaagtgtcacctcagcctctcctgcccaaacagctgcttgcatgcggagatcagactccagacttaccccaactggggttcagatccaaattccaagagctaccaccaaggagacttttggaaagttctcaggctcctcagagcccagtcccttcatgagtgcaactcctgcttccgaggtgaaacactggaaattatcaaaatcccaacaagagggaactggatagatcatgaacatatccctgagatgaaagaatcaacaactgagacaaagatgctgtattttgaaattacccagatagccatcggtaaaggactgctgtatccaggagaatggttaggatctttcagctgagagactgctaagtgatatgccaacttgtgggttaaaagtgggggggaaagaaatatatatttgtattcacttgtatttatgtgtggaaaacactggaagaattcatgagaaacaagtaaaaatgcttccctgtgtgaagtggaggagctctgggcagaaggcagatggcagacaaaggcagtgggtagattttttcttggtacccacatacacttcattttagtttttgaaacatgaatatattacctaatcaaaattatcttttaaaatattcttttt

SEQ ID NO: 470725 - DNA, 1761 bp, Homo sapiens
ctatcaactgtccatttcttggactttttcccactcttctctggatgctcggggaccatatgtgacacttggctgcctgacagtgggccaagtggaggcactagtgtcaatgtgtatatgaaatatgtgaggcttaattttacatttttagatcagagtaatgtcaatgggaattctcattttatcttctcagctctcattggatcatcttgtatactccactttggaaactaccaaactgcagaacatggagaattttataggacgcatttcaaaggaggtgcttggaaaataccccaggatgaagacaggctgaaaggtcagggaaaagcaacagtaaaagcaaagaattcacacagccctgggcgcatgcgagtgcgtgtggagacctgttgcctggtgtcacctaacaagagtcagcaaaaaggccacaattggcaggtcttcccctttacatttcactactacccgggttgaatacgaacccttttgaaaaatattggatttctttaactttataactcttatatttgtgacctgcttgctgcatttggagttctcactcttttttattttattcattctgatagagggatagtgatcactcattgtggttttaatttgcattttcctaatagctaatgatgtcgagcatttttcatgtgcttatttgccatctgtatattctcttcagtgaaatgtctctttataacttttgttcattttctaattatattgtttttcactatggagttttgagagttctttatatattccaaatactaatactttgtccaatatgtaatttgaaagtatttcctctcattttgtaccttgtctttttaccctcttaagagagtctttcaaatagcaaaagtttttaattttgatgaaattcaatttatcaattttttctttacggaccacactttcagtgtcaagtctgaaataatttatctatattttttctacgtttcatagttttaccatttatacaaaagtctctgatccactttgagttaatagttaaagtaaggcttaggttgaggttcatcttttggcctatggatatccacttgctccagcatcatttgttcaaaatttaccttcctttactgaattgcttctgcaattctgtcaaaaatctgttggacatatttgtgtgggtcaatttcttggttctttgttctgtttctttaatatgtgtgtctattcctccaccaatactgcacagttttgattaatgtagctgtgtaatgtcctgaaattcagaagactgattgctaccacttgatcctctttttcaaaataatttcagcaactctagttactttgccttttcatacacatattagaataatcttatctattcctaaaaaaatactaggattttcatagaaattgcattaaacctgtatgtcaatttgggaagagttgatatgtcgagtttttcaatccgtgaacatggtatgtctctccatttttcagatctttgatttctctcatcagcatgtgtagttttgaacatacaagtcagtcctgtacatatttagattgtaattattttattttttgagcaattgtaaatattttattctgcatttcaatgcccatgtgtttattgttagtatatagaaatacagttgatttttgtatattgatcttgtcttgcaaccttgccgaattcacttattagttgtagacggttttgttgtggattctttggtactttatatgtagacaatcacgtaatttcaaata

SEQ ID NO: 470726 - DNA, 958 bp, Homo sapiens
agctctcttctcccgataactgtggccatgtggcctcgtctgctgcccagtgtgacctcagcctcaaagccccactcctaccttagaaaggtgctcctgcagaggaacctggtgtcttccccaccccaggctgcaggagctctctgttcaatgcagtatccactggccacatgtggctttgagctcctgaaacatggctggtctaaactgagatatgctataagtgtacagtacacatcagattttgaagacatccacaaggtattaaaacccagcaggatccaggctggaatgaaggcaactctcaagggcacaggccgtgggcaccgaggaggacctgacacaccccgtgggatgcaaggaggacaccctggaggaggcaaggccaatgctgccaatttcccattgcctaccggggagttcagtctgctcctcatctataaaatggggacatgcaagtccctaacccagaagcacaaactgccagaagtaggcttctggtacaaagcagatgatgacttttagggctggcaatttctgtcctttgtgggcaacattgccattaacttactgatgacttggggtttccagagtcctggataaagaagaaaggagtttcctagggaacaagcctaaatctcctgggaagaatcagtgagagcctttaagtttatttcctccttttctggcctggtttgaatagagccccagggcaggagggtttttctgagctacctgaactttaaatacctgcctggggcttcctttactgaatcttatattttcctccctgtgttatgccaaggtctgggagtttggagggatgccctaaacgggacaaaaaggggttactggggatcagggagtaggaagctgggccagcaccagagcccctgatttcttcagctgggggctccctccttatccaccttcaagttcactgccccctaccacaccc

SEQ ID NO: 470727 - DNA, 2139 bp, Homo sapiens
ggctcattgagaacgggccatgatgacaatggtggctttgcaaactgttcctggctctctggacaagaagtcccagttccgttgtcaagcggtcggcaagtccgtgacagacaatacagctgccaagccgtgcaaaacatccacccccagaatgtcttcagagaccagtggattgccaaatccacatgtggctctggttttccagtgccccgcaagccggcaccttggccagttctcttatcaagcagaaaaggctttacacttccgccaactgcagcaggtgattcagcgccttctccacactcataggggatctgtacactgcctcccatgtttccactggggctcatccaagcagcaccactgcgaccgggtaccacagctcatgctgcggccacgtagccgtcccgggagccctcaggggctgaagacccactcacctccttccatcctcgtcgccagttgttagatcctggggtctgggtccagcccatgctgaagtctaagggcaggtcagcagcttaactctttttctctctggacacgagcaagctgaactgcgtcatggctccctcctatcagtctgcaagacagacagctttggctctctctctctttgggcgtcaacacacgctccatgtcaagccatattgagccgagcccagagcccctgtatagcgttagcagggcaattatacctttttcagacaatagtggctcagagccaagtgatggtgaagtaagctccagcaggacaagtggagcatggagtataccttcaattagaaagccaaaacaatgtgaactgttgaaaactgctgtcactgattctctccaagctgagggaatacgcaaggtccctgcctcccacgaaaagccgctcttaatattcatccagcaggattgtatggaaatcaagaaatccaaaagggctgtgaaatattgatgttctgttcagtttcaagacctctgaaatgcaaagtgatatgtacactaaacacacaagaaaatgcaaatacctttataacacttttctcatagttctattttcatccctattggaagcaagtcgttaacattcattttatcgtaaatataatggcaatgaattttaatgtgcacaaattaaaatattttataaattttaaaaatagcattttacattattcaacttatggaactatttgactctagattatatgattgtataacctgaaaaaactaattataaaatattttatatcattcaatttagggtattagataaaaaaattaactcatagtgactaagctggttaattattgcccttaaatggatattaaaagcgaatttttctctttgataaagtaactagcaaatgattaaatgttgtgaaagtgtttcctggtgtatggattcactgaattcctttgacccacttaaacagaacatgtgacattcatgaaatagtaacttaatagctttaaaacagctgttctgtagctccaaattaatttagcttttctctctcaacatgtctactttatgagaaaaaagcgtgagaaatgagttgttcttttgctttcaggccctgtcctaccatgagctgaagaggcagcaacatacgtgtttggagtttagtagggactgagaagcggggaaaagaactgcctaaccaaaggtattgtttccacctgacttccaagatgtcagaaaattctccctagtagatactcttttatacatggacattagctattgttgttaaaatgaaaacaggtgaaattatttttaataacatatttttgttaacccaatatatctaaaacattttcaaacataaatcaatataaaattattaaagagatattttgcattctttttctgtactgtctttgaaatccagtgtatgttttacacttacagcacatcttaatttgaactagacacatttgaagttcttaatagtcacatgtggctaccatattggacaagcaggtctaagtcagtggttcccaaaatgtggtccctggagcagcaggataagcatcaccctaaaacttgttagaaatacaaattctcaggctccaccccagacctactgaatcagaaactctgatagttgggctcagcaacctgtggtttaacaagcctttcag

SEQ ID NO: 470728 - DNA, 1832 bp, Homo sapiens
gaagtctgttttcagtggtttttagcttgtgccaatggatgacaaatctatacagaaacctgggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcatgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcagacataattgatcaatttgcaattgttttcttgacaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaagtggaaattgtactttattttatataatgtcatgtaaaactttgcttaagatggtctggttttttttttgtttttgtttggttttttttttccatgaaaacaaatgactgttcctttttatttaat

SEQ ID NO: 470729 - DNA, 951 bp, Homo sapiens
ggatggcaggaggatgggggtgggggaagcaagggaagaactggaaggaagtgtgactttgcgctatatcggagcagggacgctgggagcgcgcgcggcccgccggctagtcagtcccctgacccggaaccgcactggtgccgccgctagccggctgcccacgtgcctgcaacagtggccacgtggggccctgaggaaacgcctttacaaaggtttgtcccctgcgctgcccagtagggaggaaaaccggaggagagcgcaggaggaaacagtaccggctggaggccggtcttgcaggagcgggggactgctgggggcggggcttggtggtgactgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtaagccctggtctctttcagcaactgtctcaagggccttcccacccctactctgtagtccctgattttttttccccttgagcatctttgtgcagcttggactcaaacctcagagtccaaccatcctactcattagaccagtgttcttcaaactggtctgatggaaaaatcacctaaggggcgtgtctaaaatgtaaatatcccatcctca

SEQ ID NO: 470730 - DNA, 804 bp, Homo sapiens
gcctccatgctgatgtgaccatatgcacgttacagttggggcagcgctggcagaatatcccgtctgtctcctggtccttacccaggagccatggacttacctagcagaggagctggtgagggaagaagcgccccccaccgacctgcaaatttttgccatgtcccaacctgcccatgtggcctggacatgtggaaatgtgtcaacaatcatgacagatctgagagcagtacctgtcccagtgcgcaggcagccaatggctggggcctgcagcctgcgatggtgcctgcagcctctgaggagacccatcaccaaatggccttcctgctccagtgagaagcccctgggccatgtgaagtctgggggagccaggaccagagtccctgagagacatggtctggaaactgctcaccaatgtctgctggatgctttctggacctggggtagtcctgatgggattgagagagataaacaggaaggcgcaaaggattaaggtgtctctctgaggaaggggctagggacaggccgggagttgggtgacgcctctgtgtggagccgagggatccagatgtgagctgctttgcccaacgcatttttccatctgtgcagagaaaataaaacaaagagaaaagaaaacaagctgtaaaatactttgcagaagtctgagcatgggcatttgccacttgatgtctcctgacagctccaagaagcaggggagggaagggagccctgccttttgatgtttgcctcagagttttcttttgtgtgaccagttgtttaggaagaaccttttgttggcgtaaggtg

SEQ ID NO: 470731 - DNA, 1777 bp, Homo sapiens
aaggccatctgccctgggataccccaatcccctccccattgctgctgcccaggatctgagctttaagcctggctggccccacccccgccaatctttgcagccctgcaaagcgcccagcccggctgcggtcccgccagcggggagccatccatcaccgcctgaatgccagccaacccgagcagccccgccttcctgccagccaatagccggaaggcagggggcgtgcggggctctaagtggtataaaaggggtccgagggccaggccgcgctacctctgcgcccccagttggctctgcttgttgctggcgtcctgttccgtgccagagcccccgggccggtgtttctgtgcgtgccgtctggctgggccctggctcctggggtctgggtttcagacgtgccccggtgcccattctgctggaggaaagaagaggccctgaggcccccttcccttatacacttggggcccgcagggtcgcccacgagggcaagggggtggaggaatgcagaaagatgcagaggggccctggggatggcaggacactggaaggcaggccctggctgctctcccgcacggaaccgccggccgcccttcccgaaaaccagtcctccgcgctcccctccgcgcccgccggctccggcctgtggcagcgctaatgaggcagtctggaggaagccggtgccagcgggcaggactctgggcggcaggccaggcttgtcatcctggcggctctgccgagctgcgggcgccacgtgggagctgggggcacagcagccggcggccctccacccccagcggggtctccgcctcagcccccggaaagctgggcctgcaaactcagggtcctctggaaggggcagcgcccttccttgccggccctcccgggtcctctggcagtgctgcgcagcccgctctgcgctgtcctctccgccgcggcgtgggtccgtcggctgcttcgcagccgcgccgctccccacaatccctcagccatcgcgggcgaggacacctttccggtcgcctctcggcattgccatgccccctcagccccttccttttaacctacactagcagggtgggtcacgcgtgcaggttgctagggcaacgtcctgtcgccggcgtcggaaaccaaccagtaactctcaggagccggagtcgggtccgccctgggggcggagttagtcagcaggtcggtccggcgggagcgcgtttcctgccggtccctgcaggtggcaccataggatcgcggatgctttcctggggcggggctttcctggggcggggcttcccgcagtgctcagcgcactccaggggcggggccggggtggagccggggtggaacgtgagccaccagctgcagtccgcaaaggatcgagggaaacgagctgtcccgggacgcaacgctagacaagctcagggacgcatttacagggacgcagaaagtgtacgcgtcagagagtggaaaggagaaaacaggttctgggacggcgacagagaagggaagtcgtgtcgcccagaaaggctatacaatctccacccttcccgtttgtccctgcgacaccctttcaccctcctgtccctccggacctgcaattcttcacaccctctgcagcgcacagggtgctcaggacacatgtgcacggtgggggctggcgatgcttcctcgcccccaccacccgcaagcttgcagagagctgtagtgcccaggatgtatgccaggataggaattccacggttccaggcatgccaagaaaaatagccatgctgtttctcggtttgtt

SEQ ID NO: 470732 - DNA, 672 bp, Homo sapiens
cagctctgcctgccccaggggtttctccaaggctgagtcctctaactttctaaccaacccctctttccagatgttctcacagggggaatagagtggggcagtggagtgtgctgatgacctgtccgagcaccccactccctctctcaagcccctgactggcatgtgttactgccattggacaagctgtcccacagccactgcaccttcagtgcggggagcctggagcccatcatctccacatcctttgcaagaattctctgtcctggataagcagcacctcccattcgctcaagctgcagatgttacatgctgccttcctcccctcactgaatgtgaaggtgatggaagccttttgctaagtctgtggctgtatgaagctcagatcgctggagcatatggcattatctactgtgagaatgaggctgatggagagccactgggctcaggcttggaaatggtgagctctgatcggaccgtggggaaaacaggacatttcccttctgaaggtcccccagcccagggcaaatgccagggcatgaatgtgtctgcaccccgcgagattgagtaaatatttgccaaaggcctgaattgtaacaataatctgccaatgtcaggccagctgtgggggagatttacagacccaaaccagggacaaaagacattctttcagga

SEQ ID NO: 470733 - DNA, 867 bp, Homo sapiens
gaggacaccactggccatttgctgccctgtcctgaccagagggcctcaagtcgcatgggaaggagggggtggggacacagctgctcccacccggagcatggccctccttagcccaagctgggacccacaagcccagacccagaagcagagatgtgagggaggaggagccggatgtttcctctttccaaaagattccagaattggcttggctgcgtggccccttgcccctgctgacagcccccacacttcctgattaagtctggcttccccaggtggctgctgcccaggactcccagatgcagctgtgggtggcaggaagcaaccagtgtcctggcatcaccccagacacaaacctggtccctgatttgacagcatcgcgttgccctccacccactgatgggcctggatgtcctcctgctggcggggacatcacagccagagagctgaccatgttccactatcagtacaagcggactctggcagcagatgtgcttctcagtgaaggtgtggcgacatctctccgcgtctccttgcaaatgatcagctcccacctccaccctggcaccaacctgggctgcaggaagctgaaatgcatgttgccccttatcatgaatgggagcatcatctttgcagaaagtctcccttctttatccttgcaaattgagagtgcaatccaggatggaaggagaccacattcaaccatcagcatcaagcgggcgaatgaggcctcctgaattgagcattgggctcaggaggggcatgaagttccacaaagcacagaccaccctttgcaatgagcagcaaggtgggtgtctctttcacaggtcggggtgaggtggggtgtttccatccagggagccccagtca

SEQ ID NO: 470734 - DNA, 1190 bp, Homo sapiens
gaggccacctggactcaagattttcaacccagggtgcgactctctgttgtgtccccaaatgtaaggtggtttgttgtgaagaagagttcagagagtgcccactgatgtgtcctggcaattaaccagagacctgtgggaggggtggcgagggcagcaggacagccaggctggctgatgcggccatgtgccccatcccctcttccgtggggggtgctccttggcccccatccacctttggagggttggcaaaggacatcggcagacacagggatgctctcacagaagtgtctatttggactattgcttttgacttgcccaacaatttaatctcccagggggtagagaaaatgaccagtggatcagccactctgaaatcaattctgaccatcaaagaactgaccagccaactggaaagtcatctgagagtggcccaatcagaagtgcattgtcatctgagagtggcccaatcagaagtgcattgtgaggagaggccgtgtgaggaaacagtggaaaaggtggtcatctacaagccaggaagagagccgtcaccagaagccagaacagtcagcgccctgatcttggacttccagtttctagaactatgagaaaataaatgtctgttgtttaagccacccagtatatggtattttgttatggcaaccacagcagactaatatagggggtatccctagaatcacccttgtgatgccctcagaggtttttaatcgagtccttatgttaatttatctctgttcacagagagctctgcttctggtttcctgatgagaccctgactgatccagaagagacggtgcctatactagtcaagggcaggaacctccaggctgaggagctggactctgtacctgtcttctttgtctcactgcatcgggctgtgccctgagcctcatcttcagaaaatggagggaagtaagtcctgggtgaccgcaggatccctgtagcacagctcccccaaggtcttaatgaagtgccattacacctctcagctaatataatccccaggaaaggggcagggcagacagatggcagagagggagactgagtcatactcactagctaggccacacagctagttagaaatagaagcaggcctgggactcttcctcccaatattccgcccccttccacaaagacccagaggctccctgcctcctccctacttttaattc

SEQ ID NO: 470735 - DNA, 904 bp, Homo sapiens
ctgtaagtggcaaataaggaagaagtcgcagaccggttctggctttcaggtctctcagacagggagtcaaaacagttgagactctgatcagccaaggctagggacacggtcatgtgttatggaaagagggccatgtcttctggaggtcagggcccagcagaccctgattctcacctgtatctagtccacgtcagtgtcccacctgtatatggtctgcgtcagtgtcccatccgtatatggtctgtgttgtatacagtccgtgttggcatcccatgcatatacagtttgcatcagtgtcccatccatataaggtccccgtcagtgtcccatccatatgcggtccgcgtcagtgttccatccgtatacggtccgagtcagtgtcctgtccgaatactgtccgcgtcagtgtcccgtccgtataaggtccgcgtcagtgtcccatctgtatacggtccgcgtcagtgtcccgtaagtatacggtccgcgtcagtgtcccatccgtatacgtccgtgtcagtgtcctatccatatatggtctgtgtcagtgtcccatctgtataccgtccgcatcagtgtcccatccgtataccatctgtgtcagtgtcccatctgtatatggcccatgtcgtatatggtctgtgtcggcgttccacctgtatacaatctgtcggtgtctcatccgtatacggtccacatcagggtctcatctgtatacagtctgtgtcagtgtcctatcggtatacagtctgtgtcagtgtcccatctgtataaggtccgcatccgtgtcccatccatatactgtctgcgtcagtgtcccatctgtataagttctgcatcagtgtcccatccatatatgatccatgtcagtgtctcatctgagtctggcctgtgagagagtcactgt

SEQ ID NO: 470736 - DNA, 777 bp, Homo sapiens
catctgttgacagttccaaatgcgtccttttaacatggcagctgacttcacccagaggagggacagatgtattacgggaatgagcactctcctcctgagaggcaatgtggaattttctgtgggtagagctgcagcaacttcactggaaagtattctgtctttaatgtgtgcaccaggcatgttgaataacctgccaagagtcatcttgaagacctaccagtcgctacctgcttttggaaaatccctcgataagcagtttgcaattgaaggttcctgctccttgcttcttgaaggtgcatgggtccaactcatgacaatggatatcaaccttcaaggaggtttcttacaaagtgccagcagctctaaccttgatccttcagatgatatctggagtatcatattcaatttggggcatcagattttgggaatggcattgatgaatcagagtgtgctcagagatagactgcttaagatgaagaaagttcaagaaattatgtggtgtgaggagaggctgaaggatcagagaacattctgcctggaaatgcaaacaggatttgtgagagagatgcatgccattgaggaagaagctgaggtagaactaaaaccaaagggtgcaagatatagggaatacaccttcctgtaaataaagacaacctttctgatcattataatcaagagaaatagtgtcagttgtataccacttacaagtgtcaaaagcaggagcccatttgtaaggtgagctattatttccatgctatggatccaggtaattggaac

SEQ ID NO: 470737 - DNA, 4061 bp, Homo sapiens
tggacgccagcgatgatttagtgcgccgcgccggcgctcgcaccagcagcacgtggagcgcttcctggggggttatttttttagaaaggagaaggggtggctagaacttaatcccatggtggagagagagagagagagagaaggaagaagaggaagaagaagaagagaagaagaagaggaggaggaggaggaagaagaagaagaagaggaggaggaggagaacaagaatgagaacaagaacaagaacaagaagaacaagaacgagaacaagaacaagaacaggaacaacaagaagaggagaaaaatgattcggaccaaaatgtccatgatgcagagggtgagaaaccctgagatagaccgtaacagggagctatccacagacacaggagcaccaccagaagccagggccatgtcgccatggtggcccggcctggcatggccaggtggccttcacccctttgggccaagcagagaggagcacgtagctgctgaacctccagaggtctccaaaggttctaagtgcaggagccaagagcgcttctgaaaaccctcattctgcacagcctggcccaccctcagccttctcttgtgcatgtggctgcctggagagcttggcagaaaggcccagagagtggggtgactgagccgggggcgggctagggtgaaggtatccatcctagagaaatactggcttgtgtacacaaaggggcattccaagcatgttcattacagtttcaaaacactatatatgtctaccaatggggaagtcattacataaattatggtacctccatactgtggagagctgtgcagcaataaaaaggcattaagttgaccaaacatgttgaaatacatcaaaagtcagaaaagaaacaagtcataaagtcaaagaacaacagggcagaatggtacctgctgtttggcccatttgtgcctcaggaccaaaagtacactgaagactcaaagcaaaactatgtacctttatatggatataaatgcaaagaacagcctggaacaataaagaaaggtggcccagtgtggttattctaggaaagtggaaggaacttcccttcaactctttggtttgatctaaaaaatatataaatatattgtaacgagaaaataatattcatatatctgttttttaaaggaagaaataattttaaaggaagaaagttaattgtcttggaagtcctttctggatatatttggcttgtggttatttcttaaaacaacaacaacagcaatattgttaaaatatgatatggctatgtttaaaatggatatattgaagactctgaagcttcatggctgtgaaaactccatagctgctgtccctgtctcaatactgtcctcaggtgcttctaccagattaatcttccaaaaactcctctttgatcatgctcctcttggaggaaaaacatcttggcctgcaaaagtggccccaccctacctggccaactttatgttcacctgcttcctgacacaagagtctcttccctaggcatgttcattccctccactttccataaacatgctgtccttgtcctactgcttctttgcatttgttcatgttactcagcaggcctgggatgcagtgccaggtccacatcataggaatgcttgactttacataatgaatgggttcccggtttgtcatttaaagcgtacgcgcatgtgtgtaaagctaatcccacttccacaatgctgggtgtttagcttcagaagttagtcttgatttgtgattcgtccttgattggctgtgagcccaattcttagttttatatttttctgcctcttagttgctgccaatttataaaccaacacttaaatccttcaaggaagttcctttaataaaagcatcatttttgatagaaagtgaggaagtcacccctgcatttaaaaaatttgtggttaaaagcttggattattgccaactggattttcttcaaatggggcctacttctatatgtcaaacaacttctttccaatttgagattcccagggtgctatgcactaaagccatctttagggttttatgtagccacatcctcaaagactttcctcctcacttgacttcacttgtgcaggcctgggcttcagccaattcatatatatctggtatacaccagaggggtggccaggtgagtctactagggttttgctttgttttgttttgtcttaatgggaaaggcttatgtgccttaacattttggggctgataatgagcttttggactaagacttcttagatagtgataaaaaagggttaccttgtcctcctaagactttgtactggatgtggggaatgggaacagtttggtgggagaagatgtcataacttgatgtgtaaatgacttaggaacaagtttggggagtgctagtgatactctggcctggttcccatgaaataagttccacagtcctctgggggtgggagctgtgaaaagagagaagaacactcttcgtggtatcagtggcccaaagaccacttgtgacccagcataaaatggatgggttgtgactatagcagaaatgatggcatgtgactcaaggcttggctcttttggaaggctaactcctgggatccaggcaccatgatgtgaggaagcccaagcagccacatggaaaggccatgtgtaggtgttcctgctgacatccactgctgaagtcccagtctacagccagcattacctaccagatacgctttaagatgattccacctgccagccttcaagtcagctccaacatgaatcttttcggctgagaccctagagacatgaaaaagagtcatttactctatgtgtcctttaaaaacttctgacttagagagaatccctggacataacaaaaccattggtatttttaaaaagctatatataccactgagcttggggagatgtgttatgcagcaacagtaagtgggacagagaactacttctctgagatggacagaagggatttggaaggcatacgtataagatgtaagatttttgaaacagatattacatatgtgtatatgtattatatacatatttaaatatacaaatatatattacagatgtgtatatgtgtgcatacacacatatatgcatatatatgtacatatacatataatcagtgtaattatacatccagacatgtttttctgctaagaatatcgaaaatccagaagccagtctgaccagagccccattaggagtctcaaggggaggcagaagaatggtggagaaagcaaggacttttagaatctggccaaactccagggccacctatcatgagcagccttgtttgctggcaatttgcagagttgcaaggggtaaaggactggctttgactattcagtctttcagtggctgctctgcaacagaacacacccagaggcatagaggatgtttcttatcgctccaagctctgcactgggcctgaagggggctgggatccagttttgatgaagggacacgaggcccttgccttgctggctgcagaggcaggaagagcccaccggggtggggctccccatgaggctgtctggaattgaggaacacagcccactgcggattccaagagccaaagaaacgaaactctccaagcttacaactgtggagaaacacttcttcagtctgttttaaatcaaaatccccacgctgacacttggactccattcaaccattaaaaagttccactagcaaataaacacttagccaaatatttgctcctatgtgttttcaatagtaaatgccagctatattgctcatctctgtatatcaccctggtggcccacccctggttgtctggagctaagtggcttctttaaagacaggtggaaactccttccaaacttcccaccatggcagccaagaggggtggactcagaccctggtggaaaagaaaaagttccctcccaccctaaagggcagaccaacttaggatcgttccgtgagatttgtacttacatgtagcacagaccccacagcccccgggccccagaaacgtatttctgctttcccctcctctcgtgggtcgtgctcctaccttccccagtgctcagtcaccagccct

SEQ ID NO: 470738 - DNA, 513 bp, Homo sapiens
atctaaggcatggatcctactggtcaatcaaccaatttctgcctccaaatcttgcttgcattcctttgcaccacattacctagcccactctcaggtagaccaaggcccatttgtgcctccaagatggctctcagtgatccccccttctgggttcatatgctagtacagtcttctcccatagcgaagaggacagacctgaatagccaaaaggatattgtggaagtgacagcatgtgacctccaaggcgagatcataacagacatcgctacttctaccttgctctctcgatcactccccatgggggaagcctgttggtacgacactcaagtagccctatggagaggttcttgtgtggccactgcagtcatccaggcaagatgtgatgaactaagataaggaaaaagaaggaacaaacttgaaagacatttagagcagaaggttggcatactttacctgtaaaaggccagataataagtatttcagattttgcagaccaaacaacctgccgcaact

SEQ ID NO: 470739 - DNA, 568 bp, Homo sapiens
agaagctgggggtgaagtcatagaagaatagagccaaggggacatgagagcaaagtggttgccatttgtcccagtcattgcttcattacagaatgtgccgattagacctccactgtaccacaaatgtcagagagacatctgtcatctccaaagccctgaaagctgtgagaggagcccagaaggcattgaaagaaccagtactctgcaggttcctaggaccaacaccttctccttgcaggccagacggcagtttggctgtcaaagacaggatgttgtcactcctacccttaaacatttccaaggatacaaccttcctgaggctgggaaatcagtctacctccttaacctcctcatctatgcaatagcagtaacattatttatcttacaaggttactgcaaggataaaggcaggagcacacacgtggccacatcaatatacacactatagctttttttttcttctgctgctgtctttgcttccctgaatttggtatccatagcaacgcatcccagcagcaatgaagaggtgacacagttgctgtttccctcacacccctattttgctgat

SEQ ID NO: 470740 - DNA, 681 bp, Homo sapiens
cagttcctgagagggtgttctcaaagtcacccttgctttcttgcgggtcccagcataagccactcgacgtctctaagcttcagtcttctcatctgtggaatggacccagtattacctgttttggagagctgtgaagtaaagtctgagactgaaggcccgagaattccaggggccaatggtgtaagtctgagtctgcctgaaagctggagaaccaggagtgatgatgaccaagggcaagagaagatggatgtctcagtacaagcagagagagcaaattcaccattcagccaacaccataactactttctttgcctgttgactcagaggcatgaggagcccaaagtggccaggtggcaggcagtttcaacttcaagttcaatggaatcactgttgtgtctcctggtgaaagtattcctgtctctggaactaagacctctaggccagcaaggcataaaagaagcaatgctgtgtggaatccttgataagaagcaatgctgtgtggaatactatgacagtgtgtaaggcattctgtaagcccacggatggtagttttggcagaagcatttcatgcagagaagacaaagtcgtaaccagagtaagtgtttattccagtaaggacaaaaaactgcctcttccatgatggaagcagtccagtgtaatcaacctgatgctggatagctc

SEQ ID NO: 470741 - DNA, 537 bp, Homo sapiens
ttctgaggggtcttgaaagtttgaccacccagcgtcattttgaataggagagaataaggcaatatgcggaaaaagcatcagtaccaagcaacggggaaaaagttaatatttttggagtgctgtttaagttcaggcttggtgccaggtggtcctaaatccaatgacaagtgttctcataaaagacacacagagaagagacacagagagaaaagaaaaagaccatgtgaagatgaagacagtgattggagttatgcagccagatgccaaggatgcctgaagccactagaagctggaacaggcaaggaaggattctcttctagagcttttggcagccaacagcaattacaagaagaagaggaagaagaagaaggaagaggaggaggaggaggagaagaacaagaagaaggaggaggaggagaaggagaaggagaagaatcgttaagtagcagctttatacccaggcttcttgttacataatggggaggtgagtggttaccctacaattttataggagttaatgaactatttgggcttaca

SEQ ID NO: 470742 - DNA, 599 bp, Homo sapiens
atcaaaccaatgcctggtgtgtcactggcaaatgttagccagaaagaaagattgttccatcctgccaggtcccttataaagggggagaaaataaaatttatcaatcagacttttgatagtgagaatgggtgctacctgggcagaatcctgggacactggcttaccagggactacctgggaaaactgggacataggatccccttcttttatagcctttcaaaaagttcctatttaacactccatcaagatgcccaactgtccaatgtgcctagcattgaggacattggactttcagttttaaaaccagaatggtcctgggcacaccaaggaactggttgcctcaatgaaagaagaaaacacctgaaaagtatacaaggattccttagcacgaaaccagcaaacagcctcaatctatcagcaatcatctttagacccattaccaaaaccagacagctccccaaaagaaagagagatacctaatgtaaatgacgagttaatgggtgcagcacaccaatatagcacatgtatacatatgtaacaaacctgcgcgttgtgcacatgtaccctagaacttaaagtataataataataataataat

SEQ ID NO: 470743 - DNA, 1129 bp, Homo sapiens
cagctgaaaaaggttctcttgtcatgggactctacatagccgttatattttattacaaagacaatatcttagtcaccaatgaagatcaagtaccaattgttgaaatagatgactctcacaccagttctattacacaagattttctgtggttcacgaagctgtcttgtatgtgggaagatataaggtggctgaggcaaagcataccaatatcctcatcctcatccacagtgctgcaaactcggcagaagatgctcgcagcaacagcacagctacagaatttacttgggacacacaacttgggaagagtttactatgagcccattaaagatcgacatggaaacatactcatagtcaccatcagggaggtggagatgctttattcattttttaatggcaaatggatgcagatctcaaagctgcaaagccagagaaagtctctatcaacacctgaggagccaacagctttagacattctactgataaccatccaggatattctatcctatcacaaaaggagtcatcagcgtctctttcctggattatatctgggttacctaaagctctgtagctctgtggatcaaatcaaagttcttgttacccaaaagttgcccaacattctctgccacgtgaagatccgtgaaaacaataatatttctagagaggaatgggaatggatccaaaagctttctggctctgaatctatggaaagtgtggatcatacttctgactgccccatgcaattgttcttctacgagctccagatggcagtgaaagctctccttcagcagatcaatatacctctacaccaggcaaggaacttccgcctctacacacaggaggtgttggaaatgggtcacaatgtgtcctttcttctcctgctccctgcctcagacgacgtctgtacagccccaggacagaataatccttacaccccacactcagggtttcttaacctccctcttcagatgtttgaacttggtatagtagcttgtttcacctagaaatattaacccagcctccttataataaaatcacaaagttatatctgttcccccttgtcccagtggagggtcaataaatcacatgatggctttggcaacaacccttcctagaactgtgtacaagtctg

SEQ ID NO: 470744 - DNA, 682 bp, Homo sapiens
gtcttcagtttcatcttacactatggtggctcctccaagctcactgtcttcaacacacttgccactggaaagtttctgcaaaggtgattatgtcaccaacttagtagagcagcttattcctccctcttccctgtcatacacccctcgggaactctggagccatgaagccttggcggagatggaggcccaccaggcagctctttattgccatgcaactgtgagattcctctccacacttcctcctggggaaaagtcagcctgccagtggagatttaacagtggagtagtgcatagtgacttgccaagtttcccctgccccccagctaccgccatccccaccatccctacccctggactgaacaaatggcatcacttatcccctgggagcctggcagttgctgagcccatacgcctcagggactggtgagcttccagtggccacagaggcaggtctccactcaaggcacatgcagactcaagcagagctgtgtctgtgactacccaactggacacgcagctggcactggagatgataagccgctttctaggtcaccttctccctgcagagatttttctcttgaatcatttttggccagatccctttgcagcattatagtttgtcaataatactttgtttttagtgtatggaaaaatactaatttttttaaatttgattttgtaa

SEQ ID NO: 470745 - DNA, 576 bp, Homo sapiens
gtttggacctggctgttccctagtgttgtttaaaggagagagaatcagcatgaatgctagggaaattagactgctggaaatgccagaggaaagcagatatggagctagaaccaagggaaaggacatactgggacatcctggctatggaaaggaagcacagtcattcacaaaatctggaacatgtcagttaaagaaggataaattcttggcaagtatgccatcaccttcccctagtgtgcctatggcagacatgactctgcccttctttttcaatagctgcgctgtggctttaggatcatttgaaccactgttgcagtggattgtagtgctcatggccctctatgggtccatgtctgagatctctatcctagtccagcatccctgggacaatacatactaccttaatggctgcaacttggtgcatgcaccaaggcttctcatactctgtatcatgagataaaacagtattactataagtgtttgctatcagctttaaaatattactgatgaaattttagaattgctatcaagtcacagttcatatgggatttagggtttaaagttagcatgtaaggt

SEQ ID NO: 470746 - DNA, 729 bp, Homo sapiens
cagctccactattcattttgcatgagggctacccgacattgtccaacagcaaccagcagacatgaaaggatagggcttgtcattgcttttgagaatattaattatgatatgtcttgcatgagaaatttgagagatgttatgtttagagaaactggtggggctgttgctgaaaaatcagcggaaatcggatgcctgcaagaaaggaccctggaaaagccagcggtacacggtgacaggcaacaggtattctggggaggggtggtagcctacggcaggctgaatcctgatggcatctggaccaggaagaggtcaaggaggcttccgatggtcccacaggacatctatagctccatgccaggtagtatttttttcattactgaaaatgaaaaagttttcctggaagtaagcagacataacactgacttcatgggtccaagcaaagaggacaatgtagagacaaaagaatacaaaccgactagttgctaaaggagctagaaagggggattatttaagaaaaaaagagacaaattaaataaataaaatatcatccttcatggtacagcagtgctgcggcctggggatagaactggaaactttgtgtgacaacctaaataggatgccgtcactttcaccctacaattaatactccctgaagaaatatctaagtgtcatgatcttttgctaaatttgaagcatgcaagcaaaaattcggtcatttccgtcagcagt

SEQ ID NO: 470747 - DNA, 760 bp, Homo sapiens
ttcctgtcccaggcccctgaggcatggccccagcttcatgccccaggctcagcccccgcactccatgtgcaagcagaggactgcccttggcccatctctgcttcagagtccctctctgcctgaccacactgctcccctattggcaggcaacttggcccagccccatttcagtggcccccagggtggcaggttgtagggggttcgcaggggtgggctccagggccgtctgcctccttcccacactctccctgcagtggcagtgggcgagagcagaaatgcagggccagggcccagagcaacagaggctctgggactggaagtggattccaccccgcagtgagagaatggggccacacagttggccgtcttggttatgcagggcacaggggacccactgccaccactgccacgcctgcagccattcctgctgctactgctcacacctccccactgcagccagcatgatggcagcagctgccccagatggcctgccactgccctcattttatgcctcagttatctgtctaatatggccagtggggtgttgaagtctcccactattattatgtggctatctaagtttctttgcaggcctctcgagatttgctttatgaatgtggccactcagatgtcaatgagtcctctatttggtccctttacctaatcccatatttctcagaggttttgttcattcttttaaattcttttgtctttacttttttcccagttgagttaattcagagacccagactttgagctc

SEQ ID NO: 470748 - DNA, 1310 bp, Homo sapiens
attgcctcactcgggaagcgcaaggggtcagggagttcccttttctagtcaaagaaagggtgacagacggcacctggaaaatcgggtcactcccgccctaatactgcgcttttccaatgggcttaaaaaacagcgcaccagaagattatatcctgcacctggcttggagggtcctacattcatggagtcttgctgattgctagcacagcagtctgagatcaaactgcaaggtggcagcgaggctgggggaggggcacccaccgttgcccaggcttgctgaggtaaacaaagcagccgggaagctcaaactgggtggagcccaccacagctccaggaggcctgcctgcctctgtaggctccacctctgggggcagggcacagacaaaaaaaagacagcagtaacatctgctgacttaaatgttcctgtctgacagctttgaagagagcagtgattctcccagcacgcagctggagatctgagaacgggcagactgcctcctcaagtgggtccctgacccctgagccccaagcagcctaactaggaggcaccccccagtacgggcagactgacatctcacatgtccaggtactcctctgagacaaaacttccagaggaacgatcagacagcagcattcgcggttcacgaaaatccgctgttctgcagccactgctgctgatacccaggcaaacagggtctggagtggacctctagcaaactccaacagacctgcagctgagggtcctgtctgttagaaggaaaactaacaaacacaaaggacatccacaccaaaaacccatctgtacatcaccgagctgatggagctgaaagtcaaggctcaagaactacgtgaagaatgcagaagcctcaggagccgatgtgatcagctggaagaaagggtatcagtgatggaagatgaaatgaatgaaatgaagcgagaagggaagtttagagaaaaaagaataaaaggaaacgaacaaagcctccaagaaatatgggactatgtgaaaagactaaatctacatctgattggtgtgcctgaaagggacgggggagtatggaaccaagctggaaaacactctgcaagatattgtccaggagaacttccccaatctagcaaggcaggccaacattcagattcaggaaacactctgcaagatattgtccaggagaacttccccaatctagcaaggcaggccaacattcagattcaggaaatacagagaacaccacaaagatactcctcgagaagagcaactccaagacacataattgtcagatcaccaaagttgaaatgaaggaaaaaatatt

SEQ ID NO: 470749 - DNA, 1157 bp, Homo sapiens
gcatcagccttcccaagatggcagctgctgaagacgagttcctgccgccgccgcggctccccgagctgttcgattccagcaaacagcttctggacgaagtcgaaggagcgactgaacccaccggttcccgaatagtccaggaaaaggtgttcaagggcctcgacctccttgacaaggttgccaaaatgttatcgcagcttgacttgttcagccgaaatgaagatttggaggagattacttccaccgacctgaagtacctgatggtgccagcgtttcaaggagccctcaccatgaaacaagtcaacccccgtaagcgtctagatcatttgcagcaggctcgcgaacactttataaaatacttaactcagtgccattactatcgtgtggccgagtttgagctgccccaaaccaagaccaactcagctgaaaatcacggtgctattacctccacggcttatcctagcctcgttgctatggcatctcaaagacaggctaaaatagagcgatacaagcagaagaaggtgttggagcataagttgtctacaatgaaatctgctgtggaaagtggtcaagcagataatgagcgtgttcgtgaatattatcttcttcaccttcagaggtggattgatatcagcttagaagagattgagagcattgatcaggaaataaagatcctgggagagaaagactcttcaagagaggcatccacttctaactcatgtcaccagaagaggcctccaatgaaacccttcattctcactcggaacatggcgcaagccaaagtatttggcgctggctatccaagtctggcttccatgacagtgagtgactggtatgatcaacatcagaaacatggagtgttaccagatcagggaatagccaaggcaacaccagaagaattcagaaaagccactcagcaacaggaagatcaagaaaaggaggaagaggatgatgaacaaacactccaaagagctcgagagtgggatgactggaaggacacccaccctaggggctacggcaaccgacagaacatgggctaatcttcccacaacaccgcaggactgcagggtgcacaccttccccgccaaggaaaaccatgcagccttcccctccctgagctcccctacagctgtgtaaaacgaaggcaaagatgctta

SEQ ID NO: 470750 - DNA, 1866 bp, Homo sapiens
tttggtgatggccatcggggctcccagatgaagtgacattgatgttgagacttggaggacctggaggcatgagccaagccgcatccctgctccttagagatcgccgtcttcagaaactgccaggcccctgctctttcaacatctttcatcctgacgtgtggccaaagcatgacaaacctccatgggaaagctgtccggcagcatcggtcatcacagaacaattagaagcaaatctttccaaaaataatcgagctttgagtgttcttcgaaggataaagagtgggagtgtagtcgccaaccgagctaaccagggcaaggaaaattctgaaaacatcaccacccctgaagtctttccaaggttgtaccacctgatcccagatggtgaaattaccagcatcaagatcaatcaagtggatcccagtgaaagcctctccattatgctgatgggaggcagtgaaaccccactggtccgtatcatccaacacatttatcatgatggggcaaatgccagagatgaccagctactaccaggagacatcatcctaaatgtcaatgggatggacattagcaaagtctctcacaactacgctctgcatctcctgcggcagccctaccagaagttctgcagcaggaacagtggacaggccctggatgcctacagaccccaggatgacagctgccatgtgatttgcaacaaaagtagccccaaggaacagcttggaataaaattggtgtgcaaggtggatgagcctggggtgtttatcttcaacgtgctagatggtattgctggccctcttcaccactgtatggacttatgcaatgccaagaaggtagaaagctgcactatgatccagtgtccagctctgaaaaatgctgctccttgtgtggtggcatgtttgactcctacctctctgctcttggaagttgctggcctatgttgcatcctgatggtaccagcagtttttatcagccataacaatggcagcagcgggctgtctggagtagctgctgccatcacgctggctgcagcagggaggcacagctgggactgcacactccatggagctggtgggaacctgggacaagtggaagccccgccccttctgagttggtggggcaggagttccctgggtgcagccacaactgcccaaactgtggctgcagacctgggcctcccgggccatggagcaggcaggggcccaaccccaccagggcagctgcagtccaccccaaccactgctgtggacccaggcatccctgcactcttaggggcccaggaaggctccccctgccctagcaggcttggaagtacctggcttccccctgctgttggcacccactttgatcttggagcaaagttggggccaagcccaggcactgtcaaggcctggccaggccagaaagggcctgaaggctcggggccaggctaccagttccatggaccaaagtgggaacttgtggtgctttttccagatccccccatggctgcccatggaccaattggcactcacttcctccctctgagacccataaaacccccagactcagccagagctgagcagatgttgggaaaaccagctgcagagaggagctacccattccagggtctcctctctgctgagagcttcagagaacgatgggatgacctgcctgcagaaggagctacccattccagggcctcctctgagctagtctatcactcaataaagctcctcttcaccttgctcactctccacttgtccacatacctcattcctcctggatgtgggacaagaacttgggacctgttgaatggcaggtctgaaaggtctataacacaaacagagctgaaacatgccccttgtttgtgacattgcaggtgaggag

SEQ ID NO: 470751 - DNA, 676 bp, Homo sapiens
atggggctgttgcaaggataacatggagacaatgggtgcagggtggcatccgggtaagagtccagacctggcatcaggctgcctgcgctggatcttggctctgcaacttccaacttatttagctctccagatctcagcttcctcatttgtaaaacgggtttgtagcaatgactgcttcaacagggctttgatgttttgcctgatcaataaagattgcaaccggccagataaggacataaccaaacacaccctgccactgtcagtcctcaccagaggactctgtggccataaaaagagctggacttccaccgctcataacagctgtcttgataagcgcctggcatctgcctctaaagactctgcctacatcaaagactcttccttgcaaagctgtgatgctgctgagctgcccaagccagaccagaatattctttttgttcacatcgctctccctggactggcttattaaccctttttcctatcccttttctcatgccatgttactttgtttgatgcgtaattttcaatctataatgtttatatattgataagtatgttatgtatggcttgcaatactgactgatctgtgaagtggcttgagcctgtgtgaatgccaagtgctaaaaattgtctcctcctctttgggaactccatagagctggtggcttttatgatc

SEQ ID NO: 470752 - DNA, 714 bp, Homo sapiens
tttgtgctgtcaagtgtccaagtagttcgtggaacagcaggacactaaacaccaacctgcggcctcacaatgatgatgatgattgcccctaaaagggggataatcgctggctgccatcatctgaaggttcgcctggggctggaaggtctgtctccaagctcatctgcatggctgttagttggaggttcagttcctctcaacagggtgcttgaatgtcctcacaacacgtcggctggcattctccagggcgagaatccaaaagatgcaggagggcactgcaatgccttcggtgacccggccttgggagtcacacaccatcacctccaccttactccactaggtaaacagaccacaggcgtcacagggcatgaagactggaggaaggccagggaaggccgaaaggaaaagctgcctgtggggagagacctggtggctgcagggaggtggctgcgggtcacctacttccatgggaagccagctccagtcagatacagggatggcggccccaacgcgggaggatccagggctatctgaggaacaagaataggcagtgtggtgggggatgttcagatgtgttcggagtttcttccttgtggtgggttcgtggtctcgctgacttcaggggtgaagccacaaaccttcgcagtcagtgttccggctcttaaaggtgtgaagctgcagactttgccatgggtgtcttacaatcagggcaga

SEQ ID NO: 470753 - DNA, 642 bp, Homo sapiens
agctgctcggagtggacttaggatgtgcgatcttgtttctgaccttgttggcttctctgagatgtttaaagttccagctaaacaatacaaatctatacatcccactttggaaatagacattgaaggtgaattacaaaatctcaaggaaattggagaattattacaaacaaagggtagagagtttggtgtaactattggaaggaaaagaagatgtggctggttggacctcgttttgctcaaatatgctcatattatcaatggatttactgcgctggaagttaccaagttgaatattttggacatgtttatggaaatcaaagttggagttgcttacaagttagatggtcaaatcatacctcatattccagcaaatcaagaagtcttaaagttgaagttcaatataagactccatgagaatggaacacagacatatcaaatgcaagggcatttaaagaactacctgttaatgcacaaaactatgttcgatttattgaagatgagcttcaaattccagttaaatggattggtgttgaaacaaatgatgaaaacataggggttctgtaaacttttgtaatgctatgagttctgtttaaattgtggactgtttattttctgctgagaccattgcaaaatttgaaagtc

SEQ ID NO: 470754 - DNA, 2184 bp, Homo sapiens
aaggtttatcagcttctgcaaggagctttgtcccaccatgcttccattcccagaaggaggagcttggagcgagtcagtcctggggcttgctgacatgggtgacccattggaaaggagaaccagccccaaggagcagcaggcatgggtccctccatccttgggcttcctgggcccctgtgatgggggaaagggctctcttataccacactcaaggagaccacttctcaggatggagtcagatggagagacctctcgggagaaagacatccccgttgtggaagttgggggcgtagaaaatgaagcaaaacaattccagggtgtctcccgctttactcttcaggaatggtgtcccaagttggaggttttgtgtcagctgcaaatcctaccagttatgtccaagaatggctttccctcgggcaggtggcagtggtcatctcccactgggaatatggcgtagtatctccggtccattccttggatgctaaggactgtgggaatgagggggtcagataaagaacaaacctcaaaacaaacaattaaattgaaatgttatgtgcctgacccaatggtaggcacatagtaggcactcaactcatatgtttaattgaattgaaaatatcccttaggggaaaaaaaaaacacacacacacacaagcaaaaaaccacaagagcctcagccagtttactccaggtagatttccacaatatgcaaagtggtggtggggtcaagacaggtgacaccagcactttaaattctttgtgtgggtatgcgtgggtgtatgtttgggaagaaaaacgaaggtgcagactatcttccttttttcttcttcaacctccatccctggcttcctcccctcacacacactggacttggtacaaaatgtcagtgtggtcctagaggaagcattggggtgggggagggagagggagctttgtgtaaagtgcctactggaaatgcactgtggggtttttcctgtatgggaaaccatttatgccaagctttcccctatttcccaaatttatatcatctggttagctgcctctgcttccagctttgtataattctctttgccagctgcacaaagctgattttctccaaagtctaaagactgagctcacctggctagattgttgtgtgttttgttgaaattgttcataatgtaatgccgtatttattgttttaaaaatgaaaggaatactaataagtcttaaaagttccttcatgcctaagattttttccagttactgggcttaactggtgtacattaattagatgtccatactgtattttgtttgcatcaagtaattttctttttgacttagtatctggcacacaaagtgggttagtactacagtatttgcattactttaagtacaaagttaggtatgtgcttatatgtacagagttgtgcatagcaatcattttatgtaagttgacatgtagtctactcacattttcatttttagcagttttgtacaaaaatagcaattaatttgtaaacactaccagaatactttctagatggcatgtaattttttaagagtgttattttgtttttgtttttgttcttagttgtggttcttcttttcatttttgttgtacgtgtagatctgtaaataaaattgcagtattcaaagcttaagctttcgggaaaaagaaaataagaattcagtgtgtgcatgacaactcgtgtgtatgagaaggagggatttgaaggaagatgacttgcagagtaagtcgggtagcagttgtcagagtgtgggaatttattttcctacggggtacgtgattttgtaaaaaggaagtatttctcccaaaattgggagtaggcaaattactaatcggtttagctttgtgttgtatgctagtttaaaaaagaaaatatgtaatataatgtaaaaaaaaaacaacaaaaaagcttttatgatggattttgtaaacagatttgttacagggtgacctgttctctagctgtgatcttaccacttcaaatgggtgtaatttgaataacttttgtatggtaaaggatcaataaaatgattttttaagaaaaaaagaaatatccttaatctgttaaagattatttataaaataaaaacttttaaaaaatcacactcagtgaggaaatattaaaaactgtcccatgagttttaggaatgaggcaaggatactctttactttca

SEQ ID NO: 470755 - DNA, 3877 bp, Homo sapiens
ttttttccataaaaggccaaagacacggcgacaggggcttcccctttgccgccgccgccggccaagctccgccgccaccggccaagctccgccgcgcccgcggcccgcggccgccatgcagtttatgttgctttttagtcgtcagggaaagcttcgactgcaaaaatggtatgtcccactatcggacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggccgatctactgcaggagaaaacagagactatgtatcacagcaagagtttcactgggtttaagaaagcgtactagaatacctgctggagtactgacacgcatcgaaatgtagtagggtatatacattcagtttgtaatgacaattctgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaaaaaagcattcattaaatactgtgaatcactaatgccattgatacagaagaatttccctatgaaaatgagagcttctgtgagaaaatgaagtagttgggagtttaatttcttactaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaatatttcaaagtttcaaattgaataaatattaaaatgaggatactttaaagacactcaaataagcaattttaaacttgctttctggtggggatataatccctttgagagtccgaaagatgatgggccgtcaccccaggaaaatttgtacatcattttgtttctaatttcagggaactctcggagcccctagaagtccttctgtagacactcaaatctggagagtttgttaaaatctgtcttgaggatttttaaaaaagtaatatcctcagtctcagtcaaattctttggattttttgcttttgtaggtataagtaaacagttaaaaaccttcattgctacttaaaataccagatgagtgactacttttccagtttttttgggaaagatttttctctagtttctttagtttatgtaatacaaatgtactaatgaatttaaacactggtggaagggaaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaaggaaagcaaacagaaacttaagttttagttatctttactgtgaactaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgtattttcattctatatgtgatcttgatacagctcattcctctctgcaactgatttaatctcatcttgataaaatatgacctagaagtgttttgagtaatattaaatcttaaacatatacatattattaatgaaccatctgtgatttatcttataagaggaaaacatgacaatcattaaaatgtttaccaaagaaaatatagctgaagtgctaggtcaaaataagcagtgccataatatatagtgtggtttggtcttcaaatattgaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcagtatctgttgctgaataataactctttcaaagcattaatgctgagtttatatagttcaaaaattctaatattcattcagttttaatacctaaatacttatattttactagtgatggcattctaatatattaagtcctcatttaaatacttaatactttgttaactgtggcattatatttctgaattttaaaacctttaatattggtaactattgcatattcttttaataaaacatgcagcatatttttttataaaaggaaaagaattcattgtttatatatagacagcataaagcctaagttaagtaagttattaaacaataacttcacaagatgttcaaatcgatttaccactgaaagaagatctatgaaaatgtgttttgaccaaacttagtattaggcaggtacacagataagattttccattcttaacattctcactgtaatgcactacatttgaagcacctggatgtgctatcaggtgggaaatttagcattatatattggaagcattgagaaacattggtctttcatttctatttttcccctcctttcctcctcctgccccataatatattattcatctggttttaatgctacataaatatgcattgtctcatgtctgtttgcgttggatgccttgtgctaagctgtaacaaaatgttgcttcttttgctgtctgtatacagctgcttgctttaaattagtagattctgaaatagctttccttgcatgtctaaaataaaagtattgcatataaaaaaaaaagaaatgacatggcatgtatgcaggatatttagtcatcatatagataatccttgtgcacaagggtattctacattctttcccaataagtctacatctgccagagttgaaataaaacaaaacaaaacaaacctatttagcaccttctgtatagcaggcccattcatatatgttattgtatttaattctcagaattcttatgacctaggcatttaaattaaaaaaaatttagttgacaaggattgtatatatttaatgcatacaacatgatgatttcatatatgtatatattgtgtactaattatcacaaatttattacatccattatcacctatgctgtacattaaatctccagcatttgttcatcttacaactgaaagtttatagcctttg

SEQ ID NO: 470756 - DNA, 1135 bp, Homo sapiens
aacctacttaaatctctcccccaaaaatggttttgcaggcttaacaggaagcatgactgggaggccccaggaaacttacaatcatggcagaaggtgaaggggaagcaagacacatcttcccatccatggtggaacaggagagagagaagggggaagtgccacacatttttaaaccatcagatctcatgaaaactcactcactatcacaagaacagcaaggggaattccacccccatgattcagtcacctcccaccagggccctcccccagcacttgtaaaggtcttcccacattcaagagatgagagctccttgactccaccccttgatggagcatcgacactatatagggaaaagagcgtgtgggaagaggaatatattgatgcggccatctttggaaaatacaatcctgctacacagataaagcatttggctgagtataatgagatgggctggaacaagtggcaaaggctttctaactgttgggagcactcgaggaagaatatagaggcccagaaaacattcaaagggcagaccccgtgtggccagggcaaactctacctgaaatgggtaaatgagagctaattaccgaagtgtgaacagtgttaaatgccttactcaggggaagaacttttccaggaatacacaaatgctatttttctgtagaacaattattggagcagaagaatatattaacaaacctagagggtacagatttatctcaattttagatccagttttcataaatgatggactaagtaaggctgagaaataaaggaaaatgtgtctatgttcaaagtattagcaaagcagatttagaagaaataacaaaaaataaaaagtatagtaaatcatatttttctatacttagaaactttttcacttccacctctccctctgccttacctttaatatgctaagtggagataaagaaatagccatctttttatctaaaagctataaaaatctcaccaattcagcccatacagccttctttttttaattaattcattaaacagtatttttcaagcaactactaagggctgaacaatgatgccaaagccacgagctgtgttaataacctattcagaaagaagacacattttcaaaagactatagaacagccatgcatgtta

SEQ ID NO: 470757 - DNA, 513 bp, Homo sapiens
attatggttcatgggtctcttcaaaagtcaaaaattacccaatagtgcacctgaattatgcgcagtttgttgtatgccaactgtgtctcaatagagctgtttcacaaaaaagggactgcctctgagagggttttgtgccaggagaaagaggttggatgtggaagatggagtggaggaaaggaagatcagaagtggttagccacgccaggcgcggtggctcaagcctgcaatcccagcactttgggaggccaagaaaattgtcgagagagcccgcaattatcccaaggtgcctataagatgccatttgccctggcaggtctaatgtttgctgcacgattgggtcaagaaacttggggtgctgaggatatcaaggacttagatgagcctaatgcaaagtccagtgtggcgttccagcctctgccaccgatgcctcacaattaccctaagattttcagcagctgcacaaatctgaaaacggccccttgattctgttccctagtagaaaagatgtat

SEQ ID NO: 470758 - DNA, 1613 bp, Homo sapiens
gaaagcctgttctgaaggctgtcaggactgggcttagcatgtagtaggtggcccataaatatttgttgaatgaacacatatcgtcgggaaaaaggaggttgttgtaaggacacgcagaagaaccagaactggaactggaagtcagagcggaagtggccccagggaccacctccttcgccagctcaggtccactgccaggctggtggggttcctcaagcgctggcccagggcccccttgctgtccacgctgtactttctcagtgggcagttgtctatgagcaaacaggtccagttagaaaatcaagtgactcatccagggacagacagaacgaggggcagagctcagaactcagacccagccagctgttgtgcactgaatggacaccgctgggctctcaggaagatgacagctccttggttagatgcagaaacatgaaggaccacccgttggggactggtaggccccttggcccttggctccttcttccgacatggctatgagaagggaggagagaatccaaacaggactcctgcagaaagtctatttactgtcctaagagttggttgaccttgaactctggaagtacagggtgtcacaaacctaggaaggaactaatgactcccaagtctgttcctatggctgacaaatgtctgaagttcctccagtagatgaaaaacagctcattcctaagccatgatttcttcagaaatcattttattatctctaagacttgtgaagtctaaagagagtagaatttgaaagaatgttgaattccatctggttcaaagagctttagtgttagacataaacaactttaccagtttgaaaaaccaaagatgagcaaaatcaaatcaggtggtagagcttcctgggtaggggtgtaacatacaacttaaatctaggtgtcctggtctatgtggcactttgtttgaattatggggtcattgacacagcaagatagataaggcagagtagttgttacgtaatctcaggagagtggagaaggcactcccaaaactggaaatgatgttacattttccttggtgagaatcttttaaccccaggagggtttaaaattaagtatagaaagtttaagggaatcatgatattaatgttttcatgtaaaagaatctaggcatgtttatgtatatataatgcttactagaatttagcctatttacagaaaaaaatgtcaaaattccagttgaaaattagtaagtatttaattgattcagacttatgactttaaactgaaaacttcctaagcgtatatatagtattggaacatttaagagaaccctaaggttgtcatatttgcaagtttaatttatcgcatgaataatctaaacttaaacacttgaaaaggttttgttgttaagtcaggccattaaagtacataaaaggaaacagaacacagtaagtgtctcaatgcaattttaaatctttaaaaggaatttaaccttataattggaaccacacatccaaaatccttttaaaagtgataggtaaaatatgttggacatcaacgggataagattagaaagctgaagcttaaagaagagctacgattttgaattgtaatttcaataaatattaattttaaaagtcagct

SEQ ID NO: 470759 - DNA, 750 bp, Homo sapiens
ggtcttcagcggtcccactctggagcctcccacaccacactgtgggcactgtggacattcatccattctccgtgaaggagctagagccatctttgccaagagcaaacctgatcataatcctccccggcttaaaaccgatatgcagtatagcctgctgatagcagtgcagacctcgcttctgctaggacaactggatgccatcatcctgaatcggacacctcacctgacatcaaacagcgggacagggcccaaggcccttggggtgacatcatactctggttgcctccgagcctggctcatcattccgcactccatggcctacactgggagcctcttcctggtgtttcaaagagccctacttcctgcctttgctgatgagaaccattcatttctggaacaaatcagttatttctgctctctacaagagaagccacaaatccacaaacttactcaatgcctgctgactggcggcattggtgtgaggcggtggccaggcctgcatctgcccgccctcccctggaacctccttcagtctcctgcccctgggccaggcgtatgtgttcatttccaggacgaaggatcctggctttggcaggacgcccacaccaccaatttcagaagcaacaagaactgacgtgggtttctgtctgcctgtctgtcctcgggtctccagcctgtgctatggattctgacttgtccttgatctgccccactttacctccatgcttccttcccaaccatctcccctgc

SEQ ID NO: 470760 - DNA, 791 bp, Homo sapiens
agggattcagccattctagagcccttcattgccaaaagaatgaaacaccctcctcacacagtaggcacaaagattgccatggcactatggacacagcaggaaccagacagacacagtccctgctctcctaaggtttacggtctacagggaaaggcaggcagatgttcaataaactgtaacacaaacagctgtgcaattgcaactatgatgagcattacaaggaagtgcaggggccatgtgacagagtataacaaaggctggagatggcaaagactacgctgtgagcacacctttgatatgcaaaccaaccaatccagagcccacacccaaactctcacgacttgtcctagtcaccccagggccaagtgtcagacaactagagaaatcccctataccttggagcccgccaaaattactcacacttgccaatcctaaaccttgccttgcctgcctttccctccgaaaccatagttaaggcccctgccctgatttcctcttgttccttctgcctcttgcccaaccctgggctcccccgtgtggccctgtgtggcatggcatgtcccttccactccggaactgttcattcacattgctgtatgtatcagtacttcatttctctttacaaccaagtaatatcccattgcatggatatacattgtatttatccattaatcagttgaaggacatgtgtgttttttcagttttgggctgttatgaataatgctgctataaacattcatgtacaagtttttgtgtggacatatgttctcatttatcttgggtatatacct

SEQ ID NO: 470761 - DNA, 533 bp, Homo sapiens
tgcgctgtcagtgtggccaggtacgactggaatgatcagtagcagtcctcctgaggacgtcattcaggccttggaagagaaaaagcccacccccaaagagtctggcaatagccaagaactggccaggggcccccaggagaggaccccctgtgggcctgctctgcgggaaggcgaggctgccgctgtggagggcccgtgcccgagccaggagtccctgtcccaggaggaaaacccggaacccacggaggatgaaaggagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggagtttagcacttcaaggtaatattattttccagcctatgatgaacgagtgacatgtagtcagtggaattacttagaattcttcatttatgctaccaaatcttcac

SEQ ID NO: 470762 - DNA, 1074 bp, Homo sapiens
gtgtgattcctctggctccaggccacctctgagggtctcccaatggctgggagggattagaggactgtggcttcttgggccttgcacacttgcttccctgtcctagacagctggggctgttcctgctcttcgctgcccctggcactcacagagcagctgactgactgacctaccaacttagggagaaaagtggggaggtggggatggaggacactctggggatacagcctcttcgtgatttccttcctggaggggagaggcggccagggcaatgcaatgctggggctgcagtgcctccgctcagccacagcactggctgcagggcaaaccctcaggaccagatgaggggagctcagcctgatgtccaggttcgctggcatgtgagggacgtggtcaggcacagctatagccatgggtctatggacggttcctggatcccaggaattgctggtggggtccctgatacacacctcacgtcttcaacctctgccctctctgatggcctgttggcactcctcctgcctatctctgcacactcagcgactttcccctttgatggggacaggagtggaggagggcagggcaggatggagacaccatacacattcctgctcaaggctgcaggtgactcagggtcttcgtcggtggctccggaagccttgcaggtgccctgccacatggccgctgtgctgctggctgctctgacgggtcctgccggggctactgctttcctgtcccctcccccgaagctgggagatggatttcctccctgagtgattaattggtctattttaagctcatcaaagtagcctcctgaaggactgcacacttctcaggcttccaaggcaggagcttcggcagcaggaacagggttgcaaggtagttagtctgggtgtctgtcgtcctgggttgggacatctgggagctggggcaaggcctctgggccctagtgccagagagcagtttggtggcgttgcctgttctttaaaatgggttaggtgtagccatgagcccccccatgcagcgggtgtgcaggcctctccctcagtcagaacaccctcacccacccctccc

SEQ ID NO: 470763 - DNA, 801 bp, Homo sapiens
tgggacctacagctttgcaaaagcctataaggggacaaagaaaaaaactaatggttttacaaggggctcttctcccttcgctcggcgcttctacttcctgccaccttgtgaagaaagtgccttgcgtcccctttgccttctgctatgactatgtcctcctctgtcaggggcctcccctggccccgcatctcacctgcttatgtggcatccagcctggaattaactctaacagcctcgggtaccacatggccaaggcataagcggaatctgatcgtgaagaaacctcagaccaacccaaatcgaggaacattcttcaaaataaccagccagacccttaaaaatgtcaagttcatgaaggacgacgaaaacactgaggaagcatttcagattaaagggagaagtgacaacagagcacgacccgcgattcaggactttcttttgctattaaggacgccactgggacaaaacccaatgacctttcaaaattacaaatctgatcttaagtattccagatggaccatcgtttgtttcactgttcacctactgaaggacatctgggtgtctagtttttactataatgaatacaagtaggcattttggataacttttgaaaagctttgtatagctttttaggtagtgctgtaggtattacattatatatacataacccattatagtctactagtgtcattattttgccagtttaaatgaaatatagaaattgtgtttccctttaaatcctgttgccctccactatttataatacaattgtcttaatatttcctctgcatacttttagaa

SEQ ID NO: 470764 - DNA, 874 bp, Homo sapiens
tgcctccaggaaaactcgtagttttgctcactttattgaaacggcagtgaaccaggaaggattaaggtggggctatgtttggacatttcctccccccatgtgaaaggctagagggagccgaatttgggtatttctcttcctacaaattggatgggaaagatgacttcaaagatctttggagacagcagatctgctgtctctttggacaccagatctcactttcacttttgaatgaaattttcactggatataaaatactaagctggcaagattttccccccaagaactttgaagatgttgtcttctggcatctgttgttattaaacaaaggctgtacaggaagcacgatgctggcatctgcttggcttctagaaaggcctcaggaaactgacaatcatggtaaaaggcgaagtgggagctggcgcacatcacatggccggagcaagagcaagagagagaggggggagatgccacacacttttaaacaacaacatctccatcaattgaaatgaccatatgatttttgtccttcattctgttaatatgatgtatcacactgattgatttgcatctgttgaactatctgtgcatcttttgaatgaatcccacttgatcatggctaatgatctttttagtctgtttttgaatttggctaaaggtctttctattttgcttatctttttagagaaaacaaatttttgtttcattgatcttttgtatttttttatttagattttatttatttatactctgatttttattattttatttcttctactaattttggcttgtttgctcttgcttttctggttctttaagatgcattgttaggttgtttatttgaagtttttatacttttttgatataggagctt

SEQ ID NO: 470765 - DNA, 703 bp, Homo sapiens
gaccctccagcaaactccaacagacctgcagctgagggacctgaatgatagaaggaaaactaacaaacagaaaggaatagcgtcaacatcaacgaaaaggtcatctacaccaaaaccccatctgtaggtcaccaacatcaaagaccaaaggtagataaaaccacaaagatggggagaaaccagagcagaaaagctgaaaattctaaaaaccagagcacgtcttctcctccaaaggattgcagctcctcaccagcaactgaacaaagctggacggagaatgactttgacaaattgacagaagtaggcttcagaaggtcagtaataacaaacttctccgagctaaaggagcatgttcgaacccatctcaaggaagctaaaagccttgaaaaaaggttagacgaatggctaactagaataaacagtgtagagaagaccataaatgacctgatggagctgaaaaccatggcacgagaacttcatgatgcatgcacaagcttcaatagccgattcgatcaagtggaagaaaagaagagcaaccctaagacacataattgtcagattcaccaaggtggaaatcaaggaaaaaatgtgaaggacagccagagagaaaggtcgagttaaccacaaagggaagcccatcagactaacagcggatctctctgtggaaaccctacaagccagaagagagtgggggccaatattc

SEQ ID NO: 470766 - DNA, 2585 bp, Homo sapiens
gcatctgagaaatggggcacacagacccacctcgcagggtcatcgtgaggatggtgtgcacgaggtgctggcacagggaaaatgctcgaggacatgtgtcatgcatctggccactgctggccaagtgtggctgcaggggcctttggccccaggctctacagcttctctgatgctctcttcctctataagtcaaacgaggccctgggaccatttgcatctaaagatgctgaggctaatcctgtggaggtgtgtacctggtggaggagtgtaccctgcggaggtgtgtaccctgtggatgtgtgtaccctatggaggtatggatcctatgaaggtgtgtaccatgtggaggtgtgtaccctatggaggtgtgtaccctgtggaggtgtgtaccctgtggaggtatggatcctgtggaggtgtgtatcctgtggaggtgtgtaccctgtggaggtgtgtatcctgtggaggtgtgtaccctgtggaggtatggatcctgtggaggtgtgtacccagtggaggcatgtaccctgtggaggtgtgtaccctatggaggtctgtaccctgtggaggtgtgtaccctgtggaggtatggatcctgtggaggtgtgtaccctgtggaggtatggatcctgtggaggtgtgtatcctgtggaggtgtgtaccctgtggaggtgtgtatcctgtggaggtgtgtaccctgtggaggtatggatcctgtggaggtgtgtacccagtgcaggcatgtaccctgtggaggtgtgtaccctatggaggtctgtaccctgtggaggtgtgtaccctgtggaggtatggatcctgtggaggtgtgtaccctgtggaggtctgtaccctgtggaggtgtgtaccctgtggaggtatggatcctgtggaggtgtgtaccctgtggaggtatggatcctgtggaggtgtgtaccctgtgcaggcatgtaccctgtggaggtatgtaccctgtggaggtgtgtaccctgtggagttgagtaccctatggaggtgtgtaccctatggaggtgtgtaccctgtggaggtgtgtaccctgtggaggtatggatcctgtggaggtgtgtaccctatggaactatggatcctgtggaggtgtctgccctgtggaggtgtgtaccctgtaccctgtggaggtgtgtccctgtggaggtgtgtatcttgtggaggcatgtaccctgtggaggtgtgtaccctgtggaggtgtgtccctgtggaggtatggatcctgtggaggtgtgtacccagtggaggtgtgtaccctgtggaggtgtgtatcctgtggaggtgtgtaccctgtggaggtgtggatcctgtggaggtgtgtaccctgtggagatgtgtacccttttgaggtatggatcctgtggaggtgtgtaccctgtggaagtgtgtaccctgtggaggtgtggatcctgtggaggtatggatcctgcggaggtgtgtaccctatggaggtatggatcctgtggaggtgtgtaccctgtggaggtgtgtccttgtggaggtatggatcctgtggaggtgtgtacccagtggagttgtgtaccctgtggaggtgtgtaccctgtggaggtgtgtatcctgtggaggtgtgtaccctgtggagatgtgtacccttttgaggtatggatcctgtggaggtgtgtaccctgtggaagtgtgtaccctgtggaggtgtggatcctgtggaggtatgtattctgtggaggcgtgtaccccgtgatggtatggatcctgtggaggtgtgtacccagtggaggtgtgtaccctgtggaggtatggatcctgcggaggtgtgtaccctatggaggtatggatcctgtggaggtgtgtaccctgtggaggtgtgtatcctgcggaggtgtgtaccctgtggaggtgtgtactctgtggcggtatggatcctgtggaggtgtgtactctgtggaagtgtgtaccctgtggaggtgtggatcctgtggagaggtgtgtaccctgtggaggtatggattctgtggagatgtgtatcctctggagatgtgtaccctttggagctatggatcctgtggaggtgtgtaccctgtggaggtgtgtaccctgtggaggtatggatcctgtggagatgtgtaccctgtggatgtaaggatcctgtggaggtgtgtaccctgtggagatgtgtaccctgtggaggtatggatcctgtggaggtgtgtatcctgtggagttatggatcctgtggagttgtataccctgtggaagtatggatcctctggaggggtgtacacttgtggaagtatgttcacctatggaagtatgtaccctgtggaagtgtgttcacctgtggaggtatgttcacctgtggaagtgtatacacctttggaaatgtgcacacctgtggagggtgtaccctgtggagatgtgtacacctatgaaggggtgtactctgtggaggtgtgtaccctgtggagtctgagagatcagccctactgggttcttcctactccttagatgctccttgacagagacctcccacctaagcatcctcggcctccagggatcttttgctcttacttgtgggtgtcatt

SEQ ID NO: 470767 - DNA, 689 bp, Homo sapiens
gactttctcggtccactccccttcaaaatgagaatctagatactacctcctggggccccagcgggaagagatgagggaggagcgggctgcctcgcccctttctcccgcctgggaggagccagctggcgtctccgggggcccgggaccgctgcccgcctgcaccaccaggggtcagcagagtgtcgtggctgcagccagtgcaggggagggggctggcgcggttgaggggcatctaggagtggccgggagcatgcctgtgcatttccttattaaattcaaagcccaggagtccgaggacagggggagttcaggatggattgtggggagttgtcgattgtggggaactgtcccctgggcggccgtgttctttttttgccaggcggcggtagacactgaacccaggtcgcttgcgcttcggcccgcgctctcagctgccacgtgctcgagacgcgcccacacagcggagaaacaaagacagccaagcggcagggctgccagcagcctcctcgacatttaataaatgaaattccatagctgggggtcgatcgggggtgaacgggcggccaccgctcgtggactgagcgcctggcacgggctgcctggccactcctcccgtctcactccccccgccccttacccccttcccgctgaggccaccaagcccatggactctggtgagagagcagctc

SEQ ID NO: 470768 - DNA, 601 bp, Homo sapiens
gatgtgggtggaggacgcaggtatgggttcctctcggaccaccctctctcagggatggtgtgttctggtggggctgagaggtgccccagctgcagggctggggctgtcatccattggctgtgctgttgaccttctgtccctggagttagaatcgtgttcgggggtgattccaggcaagctcaagattggatttcccgtgctggagtggaggcaggaggatggtagtcacgagcaggggaccttgtggttggaaggcaacaaagatggcaggcaatgtcaaggggaagagaaaacccaggagttgagcatctttagaaactccagttctgtggctgcacctgaccttgtcatcactcggaatggttcaccaatgaacgaagtcggcttcctctcacctttcctgccaccacatatttcctcccgatgatctgacgttgaagatctgacatttgggacccactaatgcaggagacacactgacacatctgtttgttgtcttggtcctttcttgtggtgggtgggaagtgcagaggggcaaggactacgggggaagggggaactctccctatgtgccagtgcttctgccagccaacccaggttc

SEQ ID NO: 470769 - DNA, 651 bp, Homo sapiens
aggtggacatgccggggaggagactggcctcctggtggcgggggagggctcctggggaccccaagtccgcggaggaggagacaggagggagcagggagatggaagacccaggagcacgggcgggctccgcgcatgcgtgggaagagaccttggcgtcctcggcgtcgccaaggcaaccggcgccagccatggcctctggggcgggcggaagctggggtcgctccccaccgcagagcgcagtcccgacgcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctcaggggctcagctgatatttgttgaacgagtgaatgaataaatgaatggttagggatacaaagccaggttggctgtgatggcacatggagaggtacaaagcacaagtgcacatagggttgggggatggggacaggctccttggaggagcagaggatcttagaaccagcccttgaaagccagacagaaggagaccctgaggagctactgccacccctcacccctgggtcctcagtgatgacacat

SEQ ID NO: 470770 - DNA, 2158 bp, Homo sapiens
gaaccactcagggtcctgtggacagctcacctagtggcaatggctccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctggacctgggggagccccccccccccacacccacacccacccccacccccacccccatccccacgccccgcccccgcccccgccccaaggctcagggtcctgtggacagctcacctagcggcaatggctgcaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttgaagaagcctatatcctgaaggagcagaagtattcattcctgcagaacccccagacctccctctgcttctcagagtctattccaacaccttccaacagggtgaaaacgcagcagaaatctaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtggaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggtcgtggaaggtgctactccagtgcccaccagccttgtcctaataaaattaagttgcatcattttgtttgactaggtgtccttgtataatattatggggtggaggcgggtggaaagcaccccagacttcctacaactactagacacatctcgatgcttttcacttctctatcaatggattgtctccctggagaataatccccaaagtgaaattacttagcacgtcaggttaggtagatccttgtgtacttcttggttgttcagagatcatcaaccagtgcaaacaatccccccatcaatacacagcggtgcctgccccttgcctccccagaccttccgaggcccttcctccgtgcctgaaccccctggacatatcatgtggcaaactgaagggtccaacgacatacaggaagcgaaacacgatgtacactgaaacgtgcaatacaaatatgcagcatgaagtgcctcggttcactaacccgagctacgttgggtgcctcttttctaccacttttcttaatgcctatggacacctcattctgtggctgaagttccttgtgttcaattccccccatcttcattgaacatcctctgtgcagggacttgacccctgtcctgctagctttgcactgaggcaagttctgtccatgcctatt

SEQ ID NO: 470771 - DNA, 624 bp, Homo sapiens
ttaagtcatgcctggcctgggggctgaggccgtcccggcttcggccgtcgtggtctccgtccgcctaatcctcctcgtcacggctcaggaaggccagctcgttctcgtagcagaaggaatccttcgcgctgcagcggggcgtagagggcacctcataggtcttgtggaagtgcgagtagtcgatcttgtacaggttcttctcctcaaagagcacgggctcaaagcggtgaccccacaggatctcattggccagataggagctgcgggcctgggtggtcatggctgtggcctccaccatgccttccaggatgaccacgatctcaaagtcgtccgtctccaggtcctgcctgctgatgccgaagagcgggctggcctcgtcaatctcgtgcaggatggtgatgggcgacaccagaaagatgcggtccaggctgttaacctcctatgcacccatcccctactcaatcctaagcaaccacaaatctgttttctgtctctatagattttcctattctattttcaatctaaatagaatcatacaataggtggccttttgtgcctggcttctttcagttggcataatgctatcaagtttcatgtttagtttgctattctttccagtgcctt

SEQ ID NO: 470772 - DNA, 624 bp, Homo sapiens
agggagagggagatgggagaggctcttccatttctttgtatcctcttttatttccttgaggagtggtttgtagttctccttgaagaggtccttcacgtccctttcttgctagcgggcagacctggtgctgacaaaatcagcatttggttgtcctcaggaccctcagctgcaggtctgttggagtttgccagaggcccactccagaccctgtttgcctgggtatcagcagcggaggctgcagaacagcagatattggtgaacagcaaatgttgctgcctgattgtacctctggaagttttgtctcagaggagtacccagctgtggaaagctttacaaaaacccacagaggtaactgtaccatatgagaagatgctacaagaccagtcagctttgatagtacaggggcttccagaaggtgttgcctttaaacaccctgagaattactatcttgcaaccctgaaatggattttggagaacacagccgggatttcattcattattaagaggcatttccctggaagtggcagctgtgacagtaaaggaagaatcagaagatcctgattatgatttatatcacattcagagtcaagaacttaaagctctataaattcaaattttaaggtt

SEQ ID NO: 470773 - DNA, 517 bp, Homo sapiens
gcaatgctgaaaatatttactatctgaccctgtatgaaaaatgtgtgattacgcctgttctggaggaaaactacaaccatcagcccccatatcaacctcttactggtcccatctaaaagctgaggggaagttcattatttcagttcgcctgcggtatctcgggggtgtgggctgggctaggaggggtgtcagaggagactcactcaaagacgcaaagatccagccaggaaacaaacttgctccaggtacctcgggatcagcggaatcatggagtattggtccttttgtgacgggctcatttccctcgactgctaatgcctttaaggttcatttgcacggtaccagggcaaaattcatgcttctctcctatttgacactttgttcatatttctaatacttacctcattgtagtatagctcattgggccacatgctttgttgattataaattctttgaaagtaaggcctgtattttctgcagaatcatcctgccagctagaatcaccccctccccacaa

SEQ ID NO: 470774 - DNA, 1380 bp, Homo sapiens
cctcccagagctggggagccgttagatcattcaggcagtgtggggtggagaatacaaaggcttgtaaccagaaaacgactttagggaatggttagcagcttacatggctggagtgggaagttcaagaggaggaatggctgaggtttgaaggagagggagtgtcctcagccttgaatcgggctcctgtggggctcccagtcccgctagttccacctcactagcagtgagagcggagcctcctccccgctttgccccagcagccagcagccagcagccctcatcagagcaagccgtcatctttctcaggaacagcagggcagcctcgcactgctgcaggggacaggaaggaagctcccactgtcagcagggagaggaatgaaccccatgatttcgcatctaggagcgtttcactgttttctaagtgtccatgctaatctgtacatggcttgttcggtgccttccaagacagaggggcagagccaagcggcttgtgctctgagcttctccctccccgagagtgggagaagggctttccggtcatctccccacatgctcttcactcctccaagatctagggagagatgacaacagggggcatgatagtgcacaaggcagccgtggaggttgcccctcaccaagggtctcctgggagcctcctgatgtcaaaggtgggtcccattgtcccagcgttggttggaaaataaggtcactataatcaaagctcccttggcacaggacagccaggtctgccctggagggagggaattggctttccctgtgctgcctgctgtcataggacctgagacccacagctgtttcaaggaatattctggtctttgccaagcagaaggctagcacagtgtgagatcatgaggatggaccatgcagatcctagctcacgggcagtgtgaccttaggcaggtcaccttacctgcctctgtgagcctgagggctctcatctgtaagatggagatcatacacctggttccagagctttccatacaccgtctcattgaatcctcgaaactaccctggaagacaggcatcttcagcaaacttcattttgcagttgagaaaagtgatgttaaggcagtccttatggctgctaaacagccatgcagaaatccagcccagatctgtctggatctagaacctgggctctgtcccgtcacaggcctttccactaacacaaacattcattcattgggaaagggtagtccacttggcccgcaggatgaggacaataatgcctactttgacagttgctgtgaggattaaatgaaataatgtttgtatggcaagataacattgttgatgtgttctccagaatccattttctattcctgtataaaattcacccctgaatttggtagcttaaaa

SEQ ID NO: 470775 - DNA, 1199 bp, Homo sapiens
ggggtgtggtctgatccagtactagcaaactgctcgctgctccactttatacgggcgagggaaagcagcgaagagctattcatttaggagaaaatcattactctggatttagacacaagcagacaagcatatgaaaagaacacatttctttgatgttgccactgataccgaggagaaggtggtgcttggagcagaacctgcacctgctgtctgcatctctctccctgccctgcactttcagaggcagccactcatcaaagcaggaccacgaatgtgtggccacagcaagactgagcagcgctttggcggcctactggggcagacaattggaaatgcaggagccatgtccaccccagaaaggggccagaagaataacaacatgaatattcacgacttccagatttgtgtccaaaaaaggaagatgaaagagtggcttctggaggggggtgggcagatgctacatgtggatgttattgccggaaacgatccctgtgaccctacactggggcctggggccttccacacagcagagcctgtgcagctcctgggtggaatgaggaccgaggcacagaatcctaactacagatgctccttgtcttactatgggattacgtcccaataaacctgttcagatgggagttatcctaaagaaaatgtgtgctacacaatgtccaaactatgtatggaatcgcttgtcccattctgttccaggaaaatatgttaaagaagaggaaaataataaattggccataagagggcagaattgttagcttttttccctgataaaattgggggacatttggagattttggttgccacaagcagaggatacgaatgctactggcatcctgtgagtaggggctagagatgctgctgaactttcctgcaatgcaaagatcagcacccacaacaaagaatgttctggctcaaaatgtcaatagtgttgagactgaggaattctgggctgttttagcggggatgggggacacggggagtatgaactggagcatctttgctgaagaacaatgagaacgtgttggattaaattaagtgcaaacatagcctgcgatgcattacatccaccccccggtgtagccccaagaaatggttgccagatctgtaaggggagacggacagctgtattttcagcagtgctgtttggtgcgtgtgttgtaggggagttggaagcaaccctacct

SEQ ID NO: 470776 - DNA, 1369 bp, Homo sapiens
ctgtgggtcacctctgcgggccgtcgccatgtcctccagccattgaagagtaagtgtatggagtggggccctcgccacatccctccttttcccaccacctctcaattcggtctgagctgttccccacagcccctcccagctagcgtccctctcctctccacagcccactaagggcctcatcagggctcatatgtggcttcctaagaaccctatctcttcctcattgagagtgtgcggtctcctgttccggatgcatccgagtgtgaagcctgggagagttcacacagccatccgcgtccctgccggatcaccaagcagcagctcggattcccactggctgttctcccagctgcccttctggctcccctaagaccagctgttcgtcctctgctctcatcatttttccccttagtaactggatgattgcttataaaacagttccaagggcagggctcccatcagcaaaatgaagactcttctccattttgactgctgagaaagttatagggtggtaaaggaaacgacacccaataaaagccccagatggagcagaatacatcaggaacagggaggaaaaaaccttggcggggaaggtctgaaggcggccgaggaagctgcgcttaaatgggtcagcatctggacagctccctgcagggctaaggcaccaggtggttaggggagactctttctaagaggcgattacagccttgtaagacccggacttttccttgctctttactggaccccataaaactccagtgactcgtgcccatgggcctcagggagattaaatctcatctgatccgttcatctgtgcggatgtcagcacggattcacatgggctatggtgttacacacgagcggctccttagagaacttcgggacgctcagcccgtgagaagtgtggctgctgtggccgccagctcagcaggtttctggatggttgcaagggaagagaggtcaaatagctgccgccttccacagggcacactgcacagggcagacatcagtgacatggtgtggggagggcccccaaaacaaagccaaaggccctggaaagtagggacggggataggagtgaggagaaagggaggccaggaaatgagagcatttccatgtatttcagaacaaataaagcaggaccaggctcatgccacctccccaatttcctggttcctgggatgacagaaaataacatcttaaatagccatttcctagctttgacgttaatggaaaaaaaaaagctttgaaagagtggttttctaggcaggcagcatctgggaaggaaagagtgtatgccatggaggtgccagccagtagggatgggggccagaagtgtcccctccagccatgacagtgtcttccagcc

SEQ ID NO: 470777 - DNA, 715 bp, Homo sapiens
atttctcaaagaactaaaagtcatgaccacaggtctacagatttaacctccatgccatggattggccttggacctagagttctcttagatctggtataccacagcttcctggaacttctcctggtgctttgcttctacccacatggcttctggggcttccggcagttcttggcttgtggcagcataatcccaagctttatctgtctccacatggccttctctcttgtcgctgtggcctctcctcttcctgtaaagaccccagttattggatttacagtgcattctaaatctgccatgtggctccatttacgcgagggagtggggcagcctggggaagatgtttctcagcaacagtgctaccctgctggacagctggtgatttttaccataaaacaagatagtaataaggatagaatgagaaatccagtggtaaaaacccaatacattattttgactccaggaagcccttgataacaagagacatcattatgcaatgtggcactaagaaataaaatggttcattaaaatatgatatgccatagattttaagaggcataccaatatcagagatgttaaaatgtgaaaaatagttgcatcttaatgtggaataaatatggcatacacttgttaggtatcaattagaattaaagtcctagatttgcttgataattttttgactctgttcaaagggtaaggtgaccaatgaaatactaac

SEQ ID NO: 470778 - DNA, 1153 bp, Homo sapiens
gccccattgaggaagtgaagcataacgtcccaccgtgtaagcatgagatgcaccgactggccctcacaccagtcactattagtgtctgcactaatagtgcagacactctgctctgcccagcccagctcactgagcccagcccacctggcagggcacctgggccagctggtcaacccctgggctcagctcctgctctggtgcaagcagggtggggcccagggatactttgctccccagatgatgccctccagagggcggaaggggggttgtctggagccaggctcactgcagaaagcctggaggaggagtcctgggtaccctgagctgagctgcacctccctcagtaccactgactgtcccttgggctctgctcccagcgcaggcgctcagctgccagccagaggagtggcctctggtgtgggcatctcacaacccctgacccccaggaggcacgtcctagacactgtgtgggtggaatccagggcctgtctgctcatttgtctggccagaggcactggctttgggcttctggtcaccttttctaaaaatggtcgtgtctcctccttctgtctcccctgcctcaaagcaagccttgctccaggcacgagggtgctgtttctgcacgaccccatcagcactattattttaatgtatttgtttctgccagtttgataggtgtgtaatggtatttcacatcttgtttacacttgcatttttaattgctcatgagactttgcattttttccatgttgctatttactcttggtatttctttctgcataaactgtcctatcgatcttttttcagcatttatcaaggggaatttttgttttgccctttattttaaaatagagcattgttctgttaaaaaaaaaaattctttccttccaccccccttttctgagtatcactatgaacttgtggctccttacctccccagcctgtcataccttgttaccttcattctttttaatgctcaacagttttttgttttgtttttaatgcaacattataacattttgagcattatgacttggaataatgtatttttaattgaaacaagccaatcattattaccttttaaaaatccttctgatagtcttcattatttatggattttgaagaatgtaacacatttttcagggtctgtaac

SEQ ID NO: 470779 - DNA, 892 bp, Homo sapiens
gtactgagctccctgtcccaggaaggatcccagccacctgaagctgattgattcccatcagggatgccatgcagagccttctgcacaagcagctggttggtctgcatgattttccagctgtgagattctgggaggttgccattcttcggagctgctgcctgctgtgtggaaggcggaggaggaaaggaaggaggccaggaaaggagcagagagagagcgatgcagcctacgaaatcacaggccccatccaggatcacccagtgattctggacagctttggaaggttccttctgggggtccgagggtctgtgtctgttaccctccaggctcctgccctagaggccctaacattgcagtggaggaatctgaggaagatcttggagaggcaactggcatctctctttgcaatgacagtccacttacttccatcccacgtggacctgcttccccagcttctgcccttggcgccaatggtcctggccacagatgggttaaggaagccatcttgtggagtttgaaagggaaactcagctaattctctccttcgtggacactaatcctgctgtgtacagctcccgggttctcttccccagaaaccacagctccttcccttttgaccccactgccctggcaattgttggcgttgctgcccctgtcaataccctcatgtgaaaccaaagaagacacaagaaggagaccactggcctgggagtcaggcacacgggtcttaaccctggctttataactcctcccctctctggactttggttttcccatctttaaaacagaaatggttccaggtgagaggggcctgaatctccctgccagcccttgtcccatgtttctttgactttaaggatcacacctcattgtgaagccctctgtgccacag

SEQ ID NO: 470780 - DNA, 4909 bp, Homo sapiens
gctgtccccttgtgcactgaggccattcaataggcttctgcatctttcagaggctatgccttctacaaaagggagactgagggcattacattttgtttttgtgaacacaatcaccatcatcactattgtcttcctcatctcaactctcatcaccaccatcaccattgtcaccattattaccagcatcaccaccaccatcacaaacatcaccattatcaccaccatcaccaccaacattaccatcatcataactctcatcactatcatcaccaccatcacagctctcacccccatcatcacgagcatcatcattgatgagggtacctgtgctaccttggaagatctcttcttcatcaagtccctactgctaaataagtatctgctgttatatatcattgctgtcaccatcatcaccatcatcatcatcaacataatcaccaccatcatcactatcaccaccaccatcatcattgtcatcaccatgaataccaccatcatcatcactaccagcatcagtatcatcatcataatcatcaccatcatcttcatcactaccatcattgtcatcaccatcgtcaccattattgtcatcatcaccacaattatccccaccactgccatctttattatcattcttatggttctggacatatcacttcaactctctgggcctcaatttccttacctgtgaaatgggcactgtaaatatttgcaaaccgtataataattatagggtttattgagtgcatttcatgtgcttgataccattctaagttcatcattcattacctcgtttaattctcatgagcacctccgagatcagattataaatagcagaactgggattctaacccgggccatctgactccagagtaagtctcttaattactaccatataaactttatatggtagtacaacgtttgtgttttaagctgttattacaagagtctgaaagttaaaaaaattaaaaagagtttacaaactaaacaagttacagtaagctaaggttagtttattattgaagaaaaaatatttttaataaatttaatgtagtctaaatgtacagtgtttatacttatagtctcaagcctcctgagtggtgataagtggcatatgcaaggtagcatgtaatgctgcaggatgtttctcgggcctttaataagtaaactgatgtgtgagctatgtgagttcatgagtgttaaatgtctgtgtgtgcacacttatgtgtgagtgtgacatgctatttaaagtatatgcagtcatgcgttgcttagtgatgaagatacattctgaaacatgtatcattaggtgatttcattgttgtgcacacatcatggagtgtacttacagaaacctggatggtatagcttactacacacctaggctatatagtatgacctcttattcctaggctacaaacctgtgcagcatattaccatgttgcatactgtaggcaattttaacacagtggtatttgtgtatctaaacatattcaaacatagaaaaaaggtagggtataaatacagtataaaagatagagaatggcacacctgtatggaacacttaccatgaatggcatgtggaggactggaagctgatctgggtaagtcaatcagtgagtggtgaatggacttgaaggcctaggacagtactgtacactactgtagactttataaacactgtacatttaggctacattaaatttattaaaaatatttttctttcttcagtaataaactaaccttagcttactgtaacttctttagtttgtaaactctttttaatttttttttaactttcagactcttgtaataacagcttaaaacacaaatgttgtatagctgtacaaaatatcttctttctttatatccttaatctataagagatttcctatttaaaattttttatttcttttgtacttcataaagttttttgttaaaagtgaagacatgaacacacacattagcctgggcctacacagggtcagcatgatcaatatcactgtcttccacctccacatcttgttgcactggaaggtcttcaggggcaataacatgtatagagctgtcatctcctgtgataatggtgctttctcctggaattcctcctgaaggacctgcctgaggctgttcctgagctatgtgatcctgttccagttccaacaattcctccttagtcaattcttcattaaccacctctgagagctcctcaatgtcatcctcatccacacccgggttgaagctgtttgccatttcaaccacagccttgttgatttttaatccccttatgcttggaaaatcctttgaagcttggataaacctcttgagtgtcttcttccagatgccattcatacactcattgatgacatcacttaagcccaagcaaggttcacgatgcaaagatgtaatttttccagaattgcgtcaatatcttctcagtgccttccttagttgtagcaatagcctgaacaaagatcttccctgagcagtaggtcttacaagctgctataattcgtttctccattggttgaatcaaagaggtggtgtttggagacagaaagaccacgttgatattgaaatgaagatcaccaataaaagagggatgtgtgggagcattatcaacaataagcaaaatcttgaaataaaatgctcactcattccttaaagctccatgaaatattatctgtctggagaagtttccaccgagtctccttggggaggaggactccctgccctctctgggttactgtgcattccctcaattgtgagataccatcgattgtgagatgcaccatcgatttaataatagcttttgggggaacagaaaccctgctctaaatgtatgtatttccatctcagaaatgagtaagtgtttttgaaaagtgcattttggagtcagggagaagcagtcagtgcttctctcatcgcacaaaggccacaagtattgactcaggcattcactcatccaatcaatcaacaaatcaatcaatcaatcaatctttattgacctctgttgcaggcactgagggggagcagttaacgaaatcaaatctcatgcagcttatattgcattgggagaaacagatagtaaacaaataaaaatataattgaatctaaataatctaaaagaaaggtcatactctcattctgttcccagccccactgaactctctgtggttcttgggcaatgccacatcctctcttgctcccctgctctgcacatgctgcccctttggtctagaacattatcctctggtcagtatcacttgccacacccaggtctaggctcctgcgagtctggttaacacttaattgctcttcagaactcagctttaagcaaaccccttctgaaaccctttactcttcccacccttcactgctggcctggccaggcccccttaggctggagtcatctctgttattcgtcctttggcactcagtttctagatgacaggaatcttgttcatctctgtacctgcagctgttctatttccaagcaggcagcttaacttaggcctcctggttgggcctttaatttggatttattgctggctgtgattgtatgttaaacaaactctaggcgattattaaaaacatgattattgcggtttatggtcctgcttggtcctcagtgggttttctggttctgagagctggccaagactctctgatacagtgcgagagctgttcaccaatgcaagatgcaatgggtcttctgttatttagttgttttttttttcatttgaaaagcaatctacataccagtccctggacacatagaatttccactgataagacacacagtccctgcctttctggagaacctgtcctagagctggagagagacaacaaagcagtttattatgctgcactctgctaggtgttccaaaacaaggcagccagcatggttaactgtccattatccttatggcgaccacattttcccagccccacatcaggacaactgacccggcaagcactcatgtacctagggagacaacagaatggaatatgggaaattgtgatggccagcaaaagtctgggctatttgggcatcttaattatagcattgatctcaatttacctgacatcagatttatgtgtgtgtatagatggagtgaggattaaaagaacaatagtggatgtatttcagagggcatgctcaggtatctttgatgtcttgaccttttcatcagatgccaccaagaatctgtatttttgttttcttctttaataaaattttgggaaattttaaccctgttacagagcaaatagaatcagatttccgtctttgcaataatacccacagctgattccatgcacttgtgatagttgtttatgttgctgactgctaccctgggcccctctctggggagtagggctgtgtaagggtgtctagcttcctcattggcaggacaggaagttccttgagagcaggaatggagtcttatttatctttatttttctatcccctccagtgcactgtacagcccttagaataaggtagagcttaagtagggcttgttgaattgaattattgagtagacaggcttgcgatgggaaataaacaaacaaaagaaccaacgccttataattcaatgctgctcaatctgtcacttgcagaccaaatccccagctccctcggatggctggagaagggagctcccagacatggagagagggatgtacctggcactgcactgtgcacacaggatcacactcatccttcctgcatctctgggatggaggtgctcttactaacaggttagggagcttcagtctcccagggaggacctggagagctgggattgggcccgtggcctgcctatcccggctgtacccttttcctcccagacagtgctgtctgggtcaatgttgctatgactcctcccctcccctggcccctcac

SEQ ID NO: 470781 - DNA, 1191 bp, Homo sapiens
gtgactgctgacagctggccctctccacacagccccttctatccttgggttctaggaatcagctaaagacacctgtagttacctacccccagcgggtgaagtggaaaataacctggctattagaggaatgcacgtctctgctcctttctctggctgctaatggaaccagcagctgtccccagccatgtgtggctgccctgaccctctgagattgtgggtggagatcagccatgggagaagactttgctcagttctgtttcccacagggcatggagacagagcagggcctgagcaacactgaatgtccccgggggagcagcacaagattttccgcagccattgctcccagcatccctgacagagcaagctccagcagaggactgatggaggagccaccggaccccgctctgctatcttggaagaagcaggcccctctggttcagcactgtctcactctctttccaatcatcgaccctggggcttggggtgtggatataaagatggacactgtcctcaccctcagaggcacctgttttggtggagacagtccatgtgcacagagtcatgggacggtttgggtgtgcatgcctctggcacctttgaagatggccaatgggaacaccaaactgaggtgtgatgattctgcttgcgataaatggggtagacggggacacaggagcacagagaggcagagcctcctgaaggtcacacagctggccacacacagcctagtgtgctccagctcctcaaggctccgggaaccccttccaaggatgcagctcagccagtctggccttgagctgcccaagccacctagaggccccacacccccaggtccagaggtccagagagagaacggggctggtgcagggtcacacagcaatcactggggggaaagcaggtctctgccggccagttttatgcctcttgcctgtgctgctgacaatgggggcatgaagccatggctctgtggagaacttgcagacatttcagcgtcctccctgagcaaacgcttatatcaggggtcactggcagagttccctctcccaggagatccggcgaagtgaagtgggtgagacgacagcagggagggatgaaagatgtttctggggtcccagagagttggcaggctccagggatgggaagtagggtgaacggagtactattcaccaccacgtgctcaggaaagga

SEQ ID NO: 470782 - DNA, 772 bp, Homo sapiens
tgtcattagaatctatgacctggaatgtgtgggggtgcagtcagtggccctgctgagcggggcactggaattctgaaggggactagagggagcttagaagcccctaaaatgatagcaaactctgcaggggctcaggccttgaagacaccaggtgcagggaggaactggtccccaattaatggagaaaatacaacaaagggaattatcaaagaaataattcaaggcagtttcctagcactaaaaaatatgaaccttcagattaaagggcctaccaagtggtcaaaacaaggggtctttgtgagatcttgcactacaaactgcagccaaggggatcccgaatgggcaagacttgatcctcatactggtgaaacctcctgagtccccagggaccctgtcagaccaggctccagcctccctgcggtctctgagagagaatgtggctagttctgccccacggctccctggcagtccagcggtcagaagtggccacgcagaacccaacattcagcctgggtgcagacactgcctctagcctcctccccaagcactctcctagtatggtaagagaataaactgaagtccctagaggccaagggtctcacctaagtggtcatatcctacagttttaagtctggagcatttctccttatagtttctctgtctagaatgttcttcccccatttcttcagctaaatcctactgctcctttaatatctggtcgtagttttgctgcctttcgaagtcagttgactctaactaggtcaccccattt

SEQ ID NO: 470783 - DNA, 1237 bp, Homo sapiens
agctccttgatcccacagtctgtccacatcccctgccttgctcacaccatgggggccaccgaccacatgctgattgatgacagaatctgtgagctcgggcaggaagaggaacgcaggcagacatgaggcagaacgttccttaacaagggctgagatgttccaggtacccaagataagtgtcctctgcagcagcttaggccttccagaagggtctcaggtgtccttggttgtccaagttctggatgtttcacaaggatggtagaaccatcacctccttgccctaaattctgcctcttcttcaatcccagcagcaaatctcagcccacacccgccaggccacatttcctgggctcagcacagtctggaagccttcccgtccctgcaggcaactgcctggagctgaagtcagagcttgcacagcaggtcatgggcagcaccaggcacaagggtccaggcagctgcatgtgcctccatggcaatgggcagcctgctcagaacctctgtgcactcacaggattcctctatagcaaagagtctggaagtgtgagggtgaagccctcccccaacctgcctggatttgctagagcgttctatttgctcatcctcatggccaacagatgtttgtggagggagatgtcagcaagcagggggctgccattgctactggttaactatgtggctttggtcaagtctcataattccttggaaccttggttttctcacttgtcaagagggggactgatgtttaccctgcagattcctcaggaattttgtgagggttggatgatgcaatatagctgaaagggcttcaagaagaacaaaacactatttatggaaggattatttcaggcttaaaaaaaggaggcctggggatggcagtatggaaaggcaacatttattgagcatctacgatgagtactttatagacttgtctcataccaccttccacacagctcttcagagaggtactatgggagtttttgcttctgattccagctgagaaactcttaacagaccacacctgccacagataatagctgtgaactctgaacaaaatatttaaaaaatcgttctcagaaggagagtaacttaaagtgggcagattccagaagggttcgcgtgggtgtttattggcacttgggagaagggaagggcactgagtaaatttcactttcttaataagtttagccggagggcaaaccccagtactcctcatgctaggtgtcttagatgggtc

SEQ ID NO: 470784 - DNA, 1149 bp, Homo sapiens
ggacctgcaaacaggccactatactacctgccaagatttgatgcagcaaggctctgggacaataggagttgtaggtttgatgctgactggctaaaagaggggcagcctggaagcagatggaggttaatgctaatgtcgctcagcacctactcagtgcagacatccggctcgcccgaggaggctgccattcaaacagccaccaattctccctggctggcgagacccaagtgtataatagcatcatgtttctaatggtcacagcaaagaaggattcagtcagagtcaaagctgatggccacagtttaaactgtttgccatctgagctgctggctgctttgccacctttagctaagggcttccaaggtgaccccaaggttgtctttatttcaggcagcccagagaggaatacgaacaaagaggagtcaaccgtccctcaagtccgggtacaaggccctcccctggttaccaagaatcactcccaaggcaaaggcaaggggcataagccctggagaagaatttttggatcagtgcaccccactttttgctcctcacacacaaacactacacataacctgcagacatcatgatagaatcatctggatacattatgaaatttcaacccaactgctcaggaggtctgaggcttgtagggtgagagaaagtgtgatttgtcactcagagacagactgaaactggaggatggatttctgataacacagtgtgatcaatgtatagcattttctgacttcggttaacaacacttcagctgttgttactcaatcttggcagctcacttcacattaacgttcatttccaaaggatcatctcagattcaagtatctttcacagactcttagcccattcagctggcaataattattgccttgttgctcaaggtgaagttctacttgttgctgcgtgacaacttccacaagtgggggctagcttcttaggtgggcacctctcacccccacttctgtgcaacatggccccccaaagcattattggtctcataaaacattatatctctccaaccacgaaaggcttctgactccgatttctcccctgaatctattcctggtcttctgagaatggcagtgagggagggctgctttcatttggattgctttgcttgcttcctggttatgc

SEQ ID NO: 470785 - DNA, 544 bp, Homo sapiens
gaacggtggatccactgacagcttgcactgtgcgtcttgaaaagctgtggacactcaatgccagcccatgaaagcagccgggagtgagactgtgccctgcaaagctacaggggtggagacgcccaagaccatgggaacctacctgttgcatcagtgtgacctggatgtgaacactcctgagcatggctccaggttctgtgggagcatcaaaggaagcatcactctaaacattcgccaggtccagaaaaagccattattgatatatcaatgcttggattcctcattttttgcctctgtcttctggacctctttggcccagtttatctggcactgggagcctgaccttgtgttctctccagcatttaaggggacacctggcttaaggcagcccctggttcttctgatggaaggtgcaaaattaataccaacactatataaaatacattcaagggtttattacttacagaccttggacagggagggtgcaacgagtcaaatggaaagagcagtcctccatccctgagtcatgtgaagcagaaataaa

SEQ ID NO: 470786 - DNA, 1895 bp, Homo sapiens
ccaacagaagaccaaagagagaagagacagtgtaagatgtttattcacatttctcccacctttccaggcctggtttcagcagtgactatattcttctactttagacaagaacttctggtgaatggaggctctaccacagctacaacttttacacagttgtgcagaggaaaccagaggctgtctttggcaaacagtgttgaaaataacattctcaaattgctacaggaagaaaatcaatgtctaattcacacattttattctcagcccaaccagacattttcttatatttatgaagaacttgaggaaacacagcagcccttcactgttctcttcaccaagttaactcatggcttccatggtgcttatatgatgcatgtgtgtctaataaaaagtcaatattgtgctaaatacagtttagcctatttttattttcatatgcattatgttaacaaataagtttatgttagtatattaggaaagtatggcattcctgacatttaatatacagggttatattcttttggtgttataatttctgttcaagtttgatttctgagaatacaccattggcctccctcaagaacaaaacatctctatatcctcagtgccttctacaatgtctgccaaataataggaattctgtaaatgctagctatgctttttttgttgatagccagcatatgcgtatagtttgaaatcatatttatttattttaaagtaaattcataattttgtcctaagatatatccagaagcaagcaataaaactaggctgactgctaagaatcaaggttgaccctcaatgtataagctttcagaatcagaatataagtaggaggtccaggaatttcattgtaaatgcctaaatctcaaagaagagctgtgtttggatctcctcccctgtattggtatatatctatgagctctgctcttgaaggcagacaactgatactctgattgctttccaaattgaaagcttcacctgctgtttgcaaacgtgttctcttctcttctgccctgttattgaacaaacaggcattgatttctatctctctcttaaaagcaacaacatcccacagataataaagacagccctgcctgcttagtgaagaatttaactgagactgatattaaaaaaaatatattaagactctgattgtttcacagtctgttggtagatagattcctgttatgaaaataatgaatctgatgtgacagatggaacaggtgtaactcactaactattaatacatagattcccagagagaaaagtatgtggaagatatttatgacagtgttacagctgaaagcagttggctaaacagacatatcaaaggtggccaatgatacttgtgcttagtaagcagaactaaactcttcttttggatgaagatcagcacttccataaaaagtaaagaaagggaaaaattttacattgctgtcaaaaataatagaatagatcctgcttaaggtgctgaatacttagtgagccatacactgaatagcctgttattaatatctatttaaaatatgtgtttcacttggattgtcagtgtcctatttatgtttatttattttaaaataccctttacatatgacctcgaaaataagtgcatgggaaatgaataaaaggagacagagagattgattctgattcatgatggaaagactcacactatctgcaaattctctgaatttatttaaaatttcgtgattaatcaatcaactaactgatccattgaatcaatgacttattgatttatttatgccttttgctcttcctccaatattatgttttatagtctttctgtcccaggaactctgataagtttacagatatacagatataaataaatcattatagggatctatttattcatgacaaatatcaattac

SEQ ID NO: 470787 - DNA, 485 bp, Homo sapiens
agccagcagtcaagcagcagccagacacattacaagtgggagttaaataataacaacttatgaacacaaataaggagacaacagacactgcgatgtacttgagggtggagggtaggaggaggaaaaggagcagaaaagataagtatcagaaatctgtacatgatgtcgccaagtcagcagaggccgagctgacgaggcaagtcagccctctggcaggcttcagcatcagagcactacgagttgatgagagttcccaggggacagtctttgtttggaatggtggtggcaacactgctgtcatagcaaagatctcagaagattcaggacctgctcctggatcagtgccatatgatcaggaagagatgtcccaacatgccagtttcactagaggaggggaggggaatgggaaaaagcattcaacttttccaagggacctccacagaggactgacttttttcttgccaatcctggagctctgatataat

SEQ ID NO: 470788 - DNA, 902 bp, Homo sapiens
taatctttctctctctctctctctctctctctctctctctctctctctccatatatctaaactagtctggaagacaagggatatgaaagcatgggagaattttcaggcccctcagctgcaggtctgttggagtttgctggtggtccactccagaccctatttgcctggatatcaccagcagaggctgcagaacagcaaatattgctgcctgatccttcctctagaagcttcgtcccagaggggctcccaccagatgccagccagagctctccagtatgaggtgtctgtcagcccctactgggaggtgtctcccagtccggctacacggggagctgtcaggcagggacgtttaagtctgctgaagctgtgctcacagctgtcccttcccccaggtgctctgtcccagggagatgggggttttatctataagtccctgactggggctgctgtcttttgttcacagatgccctgcccacagaggtgcaacctagagaggcaatcggccttgctgagctgtgactgctccactagcagcgagaatttcaagccaatggatcttagcttgctgggctctttgggtgagggacccactgagccaagcaccagagggaatctcctggtctgccaattgcaaagaccatgggaaaagcacagtatctgggcaggagtgtacctttcctcctggtacagtgtctcacagcttcccttggctaggaaaggaaaatcccccaaccccttgtgcttcccagattccagtatatcctacagctttggcatccttggcagtgactacctcacaaactcaacgtgataactctatcttttgttcaaaaaccacttatgaaggtgtcagctgggtttggtgactcatttgtaacaaataaagtaggagaagaaaactc

SEQ ID NO: 470789 - DNA, 890 bp, Homo sapiens
cctccacctgacctcagaggacagaggggactcagagcccttcccagggctttgcaacacttcccagagcccatctgttttctttttccacatgggcttttaggagctgaaaattttcgcctattggaaaatcctggggaggggaaggggtatgattttcatgacctttcctctcttttttcatgttgaattagttgtaagtcaccttgaaaaaaaaatggccctggactctgaaggccaggagatcccctctagtcacttctgtctgagcattggcagttgcgctgtgccaggcagggaacagcatgaagcaagggaggagccgacgacaaacagctggtctacccaggtcactgcccaggaagcccctgtggacttagccacagctcagggccctgagatgaccaggatggtgtctcccactctgtgtgtgctggatgacagtggagggagtagtagaatggtgttaccaaagtccctggagagctggagccatgaaggaggggtggtcctaaagaggctgcagttccgccccatctgggaggtgaggagcgcctctgcccggccgccccatctgggatgtgaggagcgcctctgcccggccaccaccccatctgggaagtggggagcgcctctgcctggccaccccatctgggatgtgaggagcacctctgcccggccacccttcgtctgggaagtgaggagcgcctctgcccggccaccccatctgggaagtgaggagcgcctctgcccggccgccccatctgggaaatgaggagcgcctctgcccggctgccctgtctgggaagtgagaagcgcctctgcctggccgctgtgcaatcttccaagtgtgaagtgacagcctttctgcaggtgtacccaacagctcc

SEQ ID NO: 470790 - DNA, 1277 bp, Homo sapiens
cccatctggactcaggaagtcctgccatttcagcaggttgaggttcctgggcccccaggctccaagtagaccagagactgcagagtggtgccaacacagccgcctgggctctatccgggctgctggcatccgtgccaggttctgtagaggtttctgcagccccaccctgttctcttccagggattttgtggggtacagcctccttcagcagtaatgtcagccctgagggtggtccctgacagcaaaagtggtggttggcccagtgtgaccgaagggtctggaaaggagcctggaaagtacccccggcccgacaatgggggcttcagaggagcctggatggcaggacacagccccctctgtgaagcggagttgaccgccaagctggagcacacacagcatcacctacagacacccagcatccctggcacacagcgtgctgtggcaccaaacccacccccaggaaggcaggctctgtggctggtccccacccagcctgctgagtgtttaagtgccctgggggtggacccgcccctccacactcccaaccttggtggcctcaggacagctgtactccctacccatagcactactgtcctccctggccagcccccagtcatggttggctcccgccatagctctgtctctcctcctcataggcagctgctccaagagccgcagctctcaggaccgcccctgccaatggcccgtctctgttgtctctgtcttcggcccatcctgatgacggagcctcctggaagcccgtccatcgcagctcctcagcgatgctctggctcagactctggtcctctggctcctccaggccacagacgcctttcccctgccttctgcctccccgactgtgctgtcctctgggctctgaactctccgtctctcagggagcccttcatctccctgggggaggggcccctgggacaggggaatcctgtttaaggcccttccctgcctgccgcaccagtctccttcccttcaagtgttccttcctgtggccctggaaaatcccttcatggggacagtgagggatggggttgaattggaatgggatcctttccctcagtccctgtttctctttggaaccaacctggaaaacagatttgtttccaacataaaaatctagttgagtcactccccttttcaacaaccttcagtggctccctattggcttcaggataaaagcatctttagaatgacataaaaggtccttggtgatccagcttctgcctactctccaagcacctctcctgcctcttggccacatt

SEQ ID NO: 470791 - DNA, 1517 bp, Homo sapiens
cacgagtcagtggcagggccaggactaggacccacaggaggggacaagtttggatggcaggagttggcctgggtgatccctggagcccggtccagtgctcctatttcttaggacctggcaacgcaggtctagcctctgctcgggaagatgaaggaaaggggcaggcgccctgctccctggctgcgctaaggggtcactggcggggtcttttctcacggtgaacctgtctggagggtggacggggcaggtgggagggcccgtgtcagggagcgtccaatgccctcgcgccatgcaaatggcacgcaaatgacccgcatgcggccctgcccaccgcagcttcccggggcgagggtcttcgcagcggttctgaatagaaagggcgctggggacgggggaggccgtccagagagaagcagcactccccaccctgccagggccaggaccccacttttgtggaagggaggagcgagtcggccctaatggctcatgattcatcgctgggctcttgtctgagctaattggctgggccagcgactgattcatggcagggagccgggctctcggggacccccgtgtccctcccccgcgcctcccgcccaggaaaggctgcgtgaggcttttagacccaggatccgttccaagggaccgctgcccggcatccatcacggctgacagactggggatcggggtgggggaggggacgccgacacggagctgccatcggatgcgacggaccccaccgagcaccccagccacggagcggcttccgcgggcagcctggggcctgggcggggtcctagggagtgacactggggacatccaggcagcctccgcagagggagccctggacttgcaacagcaggggatgaatggagaatgcagcccgcagcgaggcaccaccagcctctccgtggctccagccaaaagctcaggcgtcatctctactcctccctttgaccctcagcgacagtcagttgaagccagctgctatgttgtaaggacactcgagcagtcctatggggaggcccatgtgctgtcaggatcacagccagccaggaatggtgtgggatttggtgctgctactcagttttcggatggggacccgaggctcaaggagcgggtagtgatgtttccaaggttaccctcggacagtggcagggttgcaatcagaactcaggtcatcttaactcccagtcaagagctcagtctgcaaagactaagtcatcgcaggagtttggtgctgatttctaaagtggcaggagagccaggggaagggcggggcgttttggctcacctgaggcccggctgtcagtccgtgactccctgcctccacggctctgaggaggccccagcccatgttggtgagcgagtgctgtgtgtgaagaatgggccccgtcagcctgagagggagaggctacattgagccctcacacgaatccatgtagtggccaggcgggacactatgggtggggtttggagaagggaaaaacttccagagacagctcttcaggactggt

SEQ ID NO: 470792 - DNA, 1438 bp, Homo sapiens
ttagaggaagaccgtggggtgcggggaacgatggctgagctcgtgccatgcccaatggacagttgctagtacaatcaccccactgtacagataaggaaatcgaggctcagagaggcatagtgactctcccaagaatgataaatgaacattggtctcaacttcaagtcaccagctgcacagttcctatccagagagtcagcctttcctttgaagctttgaacctagacattgacttctcatctacaactatggaagtcctggatggcatcttcttccgaaagaaggctgtttcatctacactggaaatctatttggggcctgttttgccttcatgtgttcactggagtagcacttttaatttccttcaagaacttttcctttacacttacaacttggctgtttggcacaagaggcccagcttttggcctggcttggctttgacatgctgtcctcgctacactccattatttctagcttttgatttatagtgagaaatgagagactctttcacttgaacacttcaggtccattgtagggttattaactggctcaatttcaatattgtcctgtcttggggaatagagaggtccaagaagaggggaagagttggggttttgggcaattataaatcaagctgctgaaaacacttgcatgcatgtgtttgtgtagacatagttttcaaatcagttgggtaaatactcaggagtgggatggttggatcgtatatttagccttatgtgaaacttccaaactgccttccagtgttctgtaccattttgcattcccactaacaatgaatgacagtccctattgcctcatatctttgtcaaccaattgatattgttagtattttaaattgtagccattttgataggtgtgtagtgatatcacattttttgttttggcttttgttttaattttcaattccctgatgaaatatgacatggaacatcaaatgttaatttgccatctgtgtatcttctttggggagatgtctgttcagattttttgctgattttttaagtgggttggtatgtttttatattgttgagttttaagagttatttgtatattttggatacaagtcctttttcagaaatgtgttttgcaaattttttttgcaatctgtggcttctcttcattttcttaacagtgtcttttgaaaagatttttattttgatgaagtccaatttatcaacttgttcttttatgaattcctggttttgttgtcatatttaagaaacctttgcctagcccaaggccaaatatatttcctcttaggttttcttctggaagttttataattttaaattttacatttggcctatgacaaattttgagttaattttcatatatgaaagtcccccaggctctgcccagttctttctccctgtgccacagcctgataactctctaggcaggaagctggagaaatctt

SEQ ID NO: 470793 - DNA, 1022 bp, Homo sapiens
tcctggtcattcaagggcagagtctagatgagaactgctctagcgctcattcctggttctagctgccctgaactctggcctctaggctccctgttcattgttttctggcctgtagctaaggggtctggacagcaatcaaatcttccctcttccctggagggagatggtatatcttctaaggctgtttgctacacaagcatccttgaaaagatagtgtggtacaaaagctgtcaatgtctctgctcagaaggcctgcagaattgtgggagacccacggaaaatgtctggcagatcagcaaaggagaagacattgaaggatgcaatatttgtattgatttacccggatttccttctgatcatcatcctccgcagtacccttcctcacccaaatccttctttctggaagttattatgttctacagggtagcagacaggaacaccacaccctgtaataaaaagtcagtgtggtcattccgtgagaggtggccagctctggtgggggccatgggagagcaccacggattctgcaaagtgaagctgaatttctgtttgggggtccatgtggttcaggggaagttgactgctctgccagctatgatgggggcccatgactggtctacgcttatcaatggattccatgctgctggtcacagttcaggggattttgattgggatggaattgaatctatagatcaagttaggaagaatgctcatcttgacaatattgagtctttctatccatgaacgtgagacatctctccatttactcagttctttgacttctttcatcagttttgcagttttctttatttagatcttgttcctatcttgttagatgtgtaaataagtatttctcttgggggatgctaatgtaaatggtgctgtttttaattttatgttccacttacttatagctgattgtctatttctttttgtgtgagttttggcagattatgtctttcaagaaatcattccatttcatcttgattatcaaatttgtaggcatagagttgttgttagta

SEQ ID NO: 470794 - DNA, 879 bp, Homo sapiens
gatggtgcgagattccagagagaaggtcagagccctgcttttcttcctgccaccctgatactgttctccttcctgcccagctgctgagctgaatgctaatggacccaggctcagtctcagcctccagtgctcttgtctatactcgcagcttctttctgtcctggcgtatgattggaagattgacttcatttgcaggtcatttttaccgtaaaggggaatcgataaaggaaggtctccctcaaccaatctgcacccaggaaatgaacccactggcaaatcccgacatagaagctaaaactgagtttttcattccagcggcagccgggagtcctggacctgctcaccttcagcaggatatacccttcctccctctgccttgggctcacagcttctccaggacccccatttcactcagcgagaaagccaaggcctttacaatggacttcgagactctatgggacctggcgctcagccacctctctgacccttgctactgccactgccccctcccttaccctgcgccggccacgccagcctctcctacgcagggactggatgtgaagttttccttcaatctggttcactcctctcccagtgaggttacccacgaggccacggaaggaactgtgaacataaaccagcaaaactgagaggataaagagtccccagggctatcagcccttttatcttcgcctttattccacccctctttgacctcagactcaagaaatctaggattttccccagccatcctttgcagatgctgttctcatcttgcatgccctgaatttaatgaggatgcatctcatcttctaccatggttttgatttcagctaaactttttaaatggtgctaagaaaatatcagtctgaatcagtt

SEQ ID NO: 470795 - DNA, 5787 bp, Homo sapiens
aaaaattgtcttccacgaaaccggtccctggtgccaaaaagaaacagaatactgattttagcaggacacattgccatgaagaatgtctacttcgaagctaactgtggccacgtgcagcacttcgggtctcctcccaagactgtgggtctttataggaccagagatgttgcacaaggtggagctctcctatttgggaggagccacgatcacctcctggttctcctgctgggacttgctgctggtacctgctggcaggaccccaattgttcccctactccatcatggttcctggcttcagcttgcatgtcctcagctcataagatgttggggtccacgctgggctatggctcattccagaagctgaactcaaggagcaattggtgtctcctggacaacagcatccagctgcactccttccggacctccaggtgcagtgcctggtcctgctccctacagcacgtgttccacttgcccatgagggagcagggtagtcctcatcctagtgcagtatggacagtgctgcctccatcagtgcctactataggcatccgggcactcaggcttctcactgtgaaactggatcttgtagaggttgctggtctccttcttggacagcagggcagagtgggcatccttccagggatccactttgtgaacaaagagggagcagaaccagtagccttcgttgtccttgggatagaaatgcagcacagccgcagctgcaacatccccagcacaggcctgggccttccagtagccactgtgacactgcagagatgctgcacagccacgaagccatgggtaaggtgatatcacattgtggttttgacttgcacttccattataattagtgatgctgagcatttttccatatgcttgttggggccatttgtttatcttcttttgagaattgtctattcatgtccttagcccactttttgatgcaattgtttgttttttttttcttgctgatttgtttgagttcattgtagattctgaatattagtcctttgcctgatgtatagattgtggagattttctcccactctgtgggttgtctgttgactctgctgattattccttttgctgtgaagaagctttttaatttaattaagccccatctatttatctttgtttttgtcacatttgcttttgggttattggtcatgaagtctttgcctaagccaatgtctagaagagttttcctgatactatcttctaaaatctttatggtttcaggtcttagatttaagcccttaatccatctcgagttgatttttgtataagatgagagatgaggatccaatttcattcttctacatgtggcttgccaattatcccagcaccatttgttgcataaggtgtcctttccccactttatgtttttgtttgctttgtcaaagatcatttggctttttttctgggttctgtattctgttccattagtctatgtgcctatttttataatagtaccatgctgttttggtgactatggccttatagtatagtttgaagtcgggtaatgtgacgcctccagatttgttctttttgcttagtcttgctttggttatgtgggctcttttttggttccatatgaatattaggattgtttttttctaattctgtgaagaatgatgatggtattttgatgggaactgcatggaatttgtagattgcttttggcagtacggtcattttcacaatattgattctacccatccatgagcatgagatgtgtttccatttgtttgtgtcatctatgatttctttcagcaatgttttgtggtttgtcttgtagaagtctttcatgtccttggttaagtatattcctaagtattattttttgtaactattgtgaaaggggttgagttcttgatttgattctcggcttggtcacagttggaatatagcagagttcctgatttgtgtacattaattttgtaacctgaaactttgctgaattcatttactagttctaggagctttttgatgagtctttagagtttttccaggtatacgatcatatcatcagcaaacagcaacagtttgacttcctctttatcaatttggatgtcttttatttttctctcctctctgattgctgtggctaggacttccattactatgttgaatggaagtggaaaaagtgaacatccttgtcttcttccagttctcgggggagtgctttcaacttttcctcatttagtataatgttcctcatttagccgtgagtttgtcatagatggctcttattaccttaaggtatgtctcttctatgctgaatttgccaagggtttcaatcataaagtggtgctagattttgtcaaatattttttctgcatctattgagatgatcatgtgatttttttgtttttaattctgtttatgtggtgtatcacatttattgacttgtgggtgttgtatcagtcggggttctctagaggagcagaaaagtaggatagatgtatatataaaggggagtttattaaggagtattgattggctcacacaatcacaaggtaaggtcccacaataggccgtctgcaaggtgaggagcaaggaagctagttcgagtcccaaaacctcaaaagtagggaaactaacagtgtagccttcagtctgtgattgaaggtccaagagtcccaaagctgaagaacttggagtctgatattagtgggcaggaagcatccagcgtgggagaaagatgtaggccagaagactcagccagtctagtccttccatattcctctgcctgtttttatcctagctgcactggcatctgattagatgatgctcacccaaattgagggtaagtctgcctctcccagtccactgactcagatgttaatctcctttggcaacaccctcagggcgcacccaggaacaatactttgcatccttcaatccaatcaagttgacactcaatattaaccatcacagatgttaaaccatccctgcatccctggtatgaaagccacatgaaacatatctttgttagtcaaaataggaaccattacaagcaacacatttttgtcaatgagaaataagtttgtttattcctgtagcgtaaaaaatccttgcttcaggattgaaacgaactcacggaaagcattttctgcatcctgctggttgtggaagccttttccctgcaaaaaattgtcgagatgcttgaaaaagtggtaatcaattggcaagaggtcaggtgaatatggcaggtgaggcaaaactctgtagcccaatttattcaacttttgaagtgttgtttgtgtaacaagtggtcggatgttgtcatggagaagagttgggccctttctgctgacaaatgttggctgtaggtattgccgtttttagtgcatctcaccgattcgctgagcattcttctcagatgtaatggttttgctgggattcggaaagctgttgtggatcagactggcagcagaccaccaaacagtgaccatgacttttttggtgcaagtttggcttttggaagtgctttggagcttcttctcagtccaaccactgagctggttattgccggttgtcatgtaaaatccacttttaatcacacatcacaatccgatcgagaaatggttcattgttattgcatagaataagagaagatgatagttgaaaatgattttttttttatttttgctcagttcatgagcttatcgagctttttcacctttccaatttgcttcaaatgccaaacgaccatagaacggtcgacattgagttctttggcaacttcttgtgtagttgtaagaggatcagctttgatgattgctctcaattggtcattgtcaacttccgatggcaagccactacactcctcatcttcaaggctcttgtctcctttgcaaaacttcttgatccaccactgcactgcccgtttgttagcagttcctgggccaaatgtattattgatgttgcgagttgtctcccctgctttacgacccattttgaagtcaaataagaaaatcgcttgaatttgctttttgtctaacatcatttccatagtctaaaataaacataaaataaacagaataaacagcaagtaataagtcattagaaaaaaaaatgagaaatgcccattaaagtgatgtataacataacacatttatttaagaatgtattccaatatcaaagagcaaattccaacaatgcaaaaaccacaattacttttgcactcacaaaagtaattcactaaatgtgaatttagtgaaattggctcatggtgttcaaaacttctgtatctttattgattttcttaatttttctatcagttattgagaagtgagaattgaaacatctaagattgtggatttgtctattttttccatgaaattacctcagtttttgcttcaagtattttaagactcttattagattcataaaattttaggattattatgttctcttgatgaattgatccttttcccattacaaaatcatcttctttacccctcataatttttttggctctgaaatttaatatagacacataagttttcatttaattaatgttagcatgctatatctttttccatccttttatttttaatctacttgtgtattttatttttaaggtgtgttttttgtggacagtgtgtaattaggccatgttttttattcagtctgaaatgttttaaattggggtgtttagaccatttacatttaatgtgattattactatggccaagtttaaatctgtcatcttactatttgttttccatttgtcccatttttttattttttgctctttttctgccttcatttggtttaagcaagtatgttttatgattttatctcctttgttggtttataaaccatcactttttgttttgttaatcatttcattagtttattttttatatatgtatatatatatttaacctgttatagtccacttacaagtgatatgatgccattttaagtatggtatgggaaacttacgatagcgtagttccatttatccccacccaacttttgtgttcatgttattatacattttccttttgtatatgttacaaaccctgcagtacattgttattatttttaattacacaaacattatctttaaggtttaagtgataagaaaatgtcatatatttacatatgtagttactatttctagtgctctttattctttcgtgtagatactgattttcacttgatatcattttccttctgtccagaagacttcttctaacatttcttagcatatgggtctgttggcaatgaatttttttaacctttgattttgaaagacatgtctgttaagtatagaattctagtagacagtattcatctttcagtattttaatgatgtttctctattgtccccttgtttgcactgtttctggcaagtctactgccatccttaactttgttctctgtatagtaacatctttctctgtagttgcttttaagattctctctttatcattgatttttagcaattcgattgtcatgtaccttggtgtggtgttctttatgtttcttgttcttgggatttattgaggttcttggatgtgagtttatagtcttaatcaaatttggacattttgtgaccattattccttaaaatatttttctgccccacccactactctgcctgtcttttcttctggtgactccaattacatgtatataaagccacctgaaattgtcccatagttcactaatgctatattcatttctttctattttttcttctgtgtgttcatttttatagtttctattactatgtcttcaagttcaataattttgtattctacaatgttt

SEQ ID NO: 470796 - DNA, 701 bp, Homo sapiens
gctcttcttgagactgaggttgccacatccaggaatgctcacggcaaactcgtctgtggggacaccaaacccacccccactgccaagtctccaacccttgcccctggcccctgccaggaccccctaccacaccatgagggtcctctggtaggccttgcaggagcgacacggggcagtgagaagattctggcttctggacagccgtgggtcatgagcttccctggaaaagggatggttgcctagagatgacgccagggtctcttcccccagacatctgccagcgctggcatcagggcgtgtccctgggagccatcgatcagcactgggccaggggattgcagcctgcgggccctgtgccccacacccctagaacaaatctgctcacaaaagaattggcagatgcagcagacttttaccaaagagtcagcgggggaccaccagaggggcttgatgcaggttcacaaaatggtggcattagcatgatggaagatggagatttttggcgctctgacatcaaacgtcacctactggacactcacacagaccaagttgaaggattgatagaactccaaattctccccttctataacccagaggaattcaaacattccccagttaccataccagcaaacttcattcctaacccagccagctttgcagatctgcagatcctctgcaagggagaataggggactctcctg

SEQ ID NO: 470797 - DNA, 786 bp, Homo sapiens
tgcagctgccctcccacatcctgtccactttctctctctctcctcatctcgcttcatgccactgttcaggctcctggggctccacgtggacgactgcgtctgtgttctacggcagttacacacacgcagtggtattcacaagcggttttgtggactcaaaggttttctccctgagaggcataacccaggccagctgattcatcagaatcagctcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccgagggaggttctggccaaggtgggctgggcagggcactgtgacaccgagcccatcccccacatgacccagatgaaagtcgagagtgtgggcctctacgaagaaactaacaaggaagcaaggggacctgttccacccccagggttcctggagattcctggagtggaagtcaatgccctggctcccaacggacctggatatagggggcccttggttcccccattatgattttgaacggagctgctgggtccgtgccatatcccaggaggaccagctggccacctgctggcaggctgaacactgcggagagg

SEQ ID NO: 470798 - DNA, 549 bp, Homo sapiens
agagctccagcaggacactccaactgagccccaccctctctgtgtgcaggtggaaatgaaggcctgggggcggggggaatggagggaggcataaacttcaaggtcacacagcgaaccccggtcagaacgggcctaaacgtagggtttccgctcggctctctagggagctgggagcccagcccccgcctacccccacagccgcgacggaatgaggtctcaccgcaggccgctactgccccgcgctcgctcactccgctgagagctccgcgctgctgggccgctcgcacagagcccgcagctgttgtcccggtgtcactggcgacgggcatcggccacttccggtaccacgggcggcactccagccaaatcaaggcgcgcgtcgcacatccgctggagagaacaggtggtcagcgcaccgacgcccccttgccttttccggcttgcttttcgccggttctagccctagcccaagttccacgtcgccgccgcctgccgagccggctccctggaacagcaaagtagcacccgatcgatgcccacttcagcccc

SEQ ID NO: 470799 - DNA, 729 bp, Homo sapiens
gaagcgctgagccagcacgatgcacataagggaaggaggaaggtggcttgagggcagtgaccgagcggacagcggaagcccatttcaggagccccggtacccgagctcgggcccctttccaatcccccaggcgtccttcccatgtccttgtctcctagtcctgggaatccacggccactccactctcctgcagtaccgcggacaagaacaccatgtactcttcacaggcaggtgtcttctggtggacccaactctgttggtacttgtcgtctccaaaaagtccccaaatgcgctagaggccagccagcccggtatccgagagcgcaggacctcggcagccgggggttgggctcgagggctgagggcggcgcgccatgcgcggattagctgccatccggcgggtctttctgccggggaccagtggggtcggacgctgagggccgaggaaccccgcccccccaccgcaccgggcgggctctggggcgtccgcggaggctcccgcgtgcgtgtgcggggtggggtcggggtggcagttgggggcaaatcaatgggcctgtacttttgtctctccgcctgctgggatttgcagtttgtgaggacgtttcacatctcacggatatttacggagtcccttccacggcccaggctcttctggacaccaaaccaggcctaatataactatttaatatctaattattacaattaaacttatttgcagtcgggaagcat

SEQ ID NO: 470800 - DNA, 3689 bp, Homo sapiens
cccggtcgtatccctcggactgtctgcccgacgcggttgccacggtgccgccaagcgcggctgtcgcgctgccccggtgtcagcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcgatggacgcgtcttcaccgtccgcatcgaccgcaaggtcaactcctggagcggctccattgagattggggtgacagcgctggaccccagtgtgctggactttccaagcagtgccacgggcctgaaggggggctcgtgggtagtgtcgggctgctctgtgctgagagatggacgctctgtgttggaggagtatggtcaggacctggaccagcttggtgaaggggaccgcgtgggcgtggagcgcacagttgctggggagcttcggctctgggtgaatgggcgggattgcggtgtggctgccacaggcctgccccctcgtgtctgggccgtcgtggacctttatggcaagtgcacccagatcaccgtgctaccccctgagccaggcttcagcccccctactcccatccccacacctcccctcgagcccttggcccccactgaagactctgccttggctgaacaggggacctctgcagatgaagccttcatggtgtccccagcgcaggcccggccggagacgtttcctaacagccttgagtcgcataatgactttgccaacatggagctgtctgaggtggtgagcaacaccatcctgtctgcctacaatggagggctcctgaatgtgaacctgagctccccaccggcaggggaaggcctgggatctagcggtgctgccacctcgcccattctcacttccaacgatgccctgctctttcatgaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggtaccagccccgggcaggggcgggggtgcaggcctggtgttgctgaggggaaggaagccccgtacccgaacccaagtgtccactatcacccaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccaggtgcgcatcgacaagatggtggacaaatgggctggctccattgaaattggtgtcaccacccacaaccctgcctacctccagttgccctccaccatgaccaacttgcgctctgggacctggatgatgactgggaatggggtgatgcacaatgggacgaccatcctggatgaatacgggcacaatctggaccgcctcaaggcaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtgggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccggaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccacactagcaccgggggagatgggacccggggcaggcggtggtggcccagggctgcctccttccctgccagagctccggacgaagaccacttggatggtatccagctgtgaagtgaggcgtgatgggcagctccagaggatgaactatggccggaacctagagaggctgggggtggggagccgtgtgggtgttcgtcggggggcagatgacacgatgcacatcctggtggatggagaggatatggggcctgcagccactggcattgccaagaacgtgtgggctgtgttggatctctacgggccagtccgcggtgtgtcaattgtcagttccacgagactggaggagtcagaaggcacccagcctccttcccccagttcagacaccggcagtgagggcgaggaggatgacgagggcgaggagcatggcctgggaggccagaatgaagtgggtattatacccaccaccctcgagttcctggagaaccatgggaagaatatccttttgtctaatgggaaccgtacggccacacgggtggccagctacaatcagggcatcgttgtcatcaaccaacctctggtgccccagctgctggtgcagaagaaggtgcctttttgctacaaactgaaagatatgtgaaagttagccagctgagccc

SEQ ID NO: 470801 - DNA, 785 bp, Homo sapiens
ggttacatcatggctgttggctgtgttacttccttcctggagccttgatgttactatctccacaggcgtatgaagggagggggcagtgcacagcctccccaaagccaaggcttccttcattggaggaagcagacggattaatcttcagatgtagtccttatcctcccatcatgcccatgccaggagaagctatcagtgatagagaagagaataagagacagctggttggacatgatacctacaacttatcaggaaagaccatgactttctggactcagaagatccatttctttagctataccacctccactgcctctttttctaccgtccaggttcttaatttctggtaccttggctttggaataaagtttaaacacagtatccatggaaccatgcacattactcctctctctgagggaaggaagcatctgtacgataatgcaggaccaatgatctagaagttgagtgttggttgggaaagcattgaatctggagtcaaaagaccaaggatatttgcatctttggagaccctttatgtaagatgtgaacagtaatcctgtgttcttaagaaaattttacactcatagagatcaggagctcagctctggagtcaggctacctgggtaatcttgggcatgttactgtatttctccctgaagtctcaatgaagaggaaataatacccatttcacaagtgtggtcttgagcaataaataagataaagtatgcatggtacttaacatgtacctagcatggagaaaggaattcaatgaatattcgttgcta

SEQ ID NO: 470802 - DNA, 1552 bp, Homo sapiens
caccctgccctgggccagcctacaacatggatgcctctttgtccctcagactccagcatgccacgtctttacccacacggaagcaaccctcagccttcgtgggctctgacactctgcctggggccaccctaccctcacctccccacatggacgtgctcctccactcaggctctgaggcaactgctggatatttcctgaacatccagggacatgagaagccttttctgtacatcatcccatgtggccctcacagacaccccaaggccttgctacggcctctgctctggtggaacttccggatgaagaggagactcacccagcgcttccagaagctggggcaaagaggagcacacacgaccacctgcctactgagcagctcacacttcctccaatggagccaccacaaggtaccggcctccagggcaactgcaggcaatcctggccctcagggccttatggcataaaagggagagaagccatgaccccagcaggcctatgcagacacagtgagagaagaggcccagagaaaaagctatggacgtttagatccagtggagggatctgagtgggcttcctggaggtgactctgccccccgaccccattaaacctttaaattaacttcagctccaccccgagctatagagagtgccccaaaataaatcctaaattacatgctgcttgggggcaaccacagttctccttcctccctctccagcaagcagacccgcccgacaccgtgctgagggggctcccccaaaatgggctatttatacagctcctgctcccctgtttgctctctggccctgttgtccttgagtgaggcccaagcaggctatacagctgtcttgggagggtgaagggagtgggagaggctgcagcctggcccctgctcagtgccctctctggaagcctgctccttggccagcagacctggctcccccaggtccagcctctacctgcccgctcctcccgtccccttgagggggctttgcttcaaaggggtggagctagggctcctcctcccttcagtcacagggaggggagggtggagggggcggcaaggaggtggaccgagaaagagccggccacagagatgtccagggaatggggcagggctgggtggcagcatcacagtgtctggagggccaggctgggcctgcgccccactctagtctaagccccagaccatggaagggctccccttcccatggttgtcctgaatccgcagttcctttggatctgaaaagttcttttaggtctaactacaaccccagtaacatttgggtgacgtgccaaacagaagatgctggccttgtccaggaccctccttcctctagaacagcccttctctgctcagtctaggggggtccatggtgctcccacccccttctgacctcacccaccaaaaatccgagggccctggggccatgatgaatgctaacaggccctggtgttcttggcctggcctgggaccacccacttccaggctcctcatcttgtccccatctgcaggaaggaacgtagggcagtttggtgtcatggaactggggg

SEQ ID NO: 470803 - DNA, 2321 bp, Homo sapiens
ggggagagacacagaggggttaaatataagacagagaacatgactgggagagatgagggagaagggtgagaggcagagagcaaggaaagagaagaaacgcccacgacgtcgggggtgtttttcaggggtcaagacagattggcgacacagcaggaggcgcccaaggacatgacgttgagcctctcagggtcccccttggccgggccagggagcagcgccccacgctccatcaccccctctccccctcccgcggtcctggctgcactgctcctgcctcgccctcgcccagcgcccccagcccacaagccccggccgcgcccctcccggctcccgggggcacccgcgctgggcgacgctgccacctgccggccgctcccggaagctccgcgcctggagtgctggaggcggcggccgcagggggctcagaatcaggcccctccgcactggggcggcctccgcggggtctttccaggaatctggatgggcctgctcgcccgcgccccggcgggcctggcagaggaccagccccagctgcggaccccggggcagtctaaaccctggggccttgagttcccacccagaggtccagataagaaggggcttccacgtccccttcccactcccgccgcccctccctgccccgagtccgcctctcccggtgcagctccgcccccatcccgaggcggggccccataggtggagagaagtgggagaggtcgcagccccgccttctctacacaggaaagctcagtggcccccaagccaggatgtcccaagcttgggtccccggcctcgcgcccaccttgctgttcagcctgctggctggcccccaaaaggtcagccctgggtgttctgaaagcaccgttctctgacccctcatactccatgggcgccagcgagaactggctcttcctggacatgccacgtggcctctttccccgcacctccttagagttggatgaggagtgtcatggccgctgcaatgccccttccccacacctgcctgctgaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgaggccttttaaaagaataaataggatctgtagcaccaaccctgcaaagcatccatcacttattgttacagagaaaaggcaagttgcggaactgcctatgatctcagtttgtaaggatataacccacacatattttattttatatatgtatattttttctttgcaaatatgtagataagatctagaaggattgatggctgccccggaggtctgtcttggggtctccggtcttcatctttgttcattcccatagtggctgtcatcctgatctgcggcttcacagaccatctctggtctgatgaatctcaagacttaatctcccgccgagacttctccctgggactcagattcacatatttaactacctcacgcctcctcttggatgcctaatgagcatctcccagccaaaagcaggctcgaatttccctccaccaccccctcaaatccagtccttcccaaggtctcctatcataaatagatgtcgctccccattcgcccagctgtgtaggctaaaacactaagaaattattgtgatttctttttccctcactccatcatcctgacagcgctgcctgcaaaatagacctaggcccacttattcccatttcacggttacagccctcgaccaagccaccttcatccctagcccagcctatcctaatgaactacctgatttctgcctccaggcttgtctccatctcaccccctgcagtttatcccacacactgcacttagggagatctttctaaagcgcaaacaagacttgttattcccgtgcttaaaatcctcc

SEQ ID NO: 470804 - DNA, 611 bp, Homo sapiens
tgccaggagtagggggaccacagaggcaagtgggcgatgccctcgagtggaaattttaaaataccgttcactggccccaaagggtttctgtggagtgttttcacagaaaacgcatacatcgcaaagtgcggccgtgggcttggcagcaacttcaacgcagccggcgactctgatccagccacttcccacgtgctccctcataaggggcccagcactgccgtggattctggaaccatgcagcactcgaggcctctgctgatgccgaagcccagccttccgcagtactcctgggacccactgggccctactgacctgttcccttgggtcatccttgtgccctgtgcctctgcctctactgcccacttggctctctcctcctactgccccctctgtcgcaacctatcccagcctcctacagccccaccctcttcctccctggcactggctcagacccttccacaataggaggagacaaggttctaactactaaggactgctgtgtaagtcaccatgtcccacccccattctatgttttttaaaatgtagccataatcctttaaattgagtgggttgtgacctgtagtttgaactacactgatctagaaaaacct

SEQ ID NO: 470805 - DNA, 761 bp, Homo sapiens
gctgattaccctttagacttcatttcagttaattctctctggtttgagtgtgattcacacgccctcctctgggcctggtgtccctgagtaggaggctccttttatgaacacaaggacattatatgttagaaaaagagcgtgtgacttacctagatttatccccaaaatgcccctcagaaccaaggtgaccatacaacttctagaacacttcagaaataagctggaagagggaacagggttacctgctgagacaacagaccgtttttcaaggagaacattcaaaggactctttggcttaaactgttcacaagctctggactcccttctttcagacacagtagaggaaataggctggctctccaaagagcttcacaaaggtttcattgaagatttgacaaaggcgaagaagctgcaacacctttcggatctttgggcttacaccattgacacctctgatcctgatgacaaacgccaatttgggttttgcagggtttctggcacagcaggaaccttcttcttcttctcttctacaccctccatggttctagcctgaaaaagagtggtatctttttaatataataatttcttttcctttgggtagatgctcagtattgagattgctgggtcaaatggtaattctatttttagttcttcaagaaatctccatacagtttttcatagaggttgtactaatttactttcccaccaacaatgtataaggcttctggattttaaagctcaaatggatatgggagatgagg

SEQ ID NO: 470806 - DNA, 620 bp, Homo sapiens
ataggaagaaggacaatttttgaattaattataatattataattaggtcgtattagtggaaggagtgggaactaaaatgaaatctggtgaattggggcagctgaagctagagttcagcttagctcctcccccgactctgtcttacttccctaactcctttctttctgagacctctccttcagctttatctaacctactgggagaaaagaaatggttgtcatccgtgcagcaaatgatgaatcgacggaaagccctagcagggccaagactagcgagaggcacccagggcccacaattcaaggagtcagtgcttaggacttgggagagggtgaatgcctctttaagtcagtaccctcagtgcttcacttgttgtgccgtggagtccagcacctgggaaacattccaggaaggcaccaagagaggaggagaaggaggagaaacttgggctatgaacttgaaacaaataagagccttggaagaagaaatgcgatgaactgcacccttcattttgtgtatatgaatcaccaacagtagttcccagctttgtgactaaagacaaacgtcaatgccaaaatcaccctagttcatcctagctgcagcatcaaacagtcatggccacc

SEQ ID NO: 470807 - DNA, 1097 bp, Homo sapiens
agtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggaggagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctagacgtgggaacaacgcaagtcccacttacaacacttaagaacattctcatgatgaccgttgaactggaaaaactgacaattcccccataaaaaatgatgaccagcc

SEQ ID NO: 470808 - DNA, 3285 bp, Homo sapiens
gagtctgtaatcggagcatgacccagaataaggttctgtacctcggcaaggtgaaagcgttggcgcccactgatgaggcctgctctgagattgtgggctccatgctgagcccaatcagggacccgatagaaatccaaacaccatgtcagcgagtccccaagaaatgcattttgtgccaaggctattcaaggaaggtttgggagcagctcaagggcagacactgttaccctcccccaggtccccagtgcagggcagtgttctgcatgtggaggcagtttggcctaatggttaaggagggccaagcacatagtaactgctcagtaaatggcatcatcggcggtgtcctgtggatgagtgcttgtgattggctgaatgaccagaggggtctaaagatcctggtgatggaatcagttgtacagataaattgttacactgatcccgaatgtggcaagccatggagccttaagctcttctccctccacatcctggaacagacccgccagtttcttccaggcattgcctcagtttgcccctctgtttccagtcacactctcaccagcgataaaatgattttagaccttatcatctcaccctcggatccttatggaaacaataatgagttgttccctgtttcaattccaaaattcatatccaatccaggctacgcgtttcctctcacctgtggcagcgccgtgctccccagtgcctcacagtttccttcttgcccccgcttcctgtgtaggactcatctgcccacaggttgcacgtcctgtgagggcaaggactggcagaccgtgggaagctttcatttccggaatggaccatcaacatcccttggagaagaattctcttctccagacccagacctggtgtcctggcacccattgggcaagtgggtcctagaagacaaacctggaattcagaaatatatgtttgtggatttgtttattcacgtagcaaaccatttcttgagtgcctaccatgggccagtctctgaccccacttcaaaggcagcattcactcagggaagctcccatacaatgctagtcagagtaaaagtttggacaaattgccaggaagcagcttgtcagtatgcataaacagcctttaaaatattactactctttgacccagaatttcacttctaggaatctgtcctaaggaagtagtcacatgcaaaagatttatgtaccaagatgttcatcaaagtgttgttttataacaggaagtctcagaagctggataaatatccaacctctggaaatggttagatagaatagtatgtagccattagaaaattatgtctatggggtttaaaatgtcatgggaaaacacttctgacataaaagagcatgagaactgtatatttagcataatcttaactatgttttagaatgcacaggaaaaaaatgtacaaacatattcatagtgatgtctctggtggtaggattatgatcaaaggacctctgatcctactgagtttaatacccacgggttaataattgggaaaagcaaaggaagcgcttctgtttaggtaattatatgcatgtttttgtctttttctggctggaaagatatccaagccactgggaagccccctaatttctctcacaaggctttgttctgcagcaacctttcctaatgcagtcctggcctcttcgcagcttcattacataaccttccgtggactcctggtccaaggatcaccccagaaagccagtcagagctttgtctacagccattccatcctgaacctgcccaatcttgtctgaatcctggtttcaccactgacaagctgtgtgtccttgggcaagttacttcacctgtctgtgcttcagagtcctcatctgtgagttggggaatctggacagaatctaccccatagggcgtagtgaggatgtgttgaattatcccaagtggctacacagagtaagcactcaaatgatgtcatcgttgtcatgattgctgttaccagagcctagagttcattctgatactcgagtctgtggcccatccagcccagaggatgaaaatagaatgagcccccttaagaggtaatgagctccctgtcattggaaggattccagaagagctaggtaaccactttaggtgctatcaaggggcttttttctttaaagtcctttccaaaagcttctgagattgcataaacaataggaagccatcttggtgctttaacacaaactctccccagtgatgagggttgagccaaagccagattggcaagcagagaggagacttgtgtacaaggagttcctcgagtcaattgctttttccttgttctagccagccagagggctcctgttggaaaacaggagaccggagaggctgaggcctgaccaaaccagcttctgcaggccagctgggaggccacaactcctacctacgggaaaactgaagggcatctctatttttagattagcaaaagaaaataaatttaagtttgagtctcctttgcaacttttaaaagacatctttattgagatgatcattcacattctataaaattcccccactttgagttacaattcagtggttttagtcttccttgatgattttgatggtcttttcttaaggctcttggaagacccagaagcctctcagacacaggtgggtgtggagggcatagcacagaggcagacttctcatttcctgggtctcccctttaatgactctcagagacccctccttccccctgcccctggcttctaccccaggggtgtagagttttgccattttccaagcagaacttcatttcctcttctgtgtctacactctttgtgcttctttcttgccagctttttctcctttgcccgcccttccttccttccttccctccctccctccttccctccttccctctttccctccttccccccttccacccttccccccttccccccttccctccttccttccttccctccttccttccttccttcctgccttccttccttcctgccttccttccttcctgccttccttccttccttccttccttccttccttccttcctggtatgtgactaatttctgtttcaggacataaatgttgtccaggctgttctttggtctttctgttggataatggacatttggcattgagagaggctgctttttctgaaatcatgttcttggggcccagaacctaggtgtgtgcttctgactttgttttcttcctgatccaaattctgatatgtccatttaaattgatctagacccacagggcactgtgggacagatcctcagtggaacatgactctgtaac

SEQ ID NO: 470809 - DNA, 1334 bp, Homo sapiens
cccattggagaccagaaccgcgggccagggggcgattccgctgagtcaccgcgggcgcctggtgcgcggcggcggagcccgggaccttccttggctgccccctagcgagggccgcagcgcagcctgagacacccgccggggccgctccacggccgtcggatttagactggaagctcggtccaggtccccagcttgatgcgcccgcggtgtaggagaccagcccgactcgagcttcccctgagcccctggactcttgactccagcagggcctggggtcgccatcctgcccacctcacaggttacagtgagcctggatgcactgtcatgggcaggtgcccaggaaaatggcagacatgttccaaacagcacgcagcattccccagtgatgcccagggtcaccttggaggtgggcgagatgcctggggtttctcgtccaccccacaacacctcaggggacagccaaagctgtcccttcaggtaacttcccagactcctgggaatcataacacctatgatgatgatgatgatgatgatgatgatgatgatgacacctacctcaaggattgccctgaagggtcacagagatgcctgcaaggcacctgcatggagcaagcgccccttctctggcaggtgctgggtgagcactacctgctgccaggccctggggctatggcactgcgtgaccctgcaagtcctacctggcgaagctgtcgttcttgtgctcagtcagtgttggttgtaagactgagaagagtcacttcattttgctctccagggacatctttctgggtcctattttctgcctatgtcaagtagcacctcaaggatgctcctgaaaatgggcttgtctttcttaacatggcagaaatactggagaagcctaaagaaggagtctaaaaactctggcacgtgggccaaaactgtccttgagctaagaatgattttcacatttttaagtggttgaaaaatgaaataaaataagatgatgttttgtgacacatgaaagctatgggaaattcaaattctaatatctataaatagtgttttatcagaacacagtcatgctcatttatttatgctcgatggctgctttcccgctacaattacgttgagcagttacaacagagaccacgtggcccacaaagccttacaatatttactatctggccctttccagaaaaaaatgtatatctcctaatgctatccctccccactccccccaccccacaacaggccccagtgtgtgatgttccccttcctgtgtccaagtgttctcattgttcaattcccacctacgagtgagaacatgctgtgtttggtttttttgtccttgc

SEQ ID NO: 470810 - DNA, 604 bp, Homo sapiens
aaaggtctcatggctgctgttgcaaaaccaaggtttgtggtgaggagatctgtgtcggatggaatggagtcctccagggcacacggtgactctgatgaagaggcaaaaatgccactgcttcgtgaaaaatggccttgaagcaaaagagaacattctgatcacatttgaaaaggcagatactttgtggcaccagggcttgacttctaatgaatgtataacagaaaagatcaggcacttgtgcaaatgtgtctgttttcatgaatccgcggatttacaaagaattttgagaagcatcaccaattgcttttcaaacaagatcgggcttgttgagggtgtagcggctgtagacaccaattgcttctcagatgcagtgcaagtgggtatgaagtgtgagtcttgtcaacactgagttaatcatacacctaaataaatgccaaaaaatttttgtgcttatagatgaaagatgatgttttactaatgtaaactatgaacttgggtgataatgatatgttaatgaggattcattggttgtaacaagtgtaccactctggtctcagtgcttattctaatgacttgtgtgggctcttaatttatgaataacatt

SEQ ID NO: 470811 - DNA, 761 bp, Homo sapiens
agcctccagaggacaccttgggtcatcagggatgaccctgagcagaagggtgacccagaaagtcctgaggaatgtttttgccttgactgggcgccaagctgtggacttcctgggctttggggtgggacttggccaaggggaagccctttggacccaagagccactcagttctgcacagcctgccggctttctctctctctctgctaagcaaaaggctcatccatcactttgtgtcacgactgcctcatttcctccccccacaataggatttccttgccagggcaaatcacacaatctggaagcagtggtcatcctaaacactgtggcttatagtgggagagagggaaagcacctatttcagaagctgccttctctgttccagaaggctggtagctggaaggagggattcagttgccagggtcctgagcagctgctgacagagaaaggagcagggtacacagactgactagaagcttctggggccaagagagaaccctgccttttcattctgtactcctctcaccagctgtagaagaaagacacccgaattacttgtgagggagaaaaggaagggccctataagaaatggaaaggaaggaaggaaggagcaagggggtaacccctctcctttgccccctccctcccagcctctgccttcacaccacacacagactgcagaaccacccaggttttgccaagaggagagtcaggctgactgaatttcagctctctctacctctgctccctcctccttctcactg

SEQ ID NO: 470812 - DNA, 641 bp, Homo sapiens
ccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaagaagacatttttggtcggagtataagatatagtcatttagagtggacaatttggcaatatctatcaaaatttaaaattctcataccacttaatctaagaattccacagcccatatttaccctacaaatatatctgtacaaatacccagagagagagagatgtacaggtttgtacattgtaa

SEQ ID NO: 470813 - DNA, 620 bp, Homo sapiens
tcatctcatgtggcgtcagtacagcagccctttttagtcaaaatggctcccttccttgtagccaaatccactgtacagatggctttaaaagaggacagcggcaaacagagaggcctgctgacagggaacgactcaggtataaacagagaatgctggcatggcgttgcacacatccttgcaactgaggtgccaattctcaacacagcagccagagtgatccttttaagaccaaagccagatcatgtcacttctctgctcaaactctgcagtggctatttccctgagcagaaaagccaaagtccttcctatagcgttcatggccctatgtggtctgacactgtctcctccccacctcatctcccgctgtcctctcccctgctcgctcccgccatactggcctccctgctggaccctacacaggccaggcatcctcttgtctcagggcttttgtgctagaatatctagcaaactttgcctttgtgaattcttttactgctgctatagttagaaaggccttccctactttaaaatcaattacatgcccatacaattaatttatgtttttgttaaaacattaggggaattgaatcataatgagcagagagcctttattttataat

SEQ ID NO: 470814 - DNA, 536 bp, Homo sapiens
gcatgcacgcacgcacgcacgcaccacatgccctgccctacctgcttaagagattggatgaacatgactgttccacccagctggcaggagcttagccaaccagatgactgccttgggaagttgaggttcaatgaggttaagtatcttgtccaaggtaaaaacaaaaacctaggaggaggaggggctggcctggttgtctcctggacactagaggaacttgtactcaccaggcagagaggtcccttccagggcccttcctcaacaagtgagcatcaggccaggtctctgtatccaaacaagaggagaaacttactgaggaaagaattggtcaagcctctgcggctgctgctgtgctcaggacttgctccctcactgaaggttccagaaaacggcacagtgcttattttaggtgatggctttcacgcacaagtgggcttttcttctatcaatgatgctgccgaattcagagttgttgctgatgccatgaaagtcattggcttcaacctgaggagatccaacagtggataggattttgg

SEQ ID NO: 470815 - DNA, 1616 bp, Homo sapiens
ccagctccgtttcttctaatttgggctctccaagcaccctccagagctggctttgtgctcctgggggtcctgccccctcacagagggccttggagataagtggccccagggtgcctgcttggttctgactccatttccactgtgtgggagcacactggcactccagtgaggcagatggagcagcatgcaaatcacagagggaaaaaggaacaagatgtgtgcgtgcacgaatgatcagaggtggaatggctacagcgtgcattctcagcaggagggagagctgatagcaggacaaaaaaattgtcttttgggttttgctgtgaagagaaatagacacggagcagctgctgaagagtttgatggagtgtgtgtgcttcatacagatgatttggaaagacctttgcacaccaaaggaaatgatgctagaggaaaggaggaatggacgaccaccgaggtcaataagcaaagcaggctgggccacgactgtgggaaacctgatcggtgcttcccagtctccaacaggcaaacaaatccactagggatcctgtttgaatgcagactcttattcagtagctctgggattgatcccgagattctgtgtttctgaaagtgctgggtgacactcttattactgatctatggaccacactttgagtagtgaagactggagagtctgtggtctgctgaaaggagcggctgcttctcacctgtacctattgttgtcatatgagagagaaggctcactatggtcttctgatttctgaagagaagccagaaatctggatttttatgtaaaatcatcccatttaagaatattggcaaataattaaaaatgtaaaatgctctgtggaccaaataaaacatgtgtgagggttgaattctgcttataacaccactgcttgtgatttctgatggagaggaatccaggcagaggagaatcagctaattctttttctccttgatgttcttagtataaggactatctagcctttggtgtcagaaagcccttgagttgcttatcaaatatgtgacttgacaaggtacttgaattcgacaaggtacttgaattctttaagcctcagtatctatgtcaggaaaatgaggataatactaagatctacatcatagaatgaatctgaaggattcaatggtatttggcccccctcctcccctcctcctctctgactgcccctccctacttccaaaggccccctttctgtttggaggctgacttggtgttggcacagttccaggtctaagcaccatgagcagccccactgtgaatggatggacaagaggtccaagctggccttaggccagacgttcatctcttctcatgctgccacattaagccattcaggaaacattagctcccaggttgagatgtttccccacaggtctaatgatttcccatcttctctcatcagatgtgtccctatttacacagcccccaggtacagagcccactgggcacttttctccatgggatactccctcaaagtgaatccctacctctcagcagcatgctcctctcacacatactgtatttaggtctcatgttttcctacctccaagctgtactcgtgattatgaaatgcttgattgtggtgcctgtc

SEQ ID NO: 470816 - DNA, 1036 bp, Homo sapiens
cccctccaactctcccctccccagcccctagaggccatgggggaagccctgtgaagagatgccttccatcatgatcctgatcaggcagctcccagagccgctccgatcagacctcagtgctgtgctggagctgagcacggggcctgctgggggccttggcagcagttgtaagggagcccggggattcgagtgggacttgaacccggcacatgtcggggaatctaagaaacttttctctcctgaagatgctggccccaggagcattttggagagtgatgcccacgtccttagctctgtgcctctgctcgcagctgggtgcgtggcatccctggaggtcctgacctgccttcgtggtctgcacattgccagtctcttctttcctgcttcttgtctgtctcctttcttcgctggcccgatccatccccccacacccatcctccctcactcacccccctgcctcctcccactctttcctgtgctcatctagagaggcctccgccagctgaggcagggcttgggagcagcccccactcgtcctttctcagcccctgggagacactggtccatcctttagctgtcaccaacaagctgaataaggctggatattttggaaggggagctgcagctggctgggggaaggggtggcactgagagaagccagagggaactgcaggcagctgtggggtgggtttcatctgagtgcatccagacttgctcgagtccctgttaccacccctcacccctccacccaccctggggtggttataagcctgttcccttccaaagcaattagtgcaaggaggccagccaactcggtgctaatgctgtttcattaagtgggagcaatcctaatgataataaaatggcacatttaacattcaaacattgaacagggtttctaagcgagtgtgtctctctctttctttctggtataacagctccatcttcataaggacctgacaatacaccttaatgagagactggggagctgagcatcttcacacaaccagagagggggtgaggaggagacaaagaa

SEQ ID NO: 470817 - DNA, 3903 bp, Homo sapiens
gagttctctgagcaggtgggaccccaacccttactgaccatccccaatgacaccaaagtttttggcacttttgatctcaattacttctccctgcgtatcatgtctgtggattaccaggcttccttcgtgggccatcctcctggatctgcctaccccaagctgaacttcgtggaggactccaaggtggtgctgggagattctaaggagggcgcctttgcatacgtgcaccaccttaccctatacgacctggaggcccgtggcttcgtgaggccgttttgcatggcttatatctctgcagaccagcataaaatcatgcagcagttccaggagctttcagccgaattttccagagcttctgagtgcttgaagactggcaacaggaaggcatttgctggggaacttgaaaaaaagctgaaagacttggattacaccaggacagtgctacacacagaaacggagatccagaagaaagccaacgacaaaggcttttactcatctcaggcaattgagaaagccaatgaactggccagtgtggagaagtccatcattgaacatcaagacctgctgaagcagatccgctcataccctcatcggaagttgaaggggcatgatttgtgtcctggtgagatggagcacatccaggatcaggccagccaggcatccactacctctaaccctgatgagtctgccgacacagacctttacacctgcagaccagcctacaccccaaaacttatcaaagcaaagtccaccaagtgttttgacaagaagttgaagaccttggaggagctctgtgacactgaatatttcacccagaccctggctcagctcagccacattgaacacatgttcagaggagacctgtgttacctcctgaccagtcagattgatagagcacttctaaaacaacagcatataacaaactttctctttgaagactttgtggaggtcgatgacaggatggtggagaaacaagaaagcataccctctaagcccagtcaagacaggccgccttccagttctctagaagaatgcccaattcctaaagtgttaattagtgttggttcttacaagtccagtgtggagtctgtgttgatcaagatggagcaggaactgggagatgaggagtacaaggaagtggaagtgactgagttgagcagtttcgacccccaggaaaacttggactacctggatatggatatgaaagggagtatcagcagtggtgaaagtattgaagttttgggcacggagaaatccacctccgtgctttctaaatctgacagccaggcaagcctcacagtaccattgagcccccaggtggtccggagcaaagcagtcagccacaggaccatcagcgaggacagtattgaagtcctcagtacctgcccctctgaggccctcatccctgatgactttaaggccagctacccaagtgccattaatgaagaagaatcatatccagatggcaatgaaggagccatccgcttccaggcaagcatcagtcctccagaactgggtgagacagaggaaggcagcatagaaaacaccccatcacaaatagactcctcctgctgtattgggaaggagagcgatggtcagttggtgctgccctccactccagcccacacacactctgacgaggatggggtggtgagcagccccccacagcgccacaggcagaaggaccaggggttccgtgtagacttttcagtggaaaatgccaacccttcttcccgagacaacagttgtgaagggtttcccgcttatgagctggacccgagccacctgctggctagccgggacatcagtaagaccagcctggacaactactcagacaccaccagctacgtgagcagtgtagcgtccaccagctcagacaggatcccctctgcttatcctgctggcctgtcttccgataggcataaaaagagggctggccagaacgccttaaaattcatccgccagtacccctttgcccacccagccatctactccctgctcagtgggaggacacttgtggtcctgggggaagatgaggccatagtcaggaaactcgtgactgcactggctatctttgtccccagctatggctgctacgctaagcccgtgaaacattgggcctcctcccctttgcacattatggattttcagaagtggaagcttattggcttgcagagagtggcctcccctgccggtgccggtaccctccatgccctgagccgctacagccgctacacgagcatcctggaccttgacaacaaaaccctgcgctgccccctttacagaggcaccctggtgccccgcctggcagaccaccgcacacagatcaagcggggcagcacctactacctgcatgtccagagcatgctcacccagctctgctccaaggccttcctctacaccttctgccaccacctgcacctgcctacccacgacaaggagacagaggagctggtagccagccgccagatgagcttcctaaagctgaccctgggtctggtgaatgaggatgttagggtggtccagtacctggctgagctgctgaagctgcactacatgcaggaatctccagggaccagccaccccatgctcagcattgccggacacttgagtggcaaaatgaacgagggtgacagccaggtaactgttgtggtttggtggaaaacaggagggcagaacacccatcgcctccttcagacccagatgcagccctttatttgcttcctggagcccactgtcctaggggaggccctggaccagccagtggggagcgtgagcagcaccctgtccgctgtcctcgccacctttacctgggagagaagtgcctgtgagcgggccttgggactcactccccatactctttcaccaggaacgagcagagtgttcactagtcctagtgtgaagcgggcacaagtgaccaaagccaatgagcgcatgagcactgaccttcctcgtggggaaggtctgcagacccgtgtgaacatggcagaggccacactccagctcccacccacataaacctttgcaaccacttcactacctctcactgggtctcgtgggcttgggacagcaacggttctgtttagtcagctggtgcaggtggttggcccagccgatgagaactcaaatagcacggatttcctggatgagctaccacgtggcgctcttcaggttctgcctctgggaggctgtgtgcacctcagtcaccacagctcacggccgtccccagttgagtcccccttctgaggacaagtttgaaactgggaaggagacaccccctggttccgccagcacctatcccactgatagtgatcccctggcctccccgagcctccttaggcaatggccactggtttgtagacagagagtttcttgcagccttgaaaattttattccctaagtggggacagctctggtattactgcttctttaatttgttccacaaaaattatgctgaaatggacctgaatcagccctgggtgtgcttctgttggcgcctgctgctgaggcccggcctgcccatcggcctgtagtacgccatcgaggtcatcatggagccagccagcttctcttctcatcaaggaggcagagacccctggtggaagccaagagtgaccgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgc

SEQ ID NO: 470818 - DNA, 1836 bp, Homo sapiens
acagggtctcactctcccagaaataaacccacacaattatggccaactgatttctgacaaaggggacaaggacagtctcttcaggctggagtgctgtgggaaaatctgggctcactgcagcctcaacctccgggactcaagtgatcatcctgcctcagccacccagagtagctgagaatacaggcgtgcgccaccaggctcgggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagagctgaccctgcagatccagagcgacactggtgtcagagccaccctgaaagagttcaaggagagactggcaggggataagtaccaggcggccgtgcaggctctccgggaggagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatactatgtgtttggcattgactctggttaactcttgtgcagcaacacctacgagatgct

SEQ ID NO: 470819 - DNA, 896 bp, Homo sapiens
gttggcattctggtattctgcggggtgctgaggcccctataagatttgaaaatggttcagcgacggacagattttgtatttttggaactaggtagagagatcattgagaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctgaatcctgggattctagtatgcaataagagatgccctgtactgatgcaaaatttaataaagtttgtcacagagaatctttgtactttggggttcttttttttttgacttcaaggcattcttatcatcctggaatgttccctcacgtgtccctttacaggcaatcttttccct

SEQ ID NO: 470820 - DNA, 2539 bp, Homo sapiens
gtgtgtgtgtggggtggcgcctgtcgtcatcacacaaaacgccctacgtcgacgctgccaaatattgcttttttattcctcacagctcctcccgtctttccgagactgcggacagagggagctcaacgccattccctgccgggggcggccctcgccgcggcgacgtcacggaagaggcgggatacggaggcggccgcggcgcgggctgcaggactgaccccgggctgcgcggccccaccccgggcggtccgctccgttcccgccggtccccgcagccgccgtcttaggccagctggagcaggccgcgctcggccagcaggctctgggtgcggttgtagacatcctccaaggtgccggcggcccggaccagcgcggcccgcgcctccgcctcggtggctccgggacacgccagctccagcaggcggcggcgacccgggaaggcgaggaaggcgaggcgggcggtctgtcggaccagccaggggtgatgcggacccagggccgcacggtaggcgtcgctgcactgcacgcccgcgtccgggcctcccagcgcgccggtcgccacccggtggaggcagagctgggaccagcgcagcgcgcggtgcagcaggagcagcgtgcgagagcccgagctccgggtcgggtcccggggggccgcccccggctgctccagcagtcccgccctccgctcccacgccgccatggccaccagcgaccagtagtgctccgcgtccgggccgtgcacccgagcctccaggtctgtcaccttggtgaaggcctccctagtggcgaaggcgaagacggagccgaggggagtcaggaacctgcgggcgagacgatttgagagaatggagatggagccgccaaggaggcggggaccggctggggggcgggaggccactcactcgacgagtgccctccatcccgccaggtacggcgacagccccacatccccttcgggtttcagactggcgtggaaccgcctcatcatgcggcccagcatcccccgagggcccagacacggaggctgtttcctctccggggcctccagggttcccgactcctgccggacctggtggggagacacgatgggaagaggtgggagcagattctgccctgaagaaattgttccgaaggtttagctggcggctcttctgctgtgcgctcagcttccgacgggagagggtagaccgggggaggacccgccctttgccggaccctcagcctggctccacgtccccctgttctggtccctcctggagcgcccgcgcccaatcctgcgcctagcgtacctggaagggcgccgtttcccctggaacgcagggctgcgccctgggtccgcagcccgagcgggcgcctgggtagaggagaagcggagcggtgagggctcgagaaagaggcttgagtcgtgagggcctggattccgggcttcctcccggagcaagtgagggaaggggcagctcacctaggctccgaacactgagataaagcagcagcagcgcgaagatagcgagaggaattgagtggctgaaccagtgccgcagggctgggggccgcgccgccactcccatgcctgctgctgggaccgccgccccctcaccagcgcctagccagtccgtgtccctccgcctccaggaggggacagaagcccctctgggagcctctgcctccgggagcaggaaatagggttccgggagtggattagttttgggtttcacttaatctgggaggcccttccgcaatcggagccctcacagaggccaaactgatataaatctgcttaggaggcctgattcacagacgctacaggatggagcggggcgcaggagccaagctgctgccgctgctgctgcttctgcgggcgactggtttcacatgtgcacagacagatggccggaacggctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgggatcaggctgcactgcgcgcgcgggaacgtcctaggcaatacgcacgtggtagagtcccagtctggaagctggggcgaatggagtgagccgctgtggtgtcgcggcggcgcctacctagtggctttctcgcttcgcgtggaggcacccacgaccctcggtgacaacacagcagcgaacaacgtgcgcttccgctgttcagacggcgaggaactgcaggggcctgggctgagctggggagactttggagactggagtgaccattgccccaagggcgcgtgcggcctgcagaccaagatccagggacctagaggcctcggcgatgacactgcgctgaacgacgcgcgcttattctgctgccgcagttgaacggcgccgccgccgccgctctctcccgggccaggaggctagtcccacctcttgctattaaagcttctctgagttgactttggtgcctaggttgtctcctttctgaaccagtgacctaagatt

SEQ ID NO: 470821 - DNA, 2527 bp, Homo sapiens
tctgaaactttttgagtgccagacacaatgctgaaaggaaatgctcattggcgcattttggattcgatttttcaatgctttatcatcgacaaagcacctttgcacgcctgctcgcatcagagggccagcttccctgacatcgagccctgccctggcctgtcccagggagaaagggtgcccgctcattgggccaaacccactcatcaccccacaaagcctgaggcctggcgtccagccagcacagcagagcagggcctgcgggtaatgttacagtcttgtctctggagcacacagccgcggttatctgaattccccgctggtgggtccttgggaacctctggctgccggctgagctctgttcccgggaccgagacaccggccctgtcgcggctgtggggctggctgatggctgggaccaccgttctgacggggcttgtgtgtttcaggaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactcccctttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttgcttggggtttgtcatttctgtttaggagatgggagttctgtgaataagagactttgcacaccttccaagtgaatatccactacattccacccctgttcctgcacttaaatcactggcctggaaagctgaagatggcatttgctgtcatctctgatcatctctgagtgtgcctgtctcccatctccatgttgtggaaggagcgtcaacagaaagttccccttgagatccgtcctctggatgtagaccgcagtgtttgtgataaacagtggcccaagacagcagggtttggggtggtcccgcacttggaggaagcccatcaaggaacgttggtttattttcacagctgtttggtggtaggactttcatagaaaaatcttgagattctatagagctccagccattagcttattctcagccaagaatcattgtataattgggttggattttagccatgcacttctaaaccttccctttaaggagcggatctgtgtcttcacctcatgcagccggctctcaacaccagtgcctgtgtgcctttgtggggtcccacgtgtcccttgggtggtatattggggggtgggcaggagatccctgggggtgtcaggaggaacatggcagagcctgcaggtgggtgagcagtattctccatggattggttggtccaggctgcagtcttgccctctctctcggattctcccactctggaaaccattcccttgctagctctctcgtctcttgtacgcttggggaggtgagacctattattaacaggacacataactgaaggttagggtttcaaacctgaagccaatctgggaacacaagggctctgtaaaaagcatggctatatgttactgagtcctcgcacacgttaaatggagctctcccgagttgcagacatggccgtacgctctgcgcatgaaacagagcagatcctgccagaatgcagaacaatttcttttaaactttaggaatggtgtccctcatgtctcacattcagaatgagacagactcgagtttttaaagttggttccatgatgttcttgtctgtggtctttgttgggggtggggggtgagagatcataagacagtttgtgagtttcaaacatgattttacctct

SEQ ID NO: 470822 - DNA, 1507 bp, Homo sapiens
ccgtgttagaggacagttctgttcattttcacagcagaggggacagccgagcgaaggcccccaggcggcgtgttggaggaggtggaaaaaggccgttgtagcaggagggaaagcggaagatggggagagggctagggaacctgaggtgcccatcctgctgagataggatatgggccccagtcctggggcttgggggacgctgcttccggcccatgagagaaccaagcttcagtgcgctcatcccccaggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaagggagaagagaacctggggctggagcagaaacagaaggcttcctggaggaggcaggatccagtgttgagccttggagcatcaggaggatttggctgggggaagggagagtggcccaagtgaagagacagttagggtggggggtgggagagggtgggaagcaggaagatcagggtgccgtgaatatgtgcttgcaccttacacttgaattatgtttatttccttataggtcattttgcatgatgttctgaagttcttgtttgtatatatcgtgtttttgcttggatttggagtaggtaattg

SEQ ID NO: 470823 - DNA, 3140 bp, Homo sapiens
cagcagcggctgcgttagaggcgggtggcggcgcgggtgtttacgtcaggtcgcagggtgtcgctggcagcatggcggactacctcatcagcggcggcacccgctaccagcccgaggatgggctcaccgcacagcagctctttgccagcgctgacgacctcacctacaacgatttcctgattctcccaggattcatagacttcctagctggtgaggtggacctgacctcagccctgacccggaagatcacgctgaagacgccactgatctcctttcccacggacactgtgatagaggccgacatggccatcgcgatggctctgatgggaggtattggtttcattcaccacaactgcaccccagagttccaggccaacaaggtgcagaaggtcaagaagtttgaacagggcttcatcacagaccctgtggtactgagccccttgcacactgtgggtgatgtgctggaggccaagatgcggcatggcttctctggcatccccattactgagaccggcaccatcggcagcaagctggtgggcatcctcacctcccgagacatcgacttccttgctgagaaggaccacacaccctcctcagtgagcaagaaagggaagctgcctgttgtcaatgatcatgatgagctggtggccatcatcgcccgcacggacctgaagaagaaccgagactaccctctggcctccaaggattcccacaagcagctgctgtgcggggcagttgtgggcacctgtgaagatgacaaattccgcctgggcctgctcacccaggcgggcgtcgatgtcatagtcttggactcgtcccaagggaactcggtgtatcagattgccatggtgcgttacatcaaacagaagtacccccacctccaggtgattgggaggaatgtggtgacagcagcccaggccaagaacctgattgacgctggtgtggatgggctgcacgtgggcatgggctgcggctccatctgcatcaccctggaaatgatggcctgtggtcggacccacggcactgctgtgtacaaggtggccgagtatgcctggcgttttggtgtgcccatcatagctgatggtggcatccagaccgtggggcacgtggtcaaggccctggcccttggagcctccacagtgatgatgggctccctgctggccaccaccacggaggcctccggtgaatacttcttctcagacggggtgccgctcaagaagtatcagggcatgggctctgtggatgccatggagaagagcagtagcagccagaaacgatacttcagcgaggcggataaggtgaagttctcgcagggtatcttgggctccatccaggacaaagggtccattcagaagttcgtgccctacctcatagcgggcatccagcacagttgccaggatatcggggcccgaagcctggctgtccttcggtccatgatgtactcaggagagctcaagtttgagaaggggaccgtgtcggcccagatcgagggtggcgttcatggcctgcactcttacgagaggtggctgtactgaggagagtggtggaggccgaggtggttgaaggggcgtgccccgctttccccctttgggcacagcctccctccttaactgagtgatccacagatttacactatgggttccccagctcctttccagggagagaggacgggaggccctgagggtactgttgcccctcgctgggcatctcccacaaagtcaggaccgctccctgggccaggctgccctgggaagcccagcccagccagccaggctctcaggccctgcgcctgcctcaggtctttcttgctgcagcctgctccagcccggcccccaccccaggggcaggccgcccctcctggcttctcctgtaggacacctccctgccccccagctccccaagaaatggcactctcctggccctgcctctggcccttcccaggctgctgccccctcagccatgtggcacttctgagctcctgacctaggccagcgggaggtctctgcccgcttctccggcactgggctccaattgagtcctgctcctcaggccactcccctgtccctggccctggggaggacactgccctggtcatggccacctgcccatcgttcctgactcaccaccgtccccaggtgtgccattcctgccctctcctcagctgcagtttaaggctttaactttgcacactttgggatcacagttgcgacattgtgggtattaaataattggaataaatcaagcagatctcaacgcctccaaaaaaaaaaaatctagaataggcaaattcatagagacaaagccaaatagaagttactaaagagacaaagccgaataaaacttaccaaaggctagggagaggggagaatggggagttaatgcttaatgggtaccgagtttctgtttgggtttatgaagttttggaagcaggtagtgtgaaggttgcacaacattgtgaatgtacttaatgcaattgaattgtatgctgaaaatggttaaaatggcaaattttctgtggtatatatgttttactacaatttcaaaaaattaataatttaatataccaaatgccagagacttgtaccgtttaaatgggtgaattataccttaataaagctgttaaaaataaaattgtaaaacataattgtacagtttagttacctttgttgtaaatcaaatttccatatacgcaaagatttgtttctggaccctctattatgccatgctggtttatttttatttcaattattttcagttgtatatactgtcagtttataagtcttaatacagagtagagcaagtctcaatcttcaagcatgtcacagttcttgggactttgaattccacaaactttcagtatggaatttccataaacttttaatttgtcaagttccacaaacagacaaataaaaacaccttttcagattttgattatgattgcattgaatctgaagatcaatttgggaagtatttatatctctatagtattgaaccttccaattctggaacatggtatatttctctctctctcttttttttttttttttgtttatttttgaatatttctctcagtaatgtttaatagttttctgcaggacagcttgtgctttttttaaaaaaagtcattcctgagtagttga

SEQ ID NO: 470824 - DNA, 635 bp, Homo sapiens
aagggctcagtgttcagggagccccgctgggccctcccccagcccctggtggactcagagccctctgcgacacgggctccaaactctctcctgcaccctggcctttaggcttctgagagagggactgtgaatgtcggtgggacctggagctgaggcgtggggtcgctggacttttgactgcaccgatgaaaccaggatccagaaaggactctctaatgatgtaggaaacgtcgagctctgtctcccctgcagctctcacaacacagaacagtccagtgaccccaggtgggtggggttttccctccacacggggcaagcagtccttcggcaaccagctccagctgaaggtcctcacgttcaactcaattccgacatgctccacctggaggtagcatcagccctcacaggtcgaggtctcagtcccacaagactgctcctaacttccgaggcccatcaccagccgccgtgggagagtatgcacaagaaaagccctatgaccacccagaaaaaaatgggggagaaatcactgctttggattgaaatcaatgacagagacataacagcatatacgtaatacattataaccttgaccagatctggtcttttaaaacatacacagcactagaagttcattt

SEQ ID NO: 470825 - DNA, 2059 bp, Homo sapiens
aggagttgaggaagtggagacgactccagcataacccacagcaagattccatcccaatgcccagtcccaccccaacccaatcctaatccccagccacctttcctgacacagtcctagcaacagaaatgatacctacagcgtattgcatatgcattcaagtgctggtccggcggcctcacagcctcagctcagaactcacaggcacctgtagcctcctgggccctgacctccgtccccaggctcaggccaacttcttcgaccttgatgcacgtgtggacactggagactgctacagcaacaaagaaggcggtggagaagacgatgtgaacacagccaggcagcgccgggctactggaagaaggaggaggaggaagacaaggaggaggaggaaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagaactgcctcagccatgcaacacgtcttgtgagtgtgggggctgcaggaattattctggccatgcccagagtctctgtggcatcactcatggaggaagtggctggccagaaccgcaggagaagagaattagggctccagcctttccctggccgagagagaacagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggccactttgaaggcctgactgggaaggtgccggggccaagagagaggccaggtgggagcacacggtgtgttcacagccacaccacccttgccccaggttacgctgtggccgtgctgcacaagacctgcagcctctcctacgtcgcgggggctccacagtacaaacatcatggggccgtgtttgagctccagaaggagggcaagagaggccagcttcctgccagtgctggagggagagcagtgagcaaattgatatgtaacgacccaaattggatggggtcctattttggctctgagctgtgccctgtggacattgacatggatggaagcacggacttcttgctggtggctgctccattttaccacgttcatggagaagaaggcagagtctacgtgtaccgtctcagcgagcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgaacggccttgccgacatcaccgtgggcactctgggccaggcggttgtgttccgcacctccctgagctgctgctcacagtcatcccgaagtgaacacgtctaaaaacagagct

SEQ ID NO: 470826 - DNA, 1165 bp, Homo sapiens
cactccatctgcagattgcctgtagagaactaaaccccagaccctgttttccatgaacaggatagcaggagccgggctgagcagtgaggctggctggacttatccctgctggccacaccatggctaatggtatcagggcctctggaagcactggggatgacgatgcaggcttgggagaggcagatctctctttctccagaagaagccgtgaagcccactttgtgggctgtaagaagtttgagtacctgagactgccatgctggggaggtcacatgtacgtgctctggtcacatgggctcctggctgacagcaatgacttccaggccagaggtgagaggaagagtattctggcacgagcaaaggtcctggggcaggaaggagatgctgaaagaaggccagagaagttgcagagtggggaacaaggagaggccagagagagacatggggcccagaccctgcagggggctctggttaatgagcctgggagcactcgcctggaaatggcactcgaaggggaaacagtgtaggtgaacaccaatacccaataggaccaaggttctggcgggggcagctttcctgctgagggtcccagcgccttgctttcctaggaaaggctacaacttcaaattgaattgcacgaccttgggtgggtcatttcacctctccgggaactggacttgtatggatgatttataggtcctttcaaatcccatgaatcaaagaatcaatcctcaatgactttcccatcacgaacaaagcactcgctaaaacttacataaatagattaaatgggccaatgacatgagattagatttaatatgaatcgttatcataatgtgctgtctacagagctgtgtcttttccccctaacgccagccttattttaatggcaacactgggttaggaaaggcagccactgagcaaatgtcccctggctccctggggaaagtctgcctgtgtcaaactgtagcggagaaataaatgttacacacgtgaccatggcctggacatggagctaagtccctgcctggcacgcactcatccccagatgcagacagtgccttgtcagcaaagctgactcaccaggaaagggatgcactccagacaccagtctccagcattcccttaagacatgaactccacacgattgaaaatgcagaaacca

SEQ ID NO: 470827 - DNA, 1433 bp, Homo sapiens
aatcagaagctctggaaggggcccagcaggctgtgctccagcaagccctccaggtgacgctgttgcatgcttaagtttgagaaccaagggtgtggacgctaaatgttacaggcagaaggaacagccagtgcaaaggtcccgaggcaggggactgcctgggttatttgatcatagggcaaggcagccagtggggctgctgtggggtgggtagggcgggcagctggggaaggggtggtcagagcggtcactcaggccacattgcaaggggccctgaggccatggcgaagacccaattctcgttctgggaaaaggaggagcaagtcaagaaaaacatgaaagaatccaaagggctccaggccaagacccaagttgacatcctaaagccgcctgggaagttgagaggaaatcgtctccctgcccctcctgggagttggggcaaatggcaccatgaggaccctagcctccaccggggcgtcttgggccacatctcgctccagcagtcaagcctccgagctgccgatgtacggatgtgtgtgggcccccagcactggcaacattcctgcgggctgactcccccagccctcctccagccctccttcatcctcacccgcctgcctggcctcagcagccccagtgggccagctggaggctttatcccagccacatctgaaacagctcaggagctgtgcctggccgccagccgtttccataaataacttgctgggcctggctccttgccctcctggtgatgtcattggccttggcccagatgatgaggtcacaggcttcccttccctcgccactcccttggggtgggatgggggaagcatgagaccttcttcacagagcctgtctgccgagaacctgcctgtctgcgccccatcctgttccagcccggccaggcagtggatgtgggttctccaccatctgggactgcctgcatggtggtgccagatggcagccttccccctccttgtcaccagttcctgaacagcctcccaacttttccatctccccactgccttctccccttgtcatgatgtgatttccaggggacagtggacttggtgcccggatggagctccccctaggtccaaatcctggctaccccacccactagctgtgtgactccggacaagatgcttcacctctctgtgcctctgttttctcatctttaaaatggaggcactgataggacctatctcaagggttgtcgtgaggctgacatgggctcatacctataaaacagtgcctggcgcattagtagacaaataaattgattccatgatcacacttccctgtgcctgcgtgtgctggggagaggggaggctctcgctttgtgcattttcaaatatgtggcaggcagaggcacccgtgatctcctgtctgtggctctcacatcccccacagtcaccaaagattccattttccca

SEQ ID NO: 470828 - DNA, 843 bp, Homo sapiens
gagggcttgcagatccagtccttgagggcatgaggataggaagctggcagttccctgcccaactccaagattttggagctaacttgggggaaattgcttctgttggactttaaagatgaacaaatttagtgcctttgtggagagattctgggccaaggaataccacaagatttagtattttaaagctgcacccgccaccgcgagttttacatgaggaaggagggaaggtcacagctcgatgtgatggctgtgcatgacgtgatcgggtctccagaggcaaagggattcagccgagggcctgtctgtgtgtgcatgtggtatgtgcagttagagtgtgatctatgggttgccgagccatttctgttaattaaacacttcaatataattttgagaagccaccaggccctgctccctgcagccgcaaagcacagacaatggcagccttccctcttgtgccccctgctcaccccggagccaggctcctctgacttcccctccaaatccaaccctcttattcctcagatcaacatgtgccagagggacccactcagctggcaggacccagtcagaacctcaagcgcttcagaatctagtaagggaagtctgcatatcttgttgctgaagacacagaagaagtttgctctagagaatgagcttctgccaatgcacctgcgcgtaaaagtcatgctgcccacagcccactgcatgactaactcagggatctgaaaagcccacctgcttgtctcaagaaagtggtaattattgtgattatgagctattaatgtaatcataactagcaggcaatggagtggcccaggcagtaccttgggcctctgccgtcac

SEQ ID NO: 470829 - DNA, 456 bp, Homo sapiens
cagtgggggactcatggggtgtaaagatgtgactatcagagaaatgcaaagtgccaaagatagcaggcagccaacggttcagggtattgccaacactggggcactgagaaagagctcaagactgacctgggactcacagctgtgtcagatgctggacattgcctgcagtcagatgctggaccatgcagcattggaaatcctgctgaaccatcattccaagcaaaaagtcatcctctacatgaatgatcccaagagggcaggaccactccctcttaagccctcctctcctgttgtagaaattccagtctatgaggatcccccacagcctgttatggttggagatctggcctctacagctattcctttcctccatacccccaaagacaagtacaggtcctttgcattttaagagttttgctaatgattactgagagaaattctacatggagtaatagc

SEQ ID NO: 470830 - DNA, 1587 bp, Homo sapiens
aagctcactcctcctccccttgcctcagctgtgttctccggaagcaggttctgatatgaagattcctgtgaaagacatgcattaggaaacgttcccaggataaaccaggagaaggctctcgatgaatggtggttttaaaaagagggaagagtgattccataagagcttgatttgacaaaagggtgttgagtgcccacagcggctggctcggtgccagacaccatgcggaatggatttaaaatccatcctgggtcttatgatctaggcttgtccaacctgctggaagtgcctgaatcacttcgctgtggagtgagacaggatgaaggcctgaagggctcgccagaggagacgtgctaccaggtgcgagggatagaacaaggacatgctggagtcctggagggggcttctagagagtcgggggagagcagaaaatacactccatacccggaactgcaaggcggaggtggtcataagctaagatggagtcaggaaataagggcggcaggagccgcatgggaaatgaggacagaagttcatatgaatgtatccaaaagggcttcaagagacagcggtgcaagggcaggtgggagacccccagcatccacttgggcacaatccacagctgtgggagtatggatgccccagggggtgaacctttgaccaacaggggataggagccgtggaaagatacttcctccttccccactgcccactcttccccagaggcagttctgagatggaaacatttcatacagcttcttggtggccccagagaatcaagcaaccagtctcccataagagcggccaagcagaaaatgcatccttatcttggctctcctctccctcccactcttcactccatggtaggctgaataatggcccccaaacagatccaggtcctaactcctgatactgtgattgttacctactggcaaggggggtttcagtcacattttgcagatgcaattgtattaagaatcttgatggagagatcaatcccagcttagctggtaggctctaagtataatcacaggtgtcataagaggaaggcagggaaaatgcaattacagaagaaggcaatgagaggatggagtaagatccagtgccattgactttgaagatgcagaaaggggccacataccaagaaatgcaattataggaatgcagctccagaagctggaaatggcaaggaagtggattctcccccatagtctccagagagagcaaggccctgctgacaccttgatttcaacccactgcaactcatttggcatgtgtgaccaccagtaaactgtaaaagaacaagtgtgtgtttctctaagccaccaagtttctagtaatttgttacagcagccacaggaagctcatccggctccccgtccctcacttcatgctccctaggctcacactgtttgtgagatgctcacacataagcttctcctttggctctgctgtttggggaactcagggtaagatagcatctgattaggaatcaggccccagctttgtgtatacagatagcccggttctctcaggcccccactgacaccaacgtgcacctgccctatccttccccaaaaggcaatc

SEQ ID NO: 470831 - DNA, 655 bp, Homo sapiens
tcccgggaatcttcagagtacaaaaggctcttgccaaggcaccaatttaacaatttgacatggcgaatgaacagctgcttttcaattattggacacagttgtatttcaattctcttttaacagctgtgaaacagaattcctattcagaattttataacagtaaaccacacaaaaagactactatcctagaggctacctgcattccttggcttttatccccaatcttccatcttcggagccagcaacaatatattgatcatgaggagagggctcacccctcacccggagaagtagttggggaagcaatatgcggaaacaaagccatgaatctgacaagaaatgtacttaagattgtatatatggagatgaatacccattgtcctttgcactttctggatgataaattagaaaagaaaaatccaaagaatgaagttgtgctatttgtcctcacttctgatttgggaaactagaggaaattaagatgggaaaagaccatgtgaggacacagtgagaaggagaccatatgcaaagcaggaaggaagatctcactggaaccaaaaaccagccctgctggcaccctgatcttggacttctagcctttctcagaactgtgagaaaataaatttctgatgtttcagccactcagcctgtggtc

SEQ ID NO: 470832 - DNA, 617 bp, Homo sapiens
catgtttatctgctgaccttccctccactattgtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgcctccacatgccattggctacaacaggtcacatggggtgtaaccctgcaaagttacatggcaaagtatgtggacaaaggaagaggtgaagaatcaggccatccttggaaagttttgaggcactggattagctatggggaatgcagtgaatttctgaggccttaatatttagaaattagtattttaatatactcattgataattttaattgcgttgacttattactattggctttttagatctttacagtgaccttgataagtgttctgaccagggcataaggaattatgctgtttcagtgacatctctgaatgaagtattcttgaa

SEQ ID NO: 470833 - DNA, 2441 bp, Homo sapiens
agtttgactcaaccagactggacccagtgtatgacttcctggcacagtctgccctgtgaggattgggttatcaggaaagttgacttccaaaaagccagaagagaagcttcttaaggcttaggctccaaactggcacagggtcactgctgctgccttcccttggctaatatgattcaaagagatctccaaattcaaggggaaagggcaataccagacaaattggaagaagaaaagaagaaggagaaggaggagaaggagaagaaggtggaggaggagaaggaaggagaaaaagaagagaaggaggagaaggagaaggaaaataaggagaagaaggagaaggagagaaagaagagaaggaaaaggaagaagaggaataggaggatgagaaggaagaagacaagaaaagaggaagaaagaataagaagaaaagaaaaaaataaagaagaggagaagaagagaagatggagagggaagatggaagaaggaagggaggaagaagaatatccttggggtgctggcaggccactgcacatgcagacagcccacaccaagggaagaatcatggacacaggatactgggagtatgcaaatgcaagttgtaaccatttggaaggctcagaaaaagacatgaaaatgtgggaaagtttggagcttcctacagacctgttgaatagctttgaccaaaagcctgatagcaatatggacaataaggtccaggctgaggtggtctcagatgaagatcaggaacttgctgggaactggagcaaaggtggctcttgttatgttttagcaaagagactggcagcattttgccccttccctagagatttgtggaactttgaacttgagaaagatgatttagggtgtctggaggaagaaatttctaagcagcaaaccattcaagagcctgacaatgtaatagaaaagaaaaacccatcatcttctgaggagaaattcaagctggctgtagaaatttgcataagtaatgaggtgctgaatgttaatccccaagacaatggggaaaatgtctccagggcatgtcagtggtcttcacagcagcccctcccctcgcaggctggcaggctaagggaaaaatggttttgtgggccaggcccagggtccccatgctgtgtgcagcctagggacttggtgctctgtgttccagccactgtagctgtggctgaaatgggccaacgtagagcttcggccgtggcttcaaaaggtgcaagcctcaagccttggcagcttctaggtagtgttgagcctgcaggtgaacagaagtcaagaattgaggtttgggaacctctgcctagatttcagaggatgtatgaaaatgcctagatgcccaagcacatgtttgctgcagggaatgaatttaataaaaatcaaattatagtctagttctagtatatgtttatatcttatgaggaaagtgaatactgagatgttactgttattttgctaacctgggaaaagaaatgctaatgaattagttacaaaatgtaaatccggatgtggagggtagttattgtagttaaagaatacattttaagatcaagtgatttatttgcgaccgtttctttacgtatgaagaaaatccatttatataaatatcaattttgtggtaagaattttccatttttaatgttttttaaatggaaaaggaaaaacaaatgtctaaatctttgctataattcaagtaaactcagaatgatatagttccagcagatgtttacctatatagaaataaaatacggagatgtgtacgcagattgataaagatgtgcacatatgtgcatatgttcaaggccaggtctattagcaatcgttttataaatgtgagagttccagtgttaggtgcatatatgttcaggattgtgatattttcctgttggacaaggccttttagcattatataatgtccctctttgtctctttcaactgctgttgctttgaagtttgttttgtctgatataagaatagctaccccgttcacttttggtgtccatttgcctgaaattcattttttcacccctttactttatgtgagtccttatgtgctaggtgagtctcctgaaggcagcaaatggttggtgagttcttatccattctgtggttctgtatattttaagtggagcgtttaggccatttacattcaatgttagtatcaaaatgtgaggtactgttgcattcatcatgctctttgttgcctgtgtacttttgtttatttggttttttgtttttgctttttaacttgtgtttttgttttgcaggtcctgtgtgatttatgctttaaagaggttctgttttgatgtgtttccaggatttgtttcaagacttagagctccttttagcagttcttgtagtggtggcttgttaatggtgaattctctcggcatttgtttatctgaaaaagactgtatctttccttcatacctgac

SEQ ID NO: 470834 - DNA, 717 bp, Homo sapiens
acactgttaagatcagagacaagtaaataaaaataaagtattaatcatcataaataaatcaaacaaattttcctaactagcatgatccagcaaatcaaggttgaaatccgttgccaaaagcctagggctcagcagggggccatgcctggaagaaaggggggttatctttgcactggagggtgtagttgctgtatcttccctgctgttaaactacacttttcagaggctactgacctgggagctttcatcagccttaaacccacttttaataacaacaagctcagggaatctggggagttgttcaccaatgtctggaactctgacagatatcttctagttctgcttgaccattcaaataaacattataaattctactgtggagatgcttccaacatagatgtaattgatgatgaaatcaatgactgttcaactgctgttctgataagggagataaagtgcagatggagtcagggatcaaagcttctgttgggaagaaatgcttgggttgggtgctacagatgcaacgagagttcagcagaaagcagttttgaggaactctattcccagagcaatctaaatccaaagctgggtggaaacagtactagttggtagaagtaactttggcttaaagggcaagctatgtttgctatgtttacagaccaatggtaaaataaaacaaagataatataagtaaaattttatctgcatctatattta

SEQ ID NO: 470835 - DNA, 1494 bp, Homo sapiens
taatccaatgtgtcaaaaatatcatttcaatataaagataatcaatataaaacactttaaatcagcagcagaactgcatgcttactggaatcaaggtttggatctagagctatggccacgggagaaaaatggtcaccttcccagcctcagcctttcctgtgaatggtcccccttatatgtttctttccaggctaatggtccattatggcaccagccatgtggaaataacatctcagggctgcctcatctgatttcatttttcccaagacaatatgcagctgcatatgccaaagtggagactgtcgagaacacccactacttcatgtgggaacctgagaaaatggaaatcagctcagatgagcagactggaatgttcccaacagtcataaacaaggccagcacaaggccagatttgaaaagtaatacacccacagcagaaaactgaaagacaactaaatgtccatcagtaggggacagggtggttgcattaattgcgacacacttgtggatgcaatactatgcagtcattaaaaagaacaaagcagctctattggtactgaaatagaactatctctaagatgggaaaaaataaggtggctcaagttctacagtatgctgtcatttgtatttaaaatgtatatatgaatatgcactggtaactggttgcttttgtgaattcagtagagggacaagcaggaggcagcttatttttctgtaaccataatctcctcctcccccagacatagaccttgatgtgtgctttctcttccctcttcctattataaaaataaattatgctcattgtagaaagtgaaaatatagtgtgactgtgtacttttgctctggaatgaaacttgagctgaaaatctggttccattgctaaccagctgcattaccttacagaagtcactcatctaatatgcctgtgcctcaggagaaataggatagaggttgggtaaatactaagtgagcacccatcttggaaagtatatatatatatatatatatatatatatatatatatatatatggaaagtatatatatatatatatatatatatggaaagtatatatatatatatatatatatggaaagtatatatatatatatggaaagtatatatatatatatatggaaagtatatatatatatatatatggaaagtatatatatatatggaaagtatatatatatatggaaagtatatatatatatatggaaagtatatatatatggaaagtatatatatatataaatggaaaaaatatatatatatggaaagtatatctatatatatagatagtatatatatatggaaagtgtatatatatatatgtatatatggaaagtatatatatacacacatacttctctttttgagaaagagtcacccatgctggagtgcagtggtgcaatctcagctcactgcaacctctgcctcccaggttcaagtgattctcatgcctcagcctcccaagtagctgggattacag

SEQ ID NO: 470836 - DNA, 1096 bp, Homo sapiens
ggagtgagggctgcgggctgaggaagcaggcaggcttggtagtaacaagagcacacaatgatcaatggttcccaagggggcatgcaattggcttgtttgaataaattcatgggctggcagacagaggagctctatggtgactttgaagacttggaaacaggggacgtgcacaagggaaaatcgggccccgatactcagagaaacaaggaagaaattgaccccgacaaagaagaaagtgccaagaaaaagcatttggataagaagagaaaattgaaggagatgtttgatgaggaatatgatgaaggagaaagcacatattttgatgatcttaaaggagaaatgcagaaacaagcacagctgaatcgcacagaatttgaagatcaagatgatgaagccagagttccatatgagggttttcggcctggggtgtacgtccgcgttgagattgaaaatgttccctgtgaatttgtgcagaactttgacccccattaccccattatcctgggtggcttgggcaacagtgagggaaatgttggagacgtgcaggtgggtccctttgctgcatatttggtgcctaaggctctgtggatttcccctccatcaatcatcttacactctcatccccctcagatgcatctgaagaaacatcgctggtataagaaaatcctcaagtcccgagatccaatcatattttctgtagggtggaggaggtttcagaccatcccgctctattatatcgaagaccataatggaagacaaaggcttctaaagtataccccacagcacatgcattgcggagcagccttttgggaaggagctttccgggccagctttgaggataagctgctgatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcctatggtgtcagactaaaggcaaataaggactctctgtataagagtttaagaagtaaactccaggggatgggagtgactctggacatgggagtgacatgatagtgac

SEQ ID NO: 470837 - DNA, 1684 bp, Homo sapiens
gccgaggacagtcctttcctttcccattgtctttggatgactatccctgggctgggacatgaggcaggcagaggcgcgggtcacccttagggcccccctcttgctgctggggctctgggtgctcctgactccagtccggtgttctcaaggccatccctcgtggcactacgcatcctccaaggtggtgattcccaggaaggagacgcaccacggcaaagaccttcagtttctgggctggctgtcctacagcctgcattttgggggtcaaagacacatcattcacatgcggaggaaacaccttctttggcccagacatctgctggtgacaactcaggatgaccaaggagccttgcagatggatgacccctacatccctccagactgctactatctcagctacctggaggaggttcctctgtccatggtcaccgtggacatgtgctgtgggggcctcagaggcatcatgaagctggacgaccttgcctatgaaatcaaacccctccaggattcccgcaggcttgaacatgtttctcagatagtggccgagcccaacgcaacggggcccacatttagagatggtgacaatgaggagacaaaccccctgttctctgaagcaaatgacagcatgaatcccaggatatctaattggctgtatagttctcatagaggcaatataaaaggccacgttcaatgttccaattcatattgtcgtgtagatgacaatattacaacttgttccaaggaggtggtccagatgttcagtctcagtgacagcattgttcaaaatattgatctgcgacctatccaaaatatatgtgaccttccagagtactgtcacgggaccaccgtgacatgccccgcaaacttttatatgcaagatggaaccccgtgcactgaagaaggctactgctatcatgggaactgcactgaccgcaatgtgctctgcaaggtaatctttggtgtcagtgctgaggaggctcctgaggtctgctatgacataaatcttgaaagttaccgatttggacattgtactcgacgacaaacagctctcaacaaccaggcttgtgcaggaatagataagttttgtggaagactgcagtgtaccagtgtgacccatcttccccggctgcaggaacatgtttcattccatcactcagtgacaggaggatttcagtgttttggactggatgaccaccgtgcaacagacacaactgatgttgggtgtgtgatagatggcactccttgtgttcatggaaacttctgtaataacaccagtgtattctattattttgtgggtgaacgctaatggacagaggttgtaaagtccatttcacctagtctataccacagactatggaaactatatatatatatatatatatatatatatatatatagtgctgtccctctagagaaccctaatatgtatatataatatatataacatgccctgtcattaagatcaatgggaaactacaacagtatatatatatatatatatatatatataatatataaaatatatatataatatagataatatatactatatataatagtatatatactatatataatatattatttatgtattatatacattatattatattatatatgtattatatacattatattataatattatatatgtattatataatatattaataccttgctaatc

SEQ ID NO: 470838 - DNA, 558 bp, Homo sapiens
ttgtctgagctgaagagttcgagatgaatctgggtaatacgaagggagtcttatgcactgtacaaggtgttactgccaaaagctgcaacccaagtaaaggacctgctaatctgcctcatggccaccgcttcagaccttggaaagtgacacgaggctcagcgttatcacataactgcagtgtggaccagcaactgctgagcacaagcagtctattcaccctcctcagtgtcatacctttctgctgtcttctgattgagttctctgcctacactctcctccaggtgatagttgtagcctttacagcaaaccagtggacaagaagcatcagggtctttggaaattttgctgtgcattggaccagtgtccctgacactgttggtccaggtatcatacattgagaagcactggatatgtgcaccttggctgttccaagtagggtctgcaaccagaggcattgacatcattttgggaacttgtaatgcagaatctcaggccccagctcagacctactgaatcataatctgtaatttaataagatccctaaaaaatttttaagca

SEQ ID NO: 470839 - DNA, 769 bp, Homo sapiens
tgggaactctttgcagataagaaaaatggtataatggcgcccctgctggagagtcaaagaattttgtcatatgactcgtgcaaggtcatataaatccctggaacagtcctctttcctagaactgacagaggggagaaatcatttttctctgctgctgctgctgctgcttcttcttgtcgttgtcgtcttcttcttcttcttcttcttcttcttcttcttcttcttcttcttcttcttcttcttcttcttcttcttttcttcttctccttctccttctcctccttctccttctccttcttcttcttcttcttcttcctcttcttcttcttcttcctcttcttcttcttcttcctcttcttttttttttgagacagatgaaaatgctcccacaaccaatgccctttcccccaaagcttcctgcctccagactgacagcaagcaagaaactatctgtcggtgtttaattcctccgcttcctccacctattgggactgacccagagttgacagcggaaacacctacacaataataggtagaaggatttcccagggagctttggttcgtatgtgggcttgcagtatttgggtagctgctttctccagcactataatttcccttgtaccatttttttcacccgggcctataacagagagatggctgcagactgttcccatgaatagcatcaatctcttcaccttctggagcttcagcttgtactcttaagatggaatccagctggctgggtgtaaatgtgctttgtttgtgccaa

SEQ ID NO: 470840 - DNA, 1310 bp, Homo sapiens
tgcccagcagctcattgagaacgggccatgatgacaatggcggttttgtggaatagaaaaggcggaaaggctgacttcatcccgctggatggaattccagccaatgtgatccaaagagggaagcagtaccaggctgcagccctcgtcatgctgaagatggagcctcctgggaagctgctacccatggtcatccaggcagtgagcacaggtggagggggccatgtgcagttgctccattgggcagcggctcagctgacctgctgctccctctgttgtcctgatgacctggctgcctgtggcctgctgggactcccaccgccttctcccctgggcaggtgtgtggagatcgtccacctcctccaccaaagggatgacacggtgagggtggaccctgagctgcaggcctgggatcaggagatcatggaggtggggctgtgccaggcccaggaccgagtgctgcccttctggggacaggaccccaccctctcctcacacctcccttcctccacacaggagagcatctgcatcccattcccacctccccagactcaggacacttctagagacctgaggactgtcctcctcggagaccctggccatcaaccctacccccaccccaccccagtcacagatgcccctgagctgccatatcctggggcccaaccaggccagagccacagctgtgagggggtctgccggtccctgctggggctcatgttctcacttcacgtttgtctgctttttacctaaggatgcaaacagggagattttcccttccaaagctcagagtgacctaccttggctttccctcccttcccctcctgcctgctactgtccagcacacacgaagggcacagacctgctgcacccccgcagcagtgcaaggccagctctagaggccatctcaatactgtatatgctttggctccaacctgaactcaatgccctgacgcttgggtcagtcccttccctaggatctagctgctaccttttgtccccgcccactgcatttttatttatggagaagacatagcctttcttgggcccttcccaggttcattttcctctctctcgcacacatgggccagccaggattgtttcaggtcatccttcagcttctctcccttcatccttcagagcaacaccttgagtcccaccctttgcctgtgtgggaaaacgcaaacacccactggccaggccccggggacgcccatatcaataaattaacccctgccttaaaggggagtcttgccctggaggacctggggctacaccaccttacccatcccaccccaccctttgggcccttc

SEQ ID NO: 470841 - DNA, 804 bp, Homo sapiens
agcacatacatcctcaacaactcatgaaacatttccaggttagctttttcctatcttcaatactatacaacgagtggcacctgctccaggtgggacatcctgaaaacctcactaggcatgtcccacatcgccctggagctgtctcaggggagcagtctcctccagtgtttagaggcacagacacaggtgcccagtgtgaggtgcagctggtggagtctgggggaggcttggtacagcctggggggtccctgagactgtcctgtccagcctctggattcaccttcagtaaccactacatgagctgggtccgccaggctccacggaagggactggagtgggtttcatacattagtggtgatagtggttacacaaactacgcagaaacacacagcgaggggaagtcagtgagagcccaggcacaaacctccctgaaggggtcccagagaccaccagggggcgccaggacactgtgcacggggctgtctccagggcaggtgcaggtgctgctgagggctggctttctgtcatggcctggggcagcctcatcatcaacatattgtcatttattcgattcgtagactgactctgatatgaaacctcaaagttttcacgtacgtatggagagagagagaggaaggagaaagattttatatctgagtcagtccattaagtaaataaatgagaatattttgatttattttcctgttgatgtactttaaatttgtttccattttatgaatattataggcaaagctgtttcaaatatattagtgtaggttttcctatattgtttcatttttgtta

SEQ ID NO: 470842 - DNA, 767 bp, Homo sapiens
ccctgtagcacagctgagctacagagtctggccacctccgagttggagtggcagctctctctccacggggcctgcagaggctgggccacctctgagttggagcgacagctctctctctatggggccagcagagcctgggccaggtgtacatcaggtccagcttctgtcctggcctctgccaggtgttacatccaacaaaccttacacagaggaagccgctgacgaattccaacaagaactcacgagaaaaactctcagaaaactaggtctagaagcgcacttcctcaacctgataatggctgtattgcgtccatttaacattatactggagacattacgcagtgcaacaaagcaagaaaaagaaattaaagacataaacatcggaaataaagaagtcaaactgtatgtattttcagatgacataattacacacatagaggatcttaagaaacctttcaaacagctcccagagccaataagtgaatgtagcaaagttagaggaaatgaggtcactatgcaaaaatcaattacatttctatatgctgtcttaaataatttttaaactgacattaatttaacaaaatatttgcaagatatgtacagataaagctccaaggcaccaagacaactaaatcagtatgtgatgattatggaagatgaagccactatgtgcatgggtcagaagactccatattactaggatggtaattctcctcaaattcatctagatttaatgtaattccagtcaaaatctcagcaggcttctc

SEQ ID NO: 470843 - DNA, 2970 bp, Homo sapiens
ccaagaagtctgtgtcttgtccggtggagagacaaagctcccgtggtccagacgctgctgggtttgcatctgccgtgcctatctcagcctgcaccctgagatgcacgggcgcttggcccaatgcctcctggagcacactggacactggaagcattctgtggttgccgagggagcagtcggacagaggttccaacagcaagtgacaggcaatgacagtgctccactcacctggtacctgtctgccaggcccaggaggaagcatgctgaattccttctttcccaccacactactgggtgcatggacgagtacacaggagagctctttgctttagggggctctgctagtaaccagggctgtgctagtagccaggacagtgctagtagccagggctgtgctcgtaaccaggacagtgctagtagccagggctgtgctcgtaaccaggacagtgctagtaaccagggctgtgctagtagccagggctgtgctagtaaccagggctgtgctagtagccaggacagtgctagtagccagggctgtgctcgtaaccaggacagtgctagtagccagggctgtgctcgtaaccaggacagtgctagtagccagggctgtgctagtagccaggacagtgctagtagccagggctgtgctcgtaaccaggacagtgctagtaaccagggctgtgctagtagccagggctgtgctagtaaccagggctgtgctagtagccaggacagtgctagtagccagggctgtgctcgtaaccaggacagtgctagtagccagggctgtgctagtagccagggctgtgctagtaaccagggctgtgctagtagccagggctctgctagtaaccaggagagtgctagtagccagggctctgctagtagccagggctgtgctagtagccagggctctgctagtaaccaggagagtgctagtagccaggacagtgctagtagccagggctctgctagtagccagggctgtgctagtagccagggctctgctagtaaccaggacagtgctagtagccagggctgtgctcgtaaccaggacagtgctagtaaccagggctgtgctagtagccagggctgtgctagtaaccagggctgtgctagtagccaggacagtgctagtagccagggctgtgctcgtaaccaggacagtgctagtagccagggctgtgctagtagccagggctgtgctagtagccagggctgtgctagtaaccagggctgtgctagtagccagggctctgctagtaaccaggagagtgctagtagccagggctctgctagtagccagggctgtgctagtagccagggctctgctagtaaccaggagagtgctagtagccaggacagtgctagtagccagggctctgctagtagccagggctgtgctagtagccagggctctgctagtaaccaggagagtgctagtagccagggctctgctagtagccagggctgtgctagtagccagggctctgctagtaaccaggagagtgctagtagccagggctctgctagtagccagggctgtgctcgtagccaggacagtgctagtagccagggctgtgctagtagccagggctgtgccctcaacccttgctgccgagggcaaagtagcaaagcctccctcggtccctgtggcttcttctctgcacggcggaacctgcaagagcaccctgccccctgccagatgggtgccttcacccccggaaacattttgttcatcatcagctgctgtgtttctgcttacttctctaatgaactgagtcataagagagagagccttggctaatttcaggagagagacgggaagacaggaagggttccaattctgttaacaaggaggagagggaaagctggagacactagtaagagctgagcataaagtgggtgttattcccagtgcgcaaagacaatctaataaggctggatccagacacatgtactcactccaccttctaaaacaaacaccaattagaaaggaacgtatgtgaagcactaggaatgtgctgcggcatggcaccaaaagctgtgtgtgtgtgtgtgtgtataggtgagtgtgtagatgtgcatgtatgagcatgtacctgtgtgtatgtgtgcatgtgtgtacatgtccatgtttctgtgtgcacatgtatatgtgtatgtttatgtatgtataggtgggcatgtatatatgtgtatataggtgtgtgcatgtgtgtatgcacatgtatacatgtgcgtgtctatatgtgcatgtatgtgtgcgcacatgcatgtgtatgtgtgtgggtgtgtctatggtgtctatgtgtctctgtgtatatgactgtgtgtgtatgtgcgtgtgtttatatgtgtggacatgtatgtatatgtgtgtgtgtatgtgtgtggcatctatgcatgtctatatgcatatatgtctatgtgtgtgcatacatgtatgtaaatgtaggtgagtatacgtgtacatgtgtgcatgtgttgtctatgtgcatgtgtatgtgtacatgtctgtatgtgcatgtgcttatatacgtgtgtgtgtgtgtacctgctcctcctaaacttgattgtgctgtgcgtctgcatccttcctccaaacctggcctctgcacgcatgtgctgccatccccttctggaatgaccaccgtcgatgctccgcctccagccagctcctccccttgtgtaatggatcctgttcccttcacacctacttaagggccgccctcaggagctctctctccctcccacacatcagcttttccctctctgccaggttactcccattagcacaaacacatgctctcataatgtccatgtgacgaaaacaaacctccctcaggagcttccacatggcatcgcccaccctctcttgaacagtttagaatcacatgagagcccaccaccctgcgttgacactgcttttgttaaatccagcaatggccccgtgtgcacaaatacaac

SEQ ID NO: 470844 - DNA, 1268 bp, Homo sapiens
tcctagagcagagaccaactggggccatccatggccctgtgccatgctgcctcctggacgcacgctaggaggtggagatggtccagccccagcaggactgggccacgaggaccctgccggtaacctggtgctcaccgcccacagatcacggggcgtggagggagagactgccagtgctgtcctagtgcagcacagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactgcacctctgaccacatcatgctccgagaacgtggacgctgcacctctgaccacatcatgctccgagaacgtggacgctgcacctctgaccgcatcatgctccgagaatgtggacgctgcacctctgatcatgtcacactccaagatcatggacattgcacttctgatcatgtcatgctctgagaacatggacgctgcacctctgatcatgtcacgcttcaagaacgtgaacactgcacctctgaccacgtcacgccccgagaacgtggacgctgcacctctgaccacatcatgctctgagaacgtggacgctgcacctctgatcatgtcacactccaagatcatggacattgcacttctgatcatgtcatgctccaagaacaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggagcaaaaatgatcttgagtatgtttcctcaagcctttttgaatatattcaattttaatgtattatgttttcacatttcatcatagaaaaatgctgaaacaatcagtaacaaaatttgaaattctgtttggtagattttcacattaacatgtgtacagttgaatattttataattattaattctttatgtggaacaccgcaaaagagtgactgataagtataatgtggtttatccatgaaaaaggat

SEQ ID NO: 470845 - DNA, 1245 bp, Homo sapiens
agacatgagtgctgatgatgcagctggctgtgtggagccctctctgcacctgggcggcacaggacacagacacgagtgctgacgatgcagcttgctgagccccaggctccaagagccaacctagtgcctcatggctatgacccccgtgagggtgctcatggctatgacccccgcgagggtgctcgtggctatgacccccgcgagggtgctcgtggctatgactccggcgagggtgctcgtggctatgacccccgcgagggtgctcgtggctatgactccggcgagggtgctcgtggctatgacccccgcgagggtgctcgtggctatgacccccgcgaggctggttttcccgacgtctgctcagctctcagcagagaggagaccctggagtgggtagctcctctccgcagctggttttcccgacgtctgctcagctctcagcagagaggagaccttggagtggctggttttcccgacgtctgctcagctctcagcagagaggagaccctggagtgggtaactcctctccgcagctggttttcccgacgtctgctcagctctcagcagaggagaccctggagtgtgcagctcctctctgcagctggttttcccgacgtctgctcagttctcagcagagaggagaccctggagtgtgcagctcctctctgcagctggttttcccaacgtctgctcagctctcagcagagaggagaccccggcatgggtagctcctttctgaaggcaggttatgccatcgtttccttgagtctggctgagtccagggtttttatgggcttcaaaggggaggaagtatgtgctgactgattcatgggcagccatgggcaggcttggaaaaagcactaaaagttcccattctggtccatcagcccagcccccaggcttcaggctgtccctggcttgaaggtggcacttcactggggacctgcccctttctgcccaggaccctgtctgcctcctgccatcatccataacacccaggctgattgtgccaaggggcacctgcaggccagtgccaaactgccctcagtccccaccctcagcctccctcccatgctcgttggtgcccaaagtccagaggggctgacatagcaggggtgtttgtgcagtcttacgactttcttttcttccttatttccttcctgtctgctttactgcctccccttcttggtctcagaccataatgtgtaacaaacatatatttttaaacattattttaaaagacac

SEQ ID NO: 470846 - DNA, 522 bp, Homo sapiens
tgtcctttttctgtcccaggatcccacatgacattgagtcctcgtgtcttcttgggcttctcttggccattgggatttggagaggaagaccacagaggggagtgcccttctggtcccgtcataatgagggtgcatgctgttggaatggcagatccctggtggcgctggcctgggtccctggctgaggtggagcagacccggctgagaggttgtgatatgcagaaaatcaacaagattgcattgctagggagcacgtttgtgaagctggcgtcttccacagaagctgtcatcagcgaggaggggctgttgaggggacacatttgtgaagccagcatctttcacagaagctgtcatcagcgaggagaacccagtgctttttctgttgccctggccctctgggctgagtctttacgtggacggcggtcgatgcatctcagtttatttgtcaaaaccttcagctaaagccagttgttgcttgaaaactgcctgcttaattggcctcctcagctcgggggagcagct

SEQ ID NO: 470847 - DNA, 822 bp, Homo sapiens
agcagtcgcatgaccgcctctgccgggtcctccagccctccccctgcttctctgcatctgggcccccttgctttgccgcctgcctggttcccctggggagcagccctgctctgccagcccagcctgtgcttccagtcccatcccccagcctgcccgaggatgccctccagcagcctttccccaccctccgtgcccccagctggagcgttcttgctgctgatccggggcccagtcagctctccatccttatctcgcctggcccggtgctggtttgtggctctgccctggacgttgctccctggcgtccagacctttgagctctgctttccctccactgccgggccctcaccggccccagcgcggccccagctcatctccttgcacagcccgttcttcgccgagcagctgaccgcattccaggtgtggctcaccatgggcgtggagaaccgaaacccacccgaacagctgcccatcgtcctgcagtgctcttctcccaccacagggaagctcctccctctccacggctccccagggcccatgctcctgactcggtggctcctccgtggaagtcgtgctggccgacccccaggagcttgacccaggtggccgccatctcctctcccctcccccgatcctccaccctcactggcctcctcgtccctttcccctgcctctcttgagggttttcaaactcatcccaaaccttcttttctagagtttgctttccttcaccccttcttctctcagcctctggccagtgctgcagtctcctcctccccatctccgtattggcaccctggtcaaacccacccccttccactc

SEQ ID NO: 470848 - DNA, 2900 bp, Homo sapiens
tggaatcaacaaaagttggaatggaatggcatgaaatggaatgcaatgcaatggaatggaaccactaagagtggaatggattggaatggaatggaatggaatgaaagggaatggaatcaacccgagaggaatggaatggaatggaatgcaatggaatggaatggaatgcaatggattggaatggaatacaccagagtggaatggaatagaatggaatggaatggagtggaatcaaccccagtggaatggaattgaatggaatggaatggaatggaatggaatggaatggaatgcaatggaatggattggaatcaaaccgagtgtaatggaatggaatggaatggaaatggaatggaatggaatggaattgaagagaatggaatggaatgcaatggaatggaatggaatggaatggaatggaatggaatggaatggaaaggaatcaaccagagtggaattgactgtaatggaccggaatggaatggaatggaatggaatggaatggaatggaatgggaaggaatggaatagaatggaatggaaaggaatggattggagtggaatggaatggaatggaatggaatggaatggaatggaatggtatcaatgcaagtgtaattgaatggaatggaatggaatggaatggagcagaatggaatggaattgatttgaatgcaatggaatcacctggaatcgaatggaatggaatggaatcaaatagaatggaaaggaatggaatggaatggactgcagttgaatggaatggaatggaatcaacctgtgtggaatgtaatgcaaaggaatggaatggaacggaatggaatggaatggaatggaatggaatggaatggaatggaatcaacaaaagtggaatggaagggaatggaatagaatggaatggaattggaatggaaaggaatggaattgaagagaatggaatggaatggaatggaatggaaaggaatggaatggaatgcagtgcaatggaatcaaccagagtggaattgagaaatcaacacgagtggaatgaaatggaaaggaatttaacggaatggaatggaatggaatggaatccaatccaatgtaaaggaatggaatggaacggaatagaatggaatggaatggaatggaatggaatggaatggaatggaaaaaattcgagtggaatggaatggaatgcaaaagtggaatggattggaatggaatggaatggaatgaaagggaatggaatcaacccgagaggaatggaatggaatggaatgcaatggaatggaatggaatgcaatggattggaatggaatacaccagagtggaatggaatagaatggaatggaatggagtggattcaaccccagtggaatggaattgaatggaatggaatggaatggaatggaatggaatggaatggaatggaatgcaatggaatggaatggaatcaaaccgagtgtaatggaatggaatggaatggaaaggaatggaatggaatgaaatcaacccgaaatgaaattgagtggattggaatcaatctgagtggaatggaatggaatggaattgaagagaatggaatggaatgcaatggaatggaatggaatggaatggaatggaaaggaatcaaccagagtggaattgactgtaatggaccggaatggaatggaatggaatggaatggaatggaatggaatggaatgggaaggaatggaatagaatggaatggaaaggaatggattagagtggaatggaatggaatggaatggaatggaatggaatggaatggtatcaatgcaagtgtaattgaatggaatggaatggaatggaatggagcggaatggaatggaattgatttgaatgcaatggaatcacctggaatcgaatggaatggaatggaatcaaatagaatggaaaggaatggaatggaatggactgcagttgaatggaatggaatggaatcaacctgtgtggaatgtaatgcaaaggaatggaatggaacggaatggaatggaatggaatggaatggaatggaatggaatcaacaaaagtggaatggaacggatggaatggaatggcatggaattgaagagaacggaatggaatgcaatggaatggaatggaatggaatggaatggaatggaaaggaatcaaccagagtggaattgactgtaatggaccggaatggaatggaatggaatggaatggaatggaatgggaaggaatggaatagaatggaatggaaaggaatggattggagtggaatggaatggaatggaatggaatggaatggaatggtatcaatacaagtgaatggaatggaacggaatggaatggaatggaatggaatggaatggaatcaacaaaagtggaatggaagggaatggaatagaatggaatggaatgcaatggaattgaaagcaaaggagtcaacccgaatggaattgaatggaatcgaatgcaatggaatggaatggaatgcagtggaatggaatggaatggaatggaatggaatggaatggaatggaatggaatggaacggaatggaatggaatgggatggaatggaatggaatcagccagagtggaatagaattgaatggaacggaattgaatggaatcaacccgagtggaatggaatggaatggaaaggaatggaatcaaccagagtggaatggaattgaatggaatggaatggaatggaatcaacccgagtggaatggaatggaatggaaaggaatggaatggaatggaattaacccaagtgaaatggaatggaaaagaacggaatggaatttaatggaatggaatggaatggaatcaacctgagtggactggaatgaaatggggtggaatggaaagcaatggatttcaatggaatctgccagagttgaatggaattgaacggaatggaatg

SEQ ID NO: 470849 - DNA, 901 bp, Homo sapiens
cggaatagaatttaatggaatggaatggcatgcaatggaatcaaccgagtgcaatggaatggcatgaaatggaatgcaatgcaatggaatggaaccaataagagtggaatggattggaatggaatggaatggaatgaaagggaatggaatcaacccgagtggaatggaatggaatggaatgcaatggaatggaatacaccagagtggaatggaatagaatggaacggaatggagtggaatcaaccacagtggaatggaatggaatggaatggaatggaatggaatggaatggaatgggatggaatgggttggaatcaaaccgagaatggaatgaaatggaatggaatggaatggaatggaatggaatggaatggaatagaatggaatggagtggattggaatcaatctgagtggaatggaaaggaatggaaaggaatggaattgaagagaattgaatggaatggaacggaatggaatggaatggaatggaatggaatgcaatgcaatggaatcaaccagagtggaattgagtgtaatggatcgaaatggaatggaatggaatggaataaacctgagtagaatgcaatggtagggaatggaatcgaatggaatggaatggcattgaatggaatcaacacgagtggaatggaatggaatggattggattggaaagttatggaatcaacccgaatggaatgtaatggaaaggaatggaatggaatgcagtgtaattaacccgagtggaatggaatggtatggagtgaaatggaacggaatggaatggaatgaaaaggaaaggaaagcaatggaatcaaaacgagtggaatggaatggaatgtaaagaaatgaagtggaattcaatagaatcaacaccagtggaatgaaatggaaaggaatttaa

SEQ ID NO: 470850 - DNA, 456 bp, Homo sapiens
ccacgtaagatcgtcgagatgtctacttcgatgactggcaagcacggccatgccaaggtccacctggttggtactgacatctttactgggaagaaatatggagatatctgcctgtcaactcataacatggatgtccccagcatcaaaaggaatgacttccagctgattggcatccaggatgggcacctatcactgctccaggacagcatggaggtgcgagaggactttcgtctgcatgagggagaccttggcaaagagactgagcagaagtacagctgtggagaagagatcctgatcatggtgctgtctgccatgaccgaggaggcagctgctgcaatcaaggctcccagggcatctgggagagccctgcccccacgggctttacccttccctgcaggctctctccccgacacatttgttaaaatcaaacctgaataaaactacaagtttaatatg

SEQ ID NO: 470851 - DNA, 2405 bp, Homo sapiens
ccttttcctctcagtcagcccccacctcacgggcctgccctgcagggtgtcggggggctcttccttcttgtttttctagccttcgctcagctcagtcagtcggagcctgaccgtgggggcagctcctctctggggccggagaatcattcctgtctcctgtcgaaatgacccttggtaggaagacatagatatgagtatagacatagatatggatatggatatagatatggatatggatatagatatggatatagacatggatatagatatggatagattggaaatggatatggatgtggatatagatatagatgtggatatggatatagatatggatgtagatattgataaggatatagatatggatagattggatatggatatagatgtggatatggctatagatgtggatacggatatagatatggataggttgaatatggatatggatatagatatggatatggatatagacatggatatagatatggatagattgaaaatggatatggatgtggatatggatatagatgtggatatggatatagatatggatgtagatattgataaggatatagatatggatatagatatagatatggatatagatatggatagattggatatggatatagatgtgaatatggatatagatgtggatatggatatagatatggatgtagatattgataaggatatagatatggatatagatatggatatagatatggatagattggatatggatatagatgtgaatatggatatagatgtggatatggatgtagatatggatgtagatattgataaggatatagatatggatatagatatggatagattggatatggatatagatgtggatatagatatagatatggatatagatatggatagattggatatggatatagatgtggatatggatatagatatggataggttgaatatggatatggatatagatatggatatagacatggatatagatatggatagattggaaatggatatggatgtggatatggatatagatatggatgtagatattgataaggatatagatatggatatagatatggatagattagatatggatatagatgtggatatggctatagatgtggatatggatatagatatggataggttgaatatggatatggatatagatatggatatggatatagacatggatatagatatggatagattggaaatggatatggatgtggatatggatatggatgtggatatggatatagatatggatgtagatattgataaggatatagatatggatatagatatagatatggatatagatatggatatagatatggatagattggatatggatatagatgtgaatatggatatagatgtggatatggatatagatatggatgtagatattgataaggatatggatatggatatagatatagatatggatatagatatggatagattggatatggatatagatgtggatatagatatagatatggatatagatatggatagattggctatggatatagatgtggatatagatatagatatggatatagatgtggatatagatatagatatggatatagatatggatatggatgtggatatagatatggatatggatgtggatatagctatggttgtggatatagatataaatatgtatagactggatatggatatggatgtagatatggatatggatatggatataaatatggatacggacatagacatatcatagatatggatgtggattacaaatgccctctcagactctctcaaggactatccatagacccctcctgatgccgtgcatgcgtatgtgtgtgtttatgtgtctgtgtgtgttcgtgtgtgcttgtgtgcatgcttgtgtgtctgtgtgtgcatgtgtttgtgtgtgtgtgcatgtgtgtgtgcatgtgtgtatgtgtgcctgtgcatctgtgtgtgtctgtgtgtgtgtgtttaggtgtgtgtatgtgtttgtgtgtgtgcgtgtgtgtgtgcatgtgtttatgtgtgcatatgcatctgtgtgtctgtgcatgtgagtgtgtctgtgtgtttatgtatgtgtgtgcatgtttgtgcatgcatgtgtgtgcgtttatgtgtgcatgtgcatctgtgtgtgtctgtgtgtttatgtgtgtgtgtttgtgtgtttctgtgcgttctgtgtgtgtttgtgtgtgcatgcgtttgtgtgtgtgtgcatatgtttgtgtgtgtttatgtgtgtgtgtttatgtgtgtttgcgagtttcatgtgtttgtgtttgcgagcatgtgtttgtgttctgtgtatgtgtgtgtgttttgtgtgtgtgcatgtgtttatgtgtgtttatttgtatatgtgtttatgtgtgtgcacaagc

SEQ ID NO: 470852 - DNA, 847 bp, Homo sapiens
ctaatgctgagcagcactgcggtggaagctggaagcctggattctgggctggctccggctgcttcctcccggtgtgaccttgggcaaggctatctgcgctttgtgtacctcatcggtaaaatatagaacttacccactcacaggtatgtgcaagtcaaatgagccagtatgactgcctcttaggaagcccacggagggtcctccttggcactagttgtgcgctgacctatggacactgggagtcccagatcctttggtcacacccgtccgtaaccatggggagcacactggttttcaatcagaggcaaaccaggacttttgaagataaatccagtcccattaagccggacatctggaaagaagcaggatacatttgtgtgaaagaggacagagaagcaggacccagggacctggggcattcatgcaccaaaccctgctgggctttgactgagggctgctttggctgggggcaggtgttgcttccctggcacttctggtctgctgcgctcgtggccagagaaagaggcgcaggcgctggcagtgggagctcagtcagcaagcccggaaatggaatgggctgcgggcagtgcccgcacctgcaccttccccttcggccctaacatattctatctttgtccttgtcacttattgttaatctgctcaccagtgtccactcccctttggactctgagccccccacagaggcagaaagtggtgtcggaagcatctctgctttcctagtgtctagcagggcctggccctcagggccactggttgagtggaatcgagcaacctcaatccttccccactcctgctgtcccttcgtccctcaaggaggctcctactc

SEQ ID NO: 470853 - DNA, 415 bp, Homo sapiens
atgctccttatgatatcacagaaatgctgaaagtcaaaggatggaaaacagcacaggtttatttctggctcctcattcaatgctccctagaggatgtggccagcattgctgtattcacatttcatcgccaaggcacaccacacggccgccactccctccagggaccaaggagcacagcccttcatgcacagagggagcccagtgccacacggtccctgcaggtggccagcccagggggagagaccaagagtgggctgtggctttcacttttggccatggtcaaagacttcacctcggccggcaagacggtgcctcttgctcagaccccttcccggaccaaaggacaaacagtgaagcacgggctagagccctcctcacccaattgtcatttttattggtagccctggattcttcc

SEQ ID NO: 470854 - DNA, 995 bp, Homo sapiens
gattgcagtaggagagattgagcaccttctctccccacaacccctccagcacccccagctcctgccctgcccccatcccctcccggcatggtttgaatatcctctgtggcctccaccttgatccccgtcccctacttggggctccccagtccctaccccacccccagacagcaccccacctccccgctaggctccccagacctgacccagggccgtctcctccatgggtgccgccagcttcttggtggatcctgtactctccatgcagccacttcacgatgcccccacatcactgccacccttctctggcacgctggaacacgtgctcctcctgtgtggggtttcccttgaggttctggccacgaaggatcccctcttctccattaattgaggcgctgtgtgttgttgaatgcagtcaaggtgctgttgaatgccgtcacggtgctgtgacagtcacagtgttgttgaatgcagtcaaggtgctgttgaatgccgtcacggtgctgtgacagtcacagtgttgttgaatgcagtcaaggtgctgttgaatgccgtcacggtgctgtgacagtcacagtgttgttgaatgcagtcaaggtgctgttgaacgccgtcatggtgctgtgacagtcacagtgttgttgaatgcagtcacggtgtcgttgaacgccgtcacggtgcttgttgttgaatgcagtcaaggtgctgttgaacgccgtcacggtgctgtgacagtcacagtgttgttgaatgcagtcacggtgtcgttgaacgccgccatggacagccagaaccccgatgtgtcatccccgactcatttcctggctgttgctttgagtccagtggctcatctctggagtgaccccgctgaccacactcacagattgacatcaaagaccagaggtcagttctccatttgccatatggagaacaacttggcagacccgctgcctatgtgagctgatctggattctttccctgtaggccagctccac

SEQ ID NO: 470855 - DNA, 545 bp, Homo sapiens
cagtagacaataaagaagaaaatcaaactttttagccttgattaagtggttcgatggagagaagagtggtagcgtgctttcctcgttggctgataatcgattcttttcttggtctgagccttgcgactctgctgcataaccaagcagacagaagcacgaaggtgaccaaactgccatctgccgatttcctcaaggattttggtttttacgaatgtcctgggccgggagatggccagtatggacactatgcagttccatgttcgatgattttatgccatcttgggcttaaacagtctcggctgggaagaagcctggggaaggcagaggatgagcagcttgggactccccagcagcgagaatgttctgctttcttgactcggcgtagcaaccatgggcttgagggccagaaagacctgagtttgaatcgctcctctgagacgtgctgtggggccacggtgacccaggtgattcggatgtgtaagcagccgccagccatttgagttactttataactcgaatccaaattcatcaattaaaaacccagc

SEQ ID NO: 470856 - DNA, 766 bp, Homo sapiens
gtccttgctgcctctctcacaccctcctgtcctcctcttcctacaaacatgctcctgtctccatcccaccttgaagaaacccttggccgatacggcacccacccatggtcccaggataaccccttttcttccctaggctaataaaacagagaaagtaagtgcatcgggcactccagaccaaagccatttgcagaatggagtcacaggctgacatccaagactttagccagctggcttcaggcagcagatgcaaaggagaggtggcatcggggctccccagcactgaagggtgttcagcagcctgcaaaccaactgactcacagagcccagatagtgacgccaacaccagccgctccggggccaacatcagagctggagagctgagccatcaccgcacagctgtctctggagacaggagcacaaagctgccttctgcccagggcactgcttccttggcaagtgaccagcagctgggaccgcacgtgccaaaggcagcagctgccatgtttgacaaactggaacggagctatgtccaaattaaatccccccaaccagcctctgccatactccctttggggacaggggtggtcggtcgttacgcttgcaaaattccaacagcacctagagtcccaggaaatggggctgctggccaatagaggtgggacccagggtgacaggccacatgctccttagagagccaacagtgtttcctgaattccatgggagtttgccgaggggacatggaagctaggattccggaacaccc

SEQ ID NO: 470857 - DNA, 651 bp, Homo sapiens
ctgaacagacaatcaggaccaatatggttaagaccactgctttgggttggctgtgtccccacccaaatctcatcttgaattatagttgccataatccctatgtgtcgtggaggaaccaggtggagataattgactcatgggggcagtttccctcttcctgttctcatgatagtgagttcttgcaagatgtgatggttatatatggggtttcccccttcactcagcccttgttcttcttctcttccaccatgattccctttcctggtgcagcaaagatcctgtggatcagggagcactgcggatgttcatttaacatcatagagacagaaggaagcctaaccgtgagcttccaggatggtgtctgtggccccagcctgtcccttgagcactgagtcccagtcacgctaaaataactgacaccttttcctctctctcagagatcagggtcctgtgatacctgtgactcaatgtctggaagcaattattttatgtatattttttttttattgctatggcgggagggtcattctcctagcagttaattcttcatgggaaaactactggattcaccctctatcttggtcagaggtggggaggggtctagttcagaggcttctacttggtccatgcctctacaacagctctttccct

SEQ ID NO: 470858 - DNA, 1628 bp, Homo sapiens
ccccagagctgcccacgtgcggcaacacagtctggtgctgcaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtccccacccgccggccgcccccatggcccggctgggcgcgctgctcctggccgccgccctgggtgcactgctcatcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatcttgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtctctttattgattcaaaggttaaggaagctcctgggggcttgagggggtggcacagttttggtggggcccagtgaggacaaatctgggggtctcattagaggtttatcaattttattactcttttcaaagaactatcttttgtttatctggatattttctcttgatttatctccctcttcactaattctctctccagctgtgtctcatctactattcaacctatctactgagttcttaagttatcatatttttcagttctagaatttccatgtggccttcttatagttccaagattcctgccaaattttttttatcttgact

SEQ ID NO: 470859 - DNA, 1275 bp, Homo sapiens
acgtgaaggtagctatttcttttcctgtgtccactgatagagaaatagagactcagataaaggaacgcttgtccaccgcacgccgctgggaagcggtggagtgaacgtagacaagtccgtagatgacagaccccccaccactggcctgaaggtcggggtgcccagggcctaccctgacagcagcagcctgcacagctttaattacatcccacccctctgggcacagtgtggtcactggaaggtgcatggagttgggctggcaagcctggactcctccccgccggctgctgcctcaagcccgtggcacatagtaggtgctcactagttcccttgtgtacactcatgtccaccctctcccacactggccagaagggcagaggccccatttccatccagatcagccagctgagcagtcttgtgaagtctggggcgaaattcacggtctctgtcgagagaaccgtggcggggcagggagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacaggggccagcgctgcctggacaggatggtctgtaccacagtgcataggagcagaggtggtgttgggcacagggactcactaacagcagctgtggctgtggctgtgactgtggccccctgctcactctctcgaacactgccatctccaggggactcttgttgtggggcctgggtccaatggaggggtgggctctgcagcaacctgggatcagtgaaggaggggacatcttctatctatgggaaattcagaggagaccacaagtgcaccacagaaccgaagtcagagcttccagaaccttggcagttcctggaacctcaggacttagaccaagagcttgatattgccaggccctctttcctccaagtcgctcagctgtgcccacctctggtgtccttcatggccatggttgttgttcttcttcaacgccggacctaatcggggatcacgtgtgacctttaattgccatgagtcttgatacaccttaaatctagaactattccttattgtttctgtcctacctttcatggctttggcacttctgagagtccagccggctttgcagaatttccctcaatgtgggtttgtccagttatatcctcatgattaaactcatgttaagccttttgggaagcatatttgtag

SEQ ID NO: 470860 - DNA, 1268 bp, Homo sapiens
ggttttgttttcagtttacctaacaccgtgcttaggtttgaggcaggtcaaaatgcggatcttcgtgaaaacccttaccggcaagatcatcacccttgaagtggagcccagtgccactatcgaaaatgtcaaagccaaaatccaagataaagaaggcaatccctgtgaccagcagaggctcatctttgcaggcaagcagcgggaagatggccgcagtctttctgactacaacatccagaaagagtcgaccctgcatctggtcctgcgtcggagaggtggtatgcagatcttcgtgaagaccctgaccggcaagaccatcaccctggaagtggagcccagtgacaccatcgaaaatgtgaaggccaagatccaagataaagaaggcatcccccccgaccagcagaggctcatctttgcaggcaagcagctggaagatggccgcagtctttctgactacaacatccagaaagagtcgaccctgcatctggtcctgcgtctgagaggtggtatgcagatcttcgtgaagaccctgaccggcaagaccatcaccctggaagtggagcccagtgacaccatcgaaaatgtgaaggccaagatccaagataaagaaggcatccccccgatcagcagaggctcatctttgcaggcaagcagctggaagatggcgaaggagtcgaccctgcacctggtcctgcgtctgagaggtggtatgaagatcttcgtgaagaccctgactggaaagaccatcaccctggaggtggagcccagtgacaccatcgaaaatgtgaaagccaagatccaggatgaagaaggcatcccccccgatcagcagaggctcatctttgcaggcaagaagttggaagatggccgcactctttctgactacagcatccagaaagagtcgaccctgcacctggtcctgcgcctgaggggtggctgttaattcttcagtcttgcattagcagtgcccactgatggcattactctgcactatagccatttgccccaacttaggtttagaaattacaagtttcagtaatagctgaacctgttcaaaatgttaataaaggtttcgttgaatggtagcatacttggtgttttgtcatgatattctctagtgatgtgtgggtacacttaaaactggtgaaaatgtctagggagggatttaattttgagattggtaatgtgcccaaagttaagtcacttgactctggtatacacttgggtgggctgagggagatggagtctcaccgagcactgtggctcac

SEQ ID NO: 470861 - DNA, 6056 bp, Homo sapiens
ctgctaagagggtctgaatgtttgtccctcacataagattcctgagcactgctacgagggtctgaatgtttctgcttcacatagcatttccagaacaccaatgctgtgaacactcctgctgtggtatggatgtttgtgtctcacatgggattccagaacagtcatgctgtcatctgagtgtttgtccctcaaataggattccagagccctgctacgacggtctgtattattctccctcacataggattccagaacacggctacgaggaacaatgctacgagggtctgaatgcttgtcccacacgtaggattccggaacaccccagctgtgaagaatcctgctgtgatctgagtgtttctccttcaaataggattcctgaacactgctacgagggtctgaattattctccctcacataggattccagaacactcctgttatgaacactgctacgagcatctgatttattgtccctcacataggattccagaacactcctgctgtggtctgaatatttgtccctcacataggattccagaacactgctacgagggtctgtatgtttgtcccgcacggatccagaaaaatcccagctgtggtctggatgactgtccctcacataggattccagaacactgctgctggattctgagtgtttctccctcacataggattccagaacactgctgttggattctgagagtttttcccttacataagattccagaaaacagttatatgggtctatatgtttatccctcacagaggattccagagcactgctacgaaggtctgaatgtttgtccctcacataggattccagagcactgctacagggaacactgctgttgggatttgagtgtttgtccctcaagtatgattccagaaccctgctacgtgggtctaaatgtttgtccctcacataggattccagaacactgctacgagggtcctaatgtttgtcctgcacataggattccagaacactcctgctgtgttctgattgtgttttcctcacataggattccagaacaatgctacgagaatccagaaccatcctgctgttgtctgaatgtgtgtccctcacttaggtttccagaatactgctgttgggttctgagtgtttgtccctcacgtacgattccagaacactgctacgtgggcctaaatgtttgtccctcacatagggttccagaacactgctatgagggtctgaatatttgtcccacacttaggtttccagaacaccccagctatggtctgaatgattggccctcacataggattctggtacactgcttctgggttctgagagattctctctcacataggatttcaggtcactgctgctggggtctgaatgtttgtccctcacataggattccagaaaactgctacgaggttctgaattattctccctcacataggattccagaacactcctcctgtggtctgaatgtttgtcccttacttaggattccagaacagtgctgttgggttctgagtgtttgtccctcacgtactattccagaacactggattccagaacactgctgttgggttctgagtgtttgtccctcacatactattccagaacactggtacgtgggtctaaatgtttgtccctctcataggataccagaacactactacgagtgtctgaatgtttgttcctcacataggattccagaacactcctgctgtggtctcaatgtttgtccctcacttaggattccagaacactcttgctgtggtctgaatgtttgtccctcactgaggattccagaacactgctgttgggttctgagtatttgtccctcacgtagggatccagaacagtgctacatgggtctaagtgtttctcccagatatgggattccagaacactgctacgagagtttaaatgtttgtccctcacataggattccagaacactgctacgagggactgaatgattgtacctcacataggataccagaacactcctgctctcgtctgaatgtttgtccttctaataggattccagaacactgctgctactttctgagtgtttatccctcacataggatgccagaacactgctgctggggtctgagattttgtctctcacataacattccagaactctgctgctgggttctgagtgtttgtccctatcatacgattccagaacactgttgcgaggttctgaatgtttgtccctcacataggattccaggacactactgctgtgaacactgctacgagagtctcaatgtttgtccctcacgtaagattccagaacactgctacgaggatctgaatgtttgtctcacacgtaggattccagaacaccctagctgtggtctgaatgattgccccacacaaagcattctacaacagtgtcactgggttctgagtgttgtccctcaaatagaattcagaacactgctacgagggactccagaacactgctacgagggtctgaatgttggtccctcacataggattccagaacactgctacaagcgtctaaattattctccctcacataggataccagaactcacatgctggagtctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggattccagaacactgctacaagggtctgaatgtttgtcccgtacataggactccagaacacacctgctgtgttctgaatgtgattccagaaccctgctgctgggttctgatggcttctccctcacataggattccagaaaactgctgcgaatgtctgaatgattgtaaatcacaaaggattccgattccggaacactgctgctgggttcttagtgtttttccttcatataggattccagaacacagctacgaggaacaatggtacgaggttctgaatgcttgttctacacgtaggattccagaacaccccagctttggtctgaatgattgtccctcacattggattccagaacactgctgggttcgcagtgtttgtctctcacataggattcgagaacagtgctacgaggaacagtgctgctgtggtctgaatgtttgtccctcgcataggattccagaacactgctacgaagatttgaatgtttgtctttcacataggattttagaacactgcagcagggttctgaatatttgtccttcacataggattccagatcactactgctgtggtctgaatgtttgtcctttacataggatttcacaacactgctacgagggtctgaatgtttgtcccttaaataggataccagaaaactcctgctgtgctgtgaatgtttattcctcacataggattccagaacactgctgctttggtctgaaaggttgtccctcacagaggattccaaaactctggattccaaaacagtcctgctgtcttctgagtgtttgtccctcaaatggggttcgagaacactgctatgagggtctgaattattctccctcacataggattccagaacacggctatgagggtctgaatgtttgtccctcacatatgattcctgaatactcctgctgtgaacactgctacgagtgtcctaatgtttgttcctcacataggattacagaacactgctgctgggttctgtgtatttctcactcacataggattccagaacactgctacgagggtctgaatatttgttcctcacataatattccagaacactgccaagagagtctgaatgtttatccctcagataagattacagaacaatgctacgaggctcagaatgtttgctcttcacatcggattccagaacactactgcagtgaacaatgctacgagggtctgaatggttgtcccacacttaggattccagaacaccccagctgtggtctgaataattgtccctcacataggattccagaacactgctgctgggttctgagtgtttgtccctcacataggattccagaacactgttacgatggtctgaatgtttgtccctcaaataggattccagaacactgctatgagggtataaattattctccctcacataggattccagaacactcctgctgttgtctgaatatttgttccccactaagtattcaagagcactcctgctgcagtctgagtgtttgtccctcacttaggattccagaacactactgttgggttctgagtgtttgtccctcaggtacaattccacaacactgccacgtgggtctatatgtttgtctgttacgtaggattccagaacagtgctacgagggtctgaatgtttttctcgcacataggactccagaacactcttgctgtgttctgaatgtattttcctatgataggattccagaagaatgttatgagtgtctgaatgcttgtcgcacatgtaggattccagaaaaccccagctgtggtctgaatgattgtccctcacataggattccagaacactgctgctgggttttcagagtttgtccctaccatagcattccagaacactgcgacgagggtctaaatatttgtcattcacatagaattccagaacactgctactgggttctgagtgtttgtccctcacaaaggattcctgaacaatgctgctgtgaacaatgctaccagggtctgaatgtttttcccacacttaggattccagaacacctcagctgtgttctgaatgattgtccctcccataggattccagaacactgctgctgggttctgagtgtttctccctcacatacgattccagaacactgctacgaggaacaatgctacgagggtctgaatgtttgtcccacaaataggattccagaacacaccagctgtgggctgaatgattgtccctcacatgggattccagaacaatgctactgggttctaaatgtttgtccctcatgtaggattcctgaacactactgctggggtctgaatatttgtccctcatctaggattccagaagactactgctgtggattccagaacacccctgctcttgtctgggtgtttgtccctaaaataggattccagaacactgctgctgcgattccagaacactgctgctggtttttgagtgtttctccctcacgtaggattccagtacactgctacgagtgtctcaatgattgtacttcacagaggattaaagaacactcctgctctggtctgaatgtttgtccctcagataggattccagaacactgctgcaaggttctgagtgtttgtccctcacatgagattccagaacactgatgctgtggtctcaatgtttgctcctcaccgaagtttccagaataagcctgctgttgtcttaatgtttgttcctcaaataggattacagaacactactgctgtggtctgaaaagttgaccgtcatataggattccagaacactagtgctgtggt

SEQ ID NO: 470862 - DNA, 2178 bp, Homo sapiens
gattggaatggaatggaatgcaatggaatgggatggaatcaactggaaaggaatgaaatggaatggaatggaatggaatggaaacaacccgagtggaatgcaattgaatggaatggaatggaatggaatgaaatcaactcgagtggaatggattggaatggagtggaatggaatggaacggcatggaatgcaatggaatcaactacaatggaatggaatggaatggattggaatggaatcgaacggaatcaacctgagtggaatggaatggaatggaaagaatggaatggaatggaatggaaactaaaggaatggaatggaaaggaaacaacccgagtggaatggaatgcaatggaatgcaatggaatggaatggaatggaatggaaaggaaacaatccgagtggaatggaatgcaatggaatggaatggaatggaatggaatggaattcttggaatcgaatggaatggaatggaataaatacgagtggaatggaatggaatggaatggtatagaatggaatggaatcaactcgagtggaaaggaatgtaatggaaaggaatggaatggaatggaatggaatggaatgcaatggaatgcacgggtatggaatggagtcaatgcgagtggaatggaatggaatggaattgaatgccatggaatggaatggaatataatggaatggatagaatggaacggaatggaatggaatggaatggaatcaacccgagtggaatggaatggaatggaatggaataaacacgaatggagtggaatggaatggaatggaatggaatggaatggaatcaactcgagtggaatgaaatgtaacgtcatggaatggaatggaatggaatggaaaggaatggaatggaatggaatagaatggaatcaattcgagtgcaatgaatgcaatggaatggaatggaatcaactggaaaggaatggaatggaatggaatggaatggaatggaatggaatggaaggcattagaatcaactggaatggaagggaaagaaatgaaatggaatggaatggaatggaatggaatggaattgaatcaaccccagtggaatggagtggaatggaatggattataatggaatggaaaggaatcaatccgggtggaatggaatggaatggaatggagtggaatggaatggaatggaatggaatggaacggaatggaatggaatcaccccaatggaagggaacggaatggaatggaaaggaatggaaaggaatggaaaggaatggaatgcaatggaatcaacccgaatggactggaatggaatggaatggaatggaatggaatggaatggaatcaactcaagaatggaatggaatcaacatgactggcatggaagggaatggaaaggaatggaatggaatggaatggaatggaatagaatggaatggtatggaatcagcccaagtagaatggaatggaatggaatggaatggaatggaatggaatggaacggaacgaaaaaatggaatggaatggaatggcatggaatgtaacggcatggaatgcaatggaatggagtggaatcaacccgagtggaatggaatggaatggacttggaatggaatggaatggaaaggaatggaatggaatcaacccgagtggaatggactggaatgtaatggaatggaatcaaccagagtggaaaggaatggaatggaaagcaatagaatggaatggaagggaatggaatgcaacggaatgcaatggtatggaatggagtcaacacgagtggaatggaatggaatggaatcgaatgcaatggaatggaatggaatgcaatggaatggaaatggaatggaatggaatgaaatcaaccggattggaatggaatggaatgcaacggaatggaatggaataaactggaaaggaatcaaatggaacggaatggaatggaatggaatggaatggaatagaatggaatggaatcaactcgaggggaaaaatggaatggaatggaatgaaatcaacccgattggaatggaatggaatgcaatggaaggtaatggaatcaacaggaaacgaatgaagtggagtggaatggaatggaatggaatggaatggaatggaatggaattaaccgagtagaatgctatggaatggaatgaaatggaatggaatgaaatcaaccctaatggaatggattggaat

SEQ ID NO: 470863 - DNA, 1002 bp, Homo sapiens
acttatgttcaatgtgaatgccatggcaatattaaaaggtaagaattcgctccatacgtgcttgagaggtggagcctacagaggcaggcaggcctcctggagctgttgtgggctccacccagttccagctgcctggctgctttgtttacctaagaaagcctgggcaatggcgggccccactcccccagcctcactgccgccttgcagtttaatctcagagtgctgtcctagcaatcagcaagactccattggcataagaccctctgagccaggtgcgggacacaatctcctggtgtgccgttttccaagcctgttggaaaagtacagtattagggtgagagtgaccctattttccaggtgtcatctgtcacccctttctttgactaggaaagggaactccctgaccccttgtgcttcccgaggcaatgcctcgccctgcttcggctcccacacagtgcgctgcacccactgtttttcactcccttagtgagatgaacccggtacctcagatggaaatgcagaaatcacccatcttctgtgtcgctcatgctgggagctgtagaccagagctgttcctattcagccatcttggctccacccctcatttcattatttcatcatttaatcatttcacttcatttcatcatttcatttcatcatttcacaccatttcttcatttcatcatttcatcttttcatttcatttcatcatttcatttcatttcaccatttcacttcatcatttcatttcagcatttcatttcatttcatttcatttcaccatttcatttcatcatttcatttcatcattccatttcatcatttcatcatttcatcgtttcatttcaccatttcatctcatcatttcatttcatcattttatcatttcatttcatttcttcatttcatcatttcgtttcatcatttcatcatttcatttcatgtcatcatttcatcatttcatttcatttcagtgatacatgtatttaagtgctaatgtga

SEQ ID NO: 470864 - DNA, 1546 bp, Homo sapiens
tgctctcagctgcctgcagcacatctccagtcaacaagtcaccatgcgacctgaactgcctatcccgaactgggtgctttctgactcatgtagccataaagtgggtcatgcacagcagcattccatcatcaaatggaaatggtgtataagtgattgggctcaagcaggtcctggggggcacaatggtcaaaaactgaagatatttgtaccctgtgtgagtgttgaccaacaagtgacttcagcagaggaggattttgataatcaagtggataagatgacccgttctgtggataccactcagcctctttcctcagacacccctgtcattcaaggtggacttccactcaccaaggctgaactgtctgtggccactgctgagtgcccaatttgccagcagcagcagcagagactaacagtgaaccctttgtatggcatcatttcctggggtgatcgaccagctacccgctggattgatagaatggtgggacggccttttgaggtcgcgattacaacgtcaactaggttacaatactttgccgggccggggcaccatactccagaaggccatgtgtgctctgaatcagcgcccaatgtatggtattgtttctcccatagccaggattcacagatccaggattcaaggggtggatgtgaaagtggaaccactcactatgatgcactggcaaaatgtttgctttctgttcccatgacattaggttctgctttactagtcatcttagctccagagggaagaacgctgctaccaggagacacaataacgattccattaaactggaagttaagatggccacttggacgctttggggtcctcctacctttaagtcaacaagctaagaatggagttacagtgttggcggcagtgattgacccagactatcaagatgaagtcagtccgctactccacaacggaagtgaggaagagtatgcgtggaatataggagatccattagggcgtctcttggtattatcatgcactctgattaaggtaaatgggaaactatacccaatccaggtaggactacaaatggtccagatcctctccgggtcacgacctgctgaggtgcttgctgaaggcaaagggaatacagaataaatagtggaagaaagtagttatcaataccagctacgaccacctgaccagctgcagaaatgaggactggaactatcatgagtatttccttcttcttttgttaaaaacatgtttgtgcatgtatgcacttgtactaagaaaatatcttcatttcatttcccttttctttatcaggtgacatagatttgctgacctcatatcagcatttaagtattgtttactttatgtaagagtatttgggttggggatgggtgcatttccagttgtaggaaggatagtttattatgttaggggtaattatgaccttactattgtctgtattttaagattatgtatgatctcaggagatgtgtgtgggttcaagttcacaaggggtgggcttgtgatggttaataatgagtgtcaacttgattggattgaaggatgtaaagtatt

SEQ ID NO: 470865 - DNA, 1502 bp, Homo sapiens
cggccataggtagatatctggccacaggtggatagccagtcccaggtggacatcaggctccaggatgacatcaattggagcaggtgctgacagcgaggagaacccagacagtgggggcaggcacttccgagcctgtgtggtcacggaggccttcccaggccccaagagtgcagaggtgcctggagcacaggagtgcctgggtcgcagaccctccttgggcagctgcagttgcgcctggggagttcctgccctggcaacttggaaggggctgggctcccacttgtccccagctgccactggctccatagagtgtgcagccttggccgtgactcctcgctgcgttttccctgcagtagtgcatgggcgaggtgcaggtggcatgggggccctggctaatgccgcacaaatgaacctgatgctcctggggccaatcctgcaagacccggctgccagcgctgatgggctcccagatgtggtaggaagcgaaattgaggccgccatggagggtctgcacctggcagtgggtcctgcccagccattagggggcggcggcgcagtcagatgccttggggacacagggaacggggtcctaccaccgccactgctgctcctgctgctgctcctgacaacactgcccatgcggcccaagcgctactggcatgatggcaactgccactccagatggccagccgctcccatcaatagtgtccatatctgagaagaaaagtcaggaaataaattattggtcaataaaaataatagcaataatattccatgttaaattgactgatcaacagtgtttgcttttgtttaggattttgttttttgcttcatatttattaaacacattttattttattgagaacaaaatgttagatttttggaaattcagttagaactttttaatttttatgactgcattgtgaattataggcattttaagcttattttaattgtattttccaaatgcgaattggacaaatatttaaaattgttgtattctcaacacaaaaattgtatgtaaggcaatgcatatgttcattagctagatttaatcattccacaatatatatactttaaaacatcatattgtacacaatatgtacaatagtatctacaaattaaaaatgaaaataataataaattatgtcttaggcaaatattcacagatattggaaataatatttatgcatctcattgactcaatttatactaaaaggcaaatagccgtcttccttaataatagttgtagtattttcatagccatctctgtttatctctgcagtttactgtggagcaaattttcatacttctcttcaacactcagaggaatacttcaaagaaaaattaagatatgaaggttggttgaaggttttattgggtaaactgggttctttgtggatagacgtcatagcacacaaccgtgtagcaacttatactcaagtaccattcagatatctcctcctcacagaacgccttctgctccctcgatccctttcttt

SEQ ID NO: 470866 - DNA, 726 bp, Homo sapiens
tggaatcaacatcaaacggaatcaaacggaattatcaaatggaatcgaagagaatcatcgaatggactcgaatggaatcatctaatgaaatagaatggaataatccatggactcgaatgcaatcatcatcaaatggaatagacggaatcatcatccaatggaagctaatggaatcaaaatcgtatggaatcgaatggaaacaccatcgaattgaaacgaatggaattatcatgaaattgaaatggatggactcatcatcgaatggattcgaatggaatcatcgaatgaaattgattgaaatcatcatcaaatggaatcgaatggcatcattgaatggaatcgaatggaatcatcatcagatggaaatgaatggaatcatcactgaatggaatcgaatggattcattgaatggaatcagatgggatcatcgaatggacttgaatggaatcattgaatggactcgaaaggaatcattattgaatggaattgaatggaatcatcgaatggtctcgaatggaatcattatcaaatggaatcgaatggaatcaccgaatagaatcgaatggaacaatcatcgaatggactcaaatggaattatcctcaaatggaatcgaagggaattatctaatgcaatcgaatagaattatcgaatgcaatcgaatagaatcatcgagtggactcgaatggaatcatcgagtggaatggaatggaatagtcaatgaactc

SEQ ID NO: 470867 - DNA, 1724 bp, Homo sapiens
tggaatcaacatcaaacggaatcaaacggaattatcgaatggaatcgaagagaatcatcgaatggactcgaatggaatcatctaatgaaatagaatggaataatccatggactagaatgcaatcatcctcaaatggaatcgaatggaatcgtcgaatggactcgaatggaataaatattgaacggaatcgaatggaatcatcatcggatggaaacgaatggaatcattatcgaatggaatcgaatggaatcatgaaatggaatcagatggaatcatcatcaaatggaatcaaatacaattatggaatgaaatccaatatggaaacgaatggaatcatcatcgaatggaatcgaatggaatcattgaatggaatcgaatggaatcatcttcagatggaaatgaatggaatcatcaaacaatggattcgaatggattcattgaatggaatcagaaggaatcatcgaatggacttgaatggaatcattgaatggactcgaatggaatcattattgaatggaatagaaagtaatcatcgaatggtctcgaatggaatcattatcaattggaatcgaatggaatcaccgaatagaatcgaatggaacaatcatcaaatggactcaaatggaattattctcaaatggaatcaaatggaattatcgaatggaccgaatggaattatcgaatgcaatcaaatagaatcatcgaatggactcgaatggaatcatcgaatggaatggaatggaatagtcaatgaactcgaatggaatcatcattgaatggaatagaatggaatcatcgagtggaatcaaatggaatcatcatcaaatggaatcgaatgtaatcatcatcaaatggaatcaaaaataaacatcgtcaattggtattgaatggaattgtcatcaaatggaattcaaaggaatcatcatcaaatggaaccgaatggaatcctcattgaatggaaatgaaaggagtcatcatctaatggaatcgcatggaatcatcatcaaatggaatcgaatggaatcattgaacggaattgaatggaatcgtcatcgaatgaattgaatgcaatcatcgaatggtctggaatggaatcatcttcaaatggaaaggaatggaatcatcgcatagaatcgaatggaattatcattgaatggattcaaatcgaataaacatcaaacggaatcaaacggaattatcgaatggaatcgaagagcatcatcgaatggccacgaatggaatcatctaatggaatggaatggaattatccatggacacgaatgcaatcatcatcgaatagaacccaatggaatcatcaaatgaactcgaatggaataatcattgaacgggatcgaatggaatcatcgccgaacggaaacgaatggaaacatcatcgaatggaaatgaaaggagtcatcatctattggaatcgcatggaatcatcatcaaatggaatcgaatggaatcatcatcgaatggaatctaatggaatcattgaagggaattgaaaggaatcgtcatcgaatggattgaatgcaatcatcgaatggtctcgaatggaataatctccaaatggaatggaaaggaatcatcgtatagattcgaatggaattatcatcgaaaggactcagatggaatcaacatcaaacggaatcaaacggagttatcgaatggaatcgaagagaatcatcgaatggactcgaatggaatcatctaatgaaata

SEQ ID NO: 470868 - DNA, 3393 bp, Homo sapiens
acccgactggaatggaatggaatgcaatggaatggaatggaatcaactggaaaggaatcaaagggaacggaatggaatggaatggaaaggaatggaatggaaaggaaacgaatggaatgcaatggaatgcaatggtatggaatggagtcaacccgagtggaatggaatggaatggaatggaatgaaatggaatgtaatggaatgaaatgtaatgtaatggaatggaatggaatggaatggaatggaatggaatggaatggaatggaatgcaatggaatggagtggaatggaataaacaccagtggaatggaatgcaatggaatggaggggaatggaaagaaatggaatggaatggaatggaatggattggaatggagaggaatggaatggaatggaacggaatggattggaatcgaatggaatgggctagaatggaatggaatggaattaaatcaacccgattggaatggaatggaatgcaatggaatggaagggaatcaacaggaaaggaacgaaatggaatggaatggaatggaatggaatggaatggaatggaatggaatggaatccacccgagtggaatgcaatggaatggaatggaatggaatggaatcaacccgggtggaatggattggaatggaaatggaatggaatggaatcgaacggaatcaacctgagtggaatggaatggaatggaatgaatggaatggaatggaacggatactaatggaatggaatggaaaggaaacaacccgagtggaatggaatgcaatggaatgcaatggagaggagtggaatggaatggaatggaatggaatggaatggaatggaattcaatgtaatggaaacaaaccgagtggaattggaaaggaatggaatggaaaggaatggaatggaaaggaaagaatggaatgcaatagaatgcaatggtatggaatggaggcaacccgagtggaatggaatgacatggaatggaatgaaatggaatggaatggaatggaatggaatggaatggaatggaatggaatggaatctacccaattggaatggaatggaatggaatggaatagaatggaatggaatggaatggcattggaaaggaatggaatggaaaggaatggaatggaaaggaaagaatggaatgcaatagaatgcaatggtatggaatggagtcaacccgagtggaatggaatggaatggaatggaatgaaatggaatggaatggaatgcaatggaatggagtggaatggaataaacagcagtggaatggaagggaatggaagggaatggaatggacaggaatggaatggaatgaaatggaatggaatggagtgcaatggaataatcaacaaaggaatggaatgcaatggaagagagtggaatggaataaacaccagtggaatggaatggaatggaatggaatggaatggaatggaatgcaacggaatggagtggaatggaatggaagggaatggaatggaatggacaggaatggaatggaatggaatgaaatcaagcagattggaatggaatggaatcaactggaaaggaatgaaatggaatggaatggaatgcaatggattggaatggaatggaatcaacgcgagtggaatgcaatggaatggcatggaatggaatggaatcaacccgagtggaatggattggaatcgagaatggaatggaatgcaatggaatggaatggaatcaactggaaaggaatcaaagggaacggaatggaatggaatggaatggaatggaatggaatggaatggaaaggaatggaatggaatgaaatggaatggaatagactggaatacaatcaactcgattggaaaggaatgtaatggaaaggaatggaatggaaaggaaaggaatggaatgcaatggtatggaatggagtcaacccgagtggaatggaatgcaataatggaatggaatgaaattgaatggaatggaatacaatggaatggagtggaatggaataaacaccagtggaatggaatgcaatggaatgcagtggaatggaaagaaatggaatggaatggaatagaatggaatggaatggaattaaatcaacccgattggaatggaatggaatgcaatggaatggaatggcatcaactgcaaaggaacgaaatggaatggaatggaatgaatggaatggaatggaatggaatccaccctagtcgaatgcaatggaacgggaaagaatggaatggaatcaaccagggtggaatggattggaatggagtagaagggaatggaacagcatgcaatgcaatggaatcaagtagaatggattggaatggaatcgaacggaatcaacctgagtggaatggaatggaatggaatgaatggaatggaatggaacggatactaatggaatggaatggaaaggaaacaacccgagtggaatggaatgcaatggaatgcaatggaatggaatggaatggaatggaatggaatggaatggaatggaatggaattcaatgtaatggaaacaaaccgagaatggaatggaatggaatggaatggaatcaacccgagtggagtggaatggaatggaatggaaatgaatggaatggaatggaatggaaaagaatggaatggaatggaatggaacggaacggaatggaaagaacccgagtggaatggaatggaatggaatggaatggaatggaacggaatggaatctacccaattggaatggaatggaatggaatggaacggaatggaatgtacccaattggaatggaatggaatggaatggaatggaatggaatggcatgtaataaacacgattggaatggaatggaatggaatggaatagaatggaatggaatggaaaggaatggaatagaatgtaatggaatcaactcgagtggaaaggaatggaatggaaaggaatggaatggaacggacagaatggaatgcaatagaatggaatggtatggaatggagtcaacccgagtggaatggaatggaatggaatggaatgaaatggaatggaatggaatgcaatggaaaggagtggaatggaataaacagcagtggaatggaatggaatggaagggaatggaatggaaaggaatggaatggaatggaatggaatggaatgcaatggaaaggagtggaatggaataaacagcagtggaatggaatggaatggaagggaatggaatggaaaggaatggaatggaatggaatggaatggattggaatggaatggaatagaatggaaaggactagaatggaatggaatggaatgaaatcaacccgattggaatggaatggaatgcaatggaattgaatggaataaactggaaaggaatcaaagggaatggaatggaatggaatggaatggaatggaatagaatggaatagtatcaactc

SEQ ID NO: 470869 - DNA, 2478 bp, Homo sapiens
tggaatgatatggaatcaaatagaatggaatggaatgggatggattggaatggaatcgaacggaatcaacctgagtggaatggaatggaatggaatggaatggaatggaatgaatggaaaggaatggaatggaaactaatggaatggaatggaaaggaaacaacccgagtggaacggaatggaatggaatggaaaggaaacaacccgagtggaacggaatggaatggaatgcaatggaatggaattgaattcaatgtagtggaaacaaaccgagtggaatgtaatgtaatggaaaggactggaatggaatggaatggattggaatcaacccgattgcaatgcaatggaatggaatggaatggattggaatggaacggaatggaatggaatggaacggattggaatggaatggaacggaatggaatggaatggaagggaatggaatggaatggaaaggaatggaatgaactggaatggaatggaatgcaatttaatggaatggaatggaatggaatcaacccgagtggagtggaatggaatggaatggaaatgaatggaatggaatggaaactaatggaatggaatgcaaacaacccgagtggaatggaatgcaatggaatggaatggaatggaatggaatggaatggaattcaacagaatggaaacaccccgagtgaaatgtcatggaatggaaaggacttgaatgtaatggaatggattggagtcaacccgattagaaagcaatggaatggaatggaatggaatggaatggaagggaatggaatggaatgtaatggaatggaatggaaaggaatggaatggaatggaagggattggaatggaatggaatggattagaatggaatggaatggaatgaaatcaacccgattggaatggaatggaatgcaatcggaatggaatggaaatgaatggaatggaatggaatggaatggaatggaatggaatggaatggaatggaacggaatgcaatgcaatggaacagaaaggaatgaacccgagtggaatggaatggaatggaatagaatggaatggaaaggaacggaacagaatggaatggaatggaatggaatgaacacgagtggaatggaaaggaatggaatggattggaatataatggaatggaatcaacccgagtggaatagaatggaatggaatggaatggaatggaatggaatgggacggaatggaatggaatggcatggaatagaatggaacggaacggaaagaaacggaatggaatggaatggaatgcaatggattggaatcaaacaaatggaatggaatggaatggaatggaatggaatggaatggaatagaatggaatcaattcgagtgcaatgtaatggtatagaatggaatggaatggaatggaatggaatcaaccagagtacaatgcaatggaaagaaattgaaatgaatcgaatggaatggaatggaatggaatggaacggcatggaatggaatggaatggagtggaatcaacccgagtggaatggaatggaatggaatctaacggcatggaatggaatggaatggactgaaatcaacccgagtggaatggaatggaatggaatggactggaatgcaatggaatggaaaggaatcaacccgagtagaatgaaatggaatggaatggagtggaaaggaatacaatggaatggaatagaatggaatggaatggaacggaatggaatggaaaggaatggaatcaacatgagtggaatggaatggaatggattggaatggaataaacacgagtggaatggaatggaatggaatggaatggaatggaatggaatcgagtggaatggaatcaactcgagtggaaaagaaagggatggaaagcaatggaatggaaaggaaagtaatggaatgcactggaatgaaatgagtggagtggaaaagaatgaaatggaatggaatggaatgcaatggaatggagtggaatggaataaacaccagtggaatggaatggaatggaatggaatggaatggaatggaatggaatggaatggaatggcatggaaaggaatggaatggacaggattgaaatggaatggaatggaacggaatgctatggaatggaatggaatcaactggaaaggaatgaagtggaatggaatggaatggaatggaatggaattgaatggaatggaatggaatcaacacgagtggaatgcaatgcaatggaatggaatggaatgtaataaaatcaacccgagtggaatgcataggaatagagtggaatggaaaggacaggcatggaatgcaatggaatcaactagaatggaatggaatggaatggagaggaatggaatggaatggaatggaatggaatggaatggaatggaatggagtggaatggactagaatggaatggaattgaatgaaatcaacccgattggaatggaatggaatgcaatggaatggaatggaatcacctggaaatgaatcaaa

SEQ ID NO: 470870 - DNA, 1202 bp, Homo sapiens
atcatcacctaatggaatgaaatggaatcatcgaatggaatcttcattgaatggactctaatggaatcatcaaatggactcaaatggaaccatcgaatggactcgaatgtaatcatcattgaatggtatcgaatggaatcattgaatggactcaaatggaataatcatcaaatggaatcgaatggaatcatcatcagatggaaacgaatggaatcatcatcgaatggaatcgaatggaattatcaaatggaatcagatggaatcatcatcaaatggaataaaatagaatcatcaaatgaaatcgaatggaatcatcatcaaactgacttgagcagaatcatcatcgaatggaataaaatagaatcattgaatggactccaatggagtcatcatcgaaatcatcatcgaatggaaacgaacagaatcatcaaagggactcgaatggaattatctggaatcatcatcaaatggaatccgatggaatcatcgaatggaatcgagtggaatcatcatcgactggaattgaatggaacaattgaatggactcgagtggaatcattggagaatggaaatcatcgaatgaaatcgaatggattcatcatcgaatggaatcaaatggaattatcattgaatgcaattgaatggaatcattatcgaatggaatcgaatggaatcatcaacaaatggaatccaatggattcatcatcaaatagaaaaaatggaatatcaaaaggactcgaatggaatcatcgaatgcactcgaatggaatcatcaccaaatggagtcaaatggaatcattgaaaggaatcaaatggaatcatcatcgaatgaaatcaaatggaatcatcgaatggactcgaatggaaacatcaccagatgcaattgaaaggaatcatggaatgcacttgaaaggaatcatcaaatatactcatatggaaccaacattgagtggaatcgaaagaaatcttcgaatggaattgaattgaatcaccgaatggactcaaatggaatcatcattgaatggaatcgaatggaatcatcatctaatggaatcgagtggaatcatcaatgaatggaatcgaatggagtcaccaaatgcaatccgttggaatcatcatcgaatggaaccaaatgcagtcatcatctaatggaatcaaatggaatcgtcgaatggactcaaatggaatcatcgtatggacac

SEQ ID NO: 470871 - DNA, 840 bp, Homo sapiens
tggaatcaacgagagtggaacggaatagaatggaatggattggaatggaatggaaggcagtggaaacagcaggaacggaatttaatgaaatggaatggaatggaatggaacggaataaacctgagtggaatggaacggaatggaatgcaatggaatggaatggaatggaatcaaccccagtggaatggaatggaatggaatggaatggaatggaatggaatggaatggaatggaacggaatggaatgcaatggaatcaactggaatggaatggaatggaatggaatggaatggaatcaacgagagtggaacggaatggaatggaatggattggaatggaatggaaggcagtggaaacagcaggaacggaatttaatgaaatggaatggaatggaatggaacggaatcaacttgagtggaatggaatggaatggaatgcaatggaatggaatggaatggaatcaaccctagtggaatggaatggaatggaatggaatggaatggaatggaacggaatggaatgcaatggaatcaactggaatggaatggaatggaatggaatggaatggaacggaatggaatcaacctgagtggaatggaatggaatggaatggaatggaatggaacggagtggaattcaacggaatggaaacaacccgagtgaaatggcatggaatggatcggacttgaatgtaatggaaaggagtggaatcaacctcattagaaagcaatggaacggaatggaatggaatggaatggaatggaacggaatggaatggaatggaatggaatggaatggaagggaatggaatgcaatggaatggaaaggaatggaatggaa

SEQ ID NO: 470872 - DNA, 680 bp, Homo sapiens
tcatcatcgaatggactccagtggaatcatcatcaaatggaatccgatggaatcatcgaatggaatcgagtggaatcatcatcgactggaattgaatggaacaattgaatggactcgagtggaatcattggagaatggaaatcatcgaatgaaatcgaatggattcatcatcgaatggaatcaaatggaattatcattgaatgcaattgaatggaatcattatcgaatggaatcgaatggaatcatcaacaaatggaatccaatggattcatcatcaaatagaaaaatggaatatcaaaaggactcgaatggaatcatcgaatgcactcgaatggaatcatcaccaaatggagaatcatggaatgcacttgaaagtaatcatcgaatatactcatatggaaccaacattgagtggaatcgaaagaaatcttcgaatggaattgaattgaatcaccgaatggactcaaatggaatcatcattgaatggaatcgaatggaatcatcatctaatggaatcgagtggaatcatcaatgaatggaatcgaatggagtcaccaaatgcaatccgttggaatcatcatcgaatggaaccaaatgcagtcatcatctaatggaatcaaatggaatcgtcgaatggactcaaatggaatcatcgtatggacacgaatgcaatcatcatc

SEQ ID NO: 470873 - DNA, 2351 bp, Homo sapiens
aagacacatggaagaagtcatgcaaggccacacggatttaggcctgtcagagcagccctggtggaccgtagaggaagattcctgagggcctgtttgcttgagggctagagggctccctgggaagcagtcatcctgaggaaagagagttgaagcgcataagagcatttcaaggacagggcgaggagaaaagagggatttggggtagagcctcctcggtgttcacaggagcactgtggaaagcagtggacgatttcaggaagatgccagaacaagcatcatcacagttaatcagtgtgcccaagccaggaaagccctggacaagctgggaggggctgatcaccctacttcgtgatgagcccatagcagaggccctgactgggctgcaggcagatgtggaaatcctggagtggatctgcaggcagaagacgaagcctttatacaagtaccagccttcctggggcaccagtggcctggcgggaaggaggcactgccctcacatagctcctaaaacagctgagtcagtgaggggttctgtgggggaagtgggggaggtttgcctgagatacattcaggagcgcctggctgacaaggtagggggagaaccctgcaggctggggcctgggctggggccagcaggggaggagacctgctggcagagcctggctgaagccaccgtctcagaggctgtggagtctcagttacaatgtcagttccgccaggcctctgaaggcagacacaggacctcctccttgccttctctttctcccccacttccaggcagtctagagcccggtggagtctcctgtcaggacacctccagaatgcttccagtcctttccctgaccactgcccgctcggcacaggccctgtgcaatatcctaaactgctgagctcctgacacccttcctgccagcctcatcccccgccctcttcccgtcatgtgccaagccccagccactgtgcagccctgctttttccagaggtgcaggctgcaggcctctcgccttcgaatctttgcataagtgggatcctcttcctgaatgcccactcaccttcttgacttggctaacttctactcaacttagaagatttattacagatttcagaggatgtatggaaatgcctcgatgtccatgcaaaaatttgtaagggcagggccctcatggagaacctctgctagggcagtgcagagggaaatgtggagtcagagcccccacacagagtccctactggggcactgcatagtggagctgtgagaaaagagttaccatcctccagaccccagaatgatagatccactgacagctttcacagtgcacctggaaaagccacagacactcaacaccagcccgtgaaagcagacaggaggggggctataccctgcaaagccacaggagcagaactgcccaagaccataggaacccacctcttgcatcagtgtgacccagatgtgagacatggagtcaaaggagatcattttggagctttgagatttgactgccctgttggatttcagacttctatgggggcctgtagcccctttgttttagacaatttctttcatgtggagtggctgtatttacccaatacctgtacccccattgtatctaggaagtaactaacttgcttttgattttacaggcttataggtggaagggacttttctccaatgaactttggatggtgggcttctgagttaatgctgaaatgagttaagactttgggggactgttgggaaggcatgattggttttgaaatgtgaggatgcaagatttgggaatggcctggggcagaatgatatggtttggctctgtccccacccaaatctcatattgaattcccgtgtgttgtgggagggacccagtcagaggtacctgaatcatggcggcaagcctttcccatgctgttctcatgatagtgaataagtctcatgagatctgatggttttaaaaagaggaattcccctgcacaagctccctctctttgcctgccaccatccacgtaacttgtgacttgctcctcctcgccttctgccatgattctgaggctttcccagccatgtggaactgtaagtccaattaaacctctttcttttgtaaactgcccagtttttatctttatcagcagcatgaatacaaatacagttagcttctagaggttttctaatttttgcattgtacatttagctgtatgatccattttcagttagtatttgtaggagcaagatttgtgtgtagattccttttttttttttttttttttttttgcatgtgcacatccagttgttccagcatcatttgttgaacaggctctcccttctccattgaattgctttgttcctttggtgtggg

SEQ ID NO: 470874 - DNA, 951 bp, Homo sapiens
gccttggaggccgtatctcaccaaccggcaggaggaagcaagtgatgaagaagaggttgaaagctcttagtgctgccaaagcagaggggttgtagggaggagactcagaagagatgcagggtgtgggccactgtcactcacccactgagggcatcctctgtcggccacatcaccactccaggagtttttttggaaggattggtgttttaagaaactttggaaaacaaagatgtaaaccaggccaactgggtccccctggtggcctggaggacaaggttctccagtggaccctgaagaactacccaccaacagtgaagccaaaggggtttttttgtcaagagtgccatagtcaggtgtgtagcaaatcttcacccccatttatctgtgcatgtggccgacaacgacctgatggccgtgctgagcacctgggcagcgaggacaggcctttcatgtaccagcctcacctgggaaccagcaggcagtactgtgcccgtcctgtagggtgtgaaattgtgggagggggagtctacctgtctagtgtccaacagtggtcaggaaattagtccctgtgctaacacctctgccttccattgcatagtctgaccatcaatgtgatggctgctctgtcttaagggccatttgggatcaaaaagcccagaactcaaatttgagattgaccatttgtagtgtgaccttgggaaggtcatcaaaccattcagaacttaattttcccaattaaattttttttaatttccagattaataaatctgtgcctctacacccaaagaagagtttgggaaagaaaagaactaacacttattgactatctaatgtatatcaagccttctgtttgtaatcattttccttttcaaactttacatgccccaagagtctccaagagttgctatgagagctcactgagaacaaatatttaacaactgtctaggtacc

SEQ ID NO: 470875 - DNA, 481 bp, Homo sapiens
tacatatacaaaatgtttcttattgcaggtctcgttccaaaaagtttgatagcctttactctagtgcagcggttttcaattgagtgggtggagactgagatgctgctaacctttctaccatgcacaggacagttcccacagcaaagaatgattctgcccaagctgtcaatagcgctgctgttgagaaaccgattccagtggaagagacaggcacgtagacacatgaaagagaacagggaagggaattacagggcaggtggaaaggcaggtgtctctctaggttataaagaaggcaaggagccttggatgtgtactcttcgtgatcagccacttgggctggagcctagcgcctctggtcccgaaatgaaagcaagatactatcactataatcatgatcatgacaatgattatgatgattttaaaattcactgagtgtgaaacatgccaggcacagctctaaaggcttttcctgtgctaactc

SEQ ID NO: 470876 - DNA, 2936 bp, Homo sapiens
cgggagaggcctcaggaaacttacaatcatggtgaaaggggaagcaaacacatccttcttcacatggtggcagccagagaaatgcagagtgaaggacgggggaaagccctttataaaaccatcagatctcacgagaactcatttactatcacgagaacagcatggaggagttgaaaggaatagagggccctgtggagtggttcaaatggctaagcctagaaaaggtgatggtgagtttcctctggtcccaagtgtgtctagagacactatccaaaagccagggcctagaattgggaactttaggaatctacctggtgctttattctactgtagcagaactggcacaaaagccacaagacaaagtccttcccactcttatctcctatttattcaaacaatgaggtttctccccatggtcactacagcccctagcccaatgtaaataatggttggctaccaccaatgtttactcaaggcccatgggctcttcagtcagcttgtggtacatgctaccattcctgaatctctccctgaagggtagtagactctcttctggccaagggcaggtcacaaaatttcatgcaggaaccaaagcctggaattgaggactccaagagcgtgcttggtgctctaccccactgtggctgaactgatagtcaagctgagttttggttcttatgaagacgcttttatgtgtgaatttttattcaatttggtgttcctgtggggggtgggtgggcactcactggaggatttttcagtcatcttgctctgccctgtctccattttctcttttttcacttaaaatcatttgtgtcttacatttttaattcctggacaataagccatatttatttgatatgatttattcaataattctaattttgaactgtcacattatttccaacattttttatttatataaaattatgcaacaaacattaaataagtgcataaatattattgtcagtttatgaatatccccttaagatagattccacaaaatgatacattatgtgaaatggtatgaatattttatgtagtattttggaaaggctagaaaacgtagcatccctaccagtgttttatttttatctacatgcaatcaatttccataatataatttggctaggctttgctgatatcatagttaaaatttaatcttattgttttaatttgcattttgttgattaccagtgaagctgaaattttcatatatatatatatataaatttgcatttcctctgtggtttctttacctatttgactacagagtgatagaattttctaatgtctcagtaaatctttctaaataaagaggactaagcacttttgatattttttgaaaaacaattttcctggcatgtatatatttttaataaaaatatacaaattttatgtagctaaagccattttggacatcttttatcaggtctttcttggactaacattactttccttttcaataaactgaaaaagcagaatggaagtactcaaattagacattagcaagattggatatcaaccgagtctgtgataaaaaccaagtctataaatattttaatttataacatataattgcatatttatttgcaaaacttttgtactagagttaatatctttgctttgagtctgagtccactgtttggggttccctattgtccttcttgcataaatcacacccaaaatgtatcctttttaatttgcacacttgccttcttgatagagggaaaggaatctaatgaatattgtgaagtaatcaagtatagatttctaagcctttaaaatatgtatcttagtattttatattgtcgtttttaaaagtttcatttagttacttttttgtataagtcactgaattatatatataaaataattctcttttgcactcatatttcattttattaaacaaaactcatatacacagatgtaagaataaaccccaactgactcttgacaaacatacaacttcactgacagaaaagaaaatttagttctaaagactattctgccaatcgtaagaattcagtaaacctatttcataggaattaagtaaaagatgtcctgaaaatattaatatgcaccagtatctatttattgctcaagttctcaagtgtgagctgacctttaagtctgttttattgttttgtctgattgaaatgcttttccccagatattgctagaatattactctgtatgtcatatatgtgatatgtgtgtgtgtgtgtgtgtgtgcgcttaactttttatacttaatattatggtccattcacaattgatttttgtttatagaatgacttttacttacagaatgatttttatttacagaatgtcgtgagtcattcttttcccattggaatatccaagtaacccagaaacttgattgaaaagatgactcataaattatcacattggagattcatttttctcatcagttgaagtaacaattttcaaagcaaaatttaagctacatttaaaaaaagcaataaaatatttatgttttattttaaataagctgaggattatttctctgcatagtgtgcattagtttaattcatttgacatgaaaaaagttcattatgttaaattctagacgctgtatgagacaaaccatatttaacaatttactggttcataatattggtcaattaaagactgacaagtgtccctgaatgggaagcttcaaagaaatactgctcagaaaacttgtctaagggctgtcattggaattatatgccactgtagttagtgcaagttatgtagtttctccagttgtagcacaaaataaaacccatctttaatcagagaaaataatacttaaatgtgctcatgaatatttatttcagtaatggaagaagtataattttttacatggtgagttttcataacaacagtacatatttttcctgaattgaattttttgcaaaatatttgct

SEQ ID NO: 470877 - DNA, 689 bp, Homo sapiens
ccctgagagagccatcctgcccatgaataatcaaagcttgcccctgcttaccaacgggatagttataggcatgggcaggagagtcctgggattgttacacaaagggatggggcagtgtggttatctgctgataaggcctgccaaggactttcatggcagccccaaccatcttaggctcggaggcctaaaaggaaaaaaatggtttcctgggccaggcccagggccatcctgctgtgtgcagcctagggacttggtgtcctacaccctagctgctccagccatggctaaaaggggccaagctacagatcacgctgttgcttcagagagtgtaagccacaaggcttggtggcatacacatggcattgagcctatgggtgcacagaagtcaagaattaaggttcgggaatctctgcctagatttctgatgtgtgaaaagcctggatgttcagacagaaacttgctgcaggggtggagccttcattgagatcctctgctagggcagtgtggaagggaaatgtgaagttgaaacctccactcagggtccccactggggtactgcctagtgaagctgtgagaagagggccaacattctccagaccccagaatggtagatccaccaacagattataacttttccaggcacacaacaccagcctgtgaaggcagccaggtatgcaactgtaacatat

SEQ ID NO: 470878 - DNA, 1681 bp, Homo sapiens
ctctctctctctctctctctctgtctctcctgctccaccatggcaagaggtgcttgcttccccttcaccttccatcatgattgtaagtttcctaaggtctcccagtcatgcttcctgttaagctgcagaactgtgagtcaattaaacctcttttctttacacattatccagtctcagttagttctttatagcagtggtgacacgggctttatggaattatttagggagaattcccaaggcagaagtttagtgaagcttgagctgcaacatctcactctgctggggcttttttcaaggatgccaggaggaagcagcagccatagccttgagcttgtgcatgaagccctgccctggtttaggggccaccttctgagacctggggaccaggggcttcttgtggtgcaagtggaataccaacgcaaaccccacttactccaccctgaagttagtcagatagtcagaaaactacataagcatcccagaagtattgtaaatgagaggaccaagatctccatcacagctatggactaaaaaaatgagtcaggacctagtgtcagggaaggatagcaagataatttgggggtagaaagaaatggtacctctaggctgactctttggacaaatcaggaggttttcactttatatttagaatatataacatgtacattccgttttgagtgaatcagattttactatttattttattctgtttttcattagacttaaatttctcttcatttgcttttttcctgaggtagaagcgtaagctttttattttagttatatattttctaatatgtaaatttaatgctatgaatttatctctgagcacttttgctgtatcccatgctatttttaagttgtctttctgttttcactcagctcaaaattagtttttaaaattaacttgaaaattctttgacttatgtgctatttagcagtatgttgtttaatttccatggacttggatttttttttcaactgtttttatggattaaagatacacatgcaggtatgctttatctgaaattagtgactccagcactgctcatattaatatgagcatggtatttctttcctcactcctttacttttaaactttttaagctttatattcaaaagagtttaaatattcactctaaatatctttttattttaactggtttatttcgactatttaaatctctggtgtcctgtgttccactttttacttctatgagatcaactgtctttagcttccacacatgaatttcagggtagcagatttccctgaaacctcagttctctgaaggctccaagaaaagttgttgattttcagttgatttagtctttttttcttattgtgaggatagcaatcttctaagctctttacatattggagctgacactaaaagtcctattatattatatcataaatcagtccatgaatttatattatttgcaactgaaaaattctaggtgatattgagtatagatttgtaaagatatattgagggaaatatgagatatttgcaattgactggctggaatgcacagtaagtgatttatctgccaacattggagatggaatctgtaaacccataatatgtagagggaaaatggtgaattcttatcagctatgtctgcctggacccttttgaccatttacatcaacactctggaaatctgcgtactggctacc

SEQ ID NO: 470879 - DNA, 639 bp, Homo sapiens
caaagcatgcttactgttcttatgggttatttgcgctgtgctgcaagccggtgcagccagatagggactctgggaaaggccagcagacgggatgctcagatcaggctagccccaatccatgggctagatagctcttttctgtctaggtctgacagtctagataggccaaaccaaccttctggagcagggcaaacctgggaggatttgctgtccttagccatgctccactgcagccattcctatgctaaaccaactgggctctgcacaggctgtaattctgtccctgccaactctccaagcagctctccaagccagttcaaatgtttgcatgtgttgtgggattttctgcagatagacttctggaggtctgtggaaccggttttggttgtcacagctggtgtgtactgctggcatgtaatttacatgtttaagccccaacctccaatacttcaaaatgtgactatatttggagatctggtcattacataggtgtttgtgtttacatgggtgttcattagggtaggccctaaccaaatatgaactatatccttagaagaggaggaaatctggacacagaagtatctatttagaaagtcctatccagagcaatcaggcaagagaaagaaacaaacgacatcc

SEQ ID NO: 470880 - DNA, 2872 bp, Homo sapiens
ccggccatttacacttcttttgtggtggaatgtcatcagttaagaaggacgtgtttgcttccccttccatgatgattgatgcaaagcataaaatcttagaaaatgtgaagcctgataatgccacagaaaagaaaaactcattttctggggagaaattcaagccagctgcagaaattcacatacttaacaaggagccaaatgttaatcaccaagacaatggggaaatgtctccagggcatgtcaaagacctccacagcattctctcccatcacaggcccagacgcctaggagagaaaaatagtttcctgggcaatgtccagggaccccctgctgtggcagtgcagaaggaaaatgtgggttcagagcccccacatagggtcccccctggggcactgcctagtggagctgtgaaaagaggaccacagtcctccagaccccagagcagtagatccactgacagtctgcacagtttccaggtggaaaagccacagacactcaaagccatacatgagagctgggctggagctgcccaagaccatcagggtccacctcttgcatcagtgtgacctggatcttgtaaatgtttcagggtcacttgtcatccagaaatgtgccttttactaaaatgattatgccaactgttctatttaaaaggctcttgatcactgaacacagtgaaaagtaattcataaatgctgactcaagaaaaatgttttgataacaaaagttgccaaggcaagccagaatgaaagcattccttagccttaaattgaaaatagttaaaagacccatagtgaaaaacactaataacaaatcttcagaagctgatgataaacatacattagaagttatgattaaatacattttgactaaacaagatacatgaagctcttattacaaggcctggctctatgataggcaataagaatatttcatagcaatgagagtaagaaaaatattaatgatgagttgtgtaaatgtatatttttatatcgtgtttctgtggttgagtgatttgcagtaaatactgtcagctaataccaaaagcattataaaatgtgaggacagccttcacagttggttagaaaggtgacaagtgaagaacatgacacctaaaaacaactgctgcactcacgggatcaatttcagtaatttccagggtgttttatgaagatgcacagatagaactataataggactctatgatttaggtttgatttataatctttggatgtgaatgttcattatgtgttgtctcttttaatgaaattgctacctttaaacttaaagtacttatgaaatggtgtgaagaagcccagggaaggctaaggcaaatttttagtaaacacttttataagtattaaaggtattgtaatgtagtatcatggcagtaacaattaaaagggagattacatgtaaacatatttttttgtattggttctaccatttagagctagaatttcctttataacattccatgtattcataattattttattcattcaataaatatttatggagtatcaaactctgtctaccactaatgcagacatcagggatataattgttcctcgttcatggactgatttggacttacttacctggcaattgaatgttgaaatgcttcaggcaggactcattctcattgcctggaaatttgctattatctatgttatttttcaaagatattttatctatgtccatattaactattaatattcatacatgaatgactcacaaaattctattctttatgcagatttatcttctaagattttaggcccatatttcaaaatgtctactcaacatctcatctcaaatgatttatgacaccttagacttgacatatctgaaatcaaactcagatttttacaatcaaaacttggtttattccaaggatttcttatatcactgagtagtagcattatccatccagttattccagacagaatcttgagaataattgctgagatatttgttattcttacaatcatttctcagtgtccctttttttctcaatttagagactatatttttaatacttttaaattcacagcaaaattaagagtaaggtacagagatttcccatttatctccctggcccacatggataggttccatgattattaaaattcccctccagggttgtaaatttgttatagttgatggacctatattgacacctccctatcacccaaagaccatagttaacattagggttcactcttggtgttgtatattttatagtgtctttcccatgtggtcctacatggaatgctgtgcctcatgtctctaggaccctggttctaatttgtacttttctgataattagggatgctgagcaccttttctcatacctgttgtccatttgtatgttttgttttgagaaatgtctattcaggtcttttgtccattttttaatcatttttttttctactgagttccttaaatattttgactatatagtttaactttttttacatgtatggtttgcaaatatttcccctaactctgtaaattgccttttcacttcgttgatttttttctttcggaaaaaaaaattggctttagagttaaattgaggttgcttgctgacgtgatatgaagttagacaaagatgtttatgagagactctattactggtcactcatttcacttctttaggaaattggagcagaaagagaggttgactcttcactgagactgggtttgatggtttgcaaagatagacaccaatgtcaccttgcatccttgagcatacataacattatttctataaaaaaatcaagtctattttacccttgacctgagctagcctcaagacttgctttgagctatagaatgggacagaaatgaaaatatgcttatgagg

SEQ ID NO: 470881 - DNA, 728 bp, Homo sapiens
agcagtgttgatttcagggcaacagatagattttagcaagtaggagaatttgcaaacacggaatcctcaaataatgaggattgactatatttatattcacaaccagatggacattgagggctacaattctgggaagaagctccaaaacacttcccaaagccaaacttgcaccaaaaaggtcatggtcattctttggtggtctgctgctggtctgatccactacagctctctgaatcctggcaaaaccattacatctgagaaatatgctcagcaaatccatgagatgcaccaaaaactgcaatgcttgcagatggcattggtctacagaaatggcccaattcttctccacaacgcccgactgcacgtcacacaactaacgcttcaaaagttgaatgaattgggcgatggagttttgcctcatctgctatgttcacctgacctctcgccaactaactaccacttcttcaagcatctcgacaacgttttgcagggaaaacacttccacgaccatcaggatgtagaaaatgctttccaagagttgcttgaatcccaaagcacagattttcacactatggaaataaacaaattcattactcattggcaaaagtgtgttgattttaattgttcttattttgattcataaagatgtgtttgagcttagttcatggtctaaaactgcaatttcttttgcaccaatctgatagatgtaaggtcaccatgcttagtat

SEQ ID NO: 470882 - DNA, 853 bp, Homo sapiens
tctctcctactctacttacactttatgactttgctcaattttctaaagcatattttagtaacttggcctccgtatgaacttagatgtttatgtttcaggaagtcacacaccggaatagagttctgtcagacaacttccagaggctacgatgaatcatcctgctacttattttgggcagccccacaaaaacaaaaggaagattccagtgcatctgagcttctgactctatcctcaaagctgattcctatgggaaaaattattcaaggacaacagaaagtacctcttcgacctctggtcaccaaggagacagtcaaagtggaagaaggggaaaacaaagaatttcctgaaaccagggaatgtaatctgaaggaattgtttcattttctgcatcagtatcatcagcttcttaaagaacctttactaaaacggatattgaaaggacataaaaatataagtgttgagaggattctggaagttggaaagcttaaacaggctttctataaagaagtcgtgtctcctttttctgaatgctttatgggaatggatatgatgtctggctggggaacacttccccgatctagtattgtaaaattgaaacctgctaataaagtcctaatggaagctacagtacgggttgatggaattcaggtttctgtccagtatgaagtctatgatggcattgaaggtcataaagaagtctggcaatttcagaaaggttgggaattcattgcctgcagtagctaatgagagtagaaattatttaaattttctcctagtgtctggcttctgaaagttttgtatggtttttagcctatcaaaagtaagcaatgtattaccttctgtcatatattac

SEQ ID NO: 470883 - DNA, 597 bp, Homo sapiens
ccatctcctgcctgaggtagataagcacatccagcaccagatattgttttctaaatatcattacctacctaaaaggaaccagggctccttgcagataatggctgatctcagcttggagaagttggttattaccgaccttctgaagcctacttctgtcaactcatcaaactcattatccagctgtcagacagggaagtttaagtctgcagaagctgtctgctgccttttgtacagatatgctctgcccccagaggtggaatctagagaggaaataggccttgctgagctgcagtggggtccaccaaattcgagctttcctgctgctttgtttacactagaaagtctaatccacagcaagaccctaactctctttaattctacaaaggctgagagagatgaggaagcggccaaagaaaagtttgaagctagcagaagttgtttcctaaggtttaaggaaacaagctatctccataacataaaagtgcaaggtgaagcagcaagtactaatatagaagttgtaggaagttatacagaaggtctactaagatcttctgtaggtgatgaaggtggctacactaaacaatagattttcaatgt

SEQ ID NO: 470884 - DNA, 1113 bp, Homo sapiens
gggagtacggttgtgggcaatacgccaactaaccaacaggctgccttgctgcctctgctctgacccgcagaaatggtccagggtccctcagcttcagatctgttggagtttgccggagttccactccagatcctcattgcctggctatcaccagcggaggctgcagaacagcaaatattgctgcctgatccttcctctggaagctttgccccagaggatgaagattctcatatgcttccggaatggctcttgggagcctggataaaaaatagaagcacaggtgccataattgccatagtaaatcatgaaggaatgacttccccacagacaacctatgaccttttactcaacttaccatacactgaagaaaggggaataccagatctcttgagcgttgttgaatacgaggttcatgctgatgctattacagttacagtaagaatcccggagtaccagacaatgagaggtctgaccatgagtccttctccaccctccagacgtgggaccacacaaggacttccctgctactgagggacaagttcccagtggccggccgcttattgcacctatctccagcattccttatgaaaaaattacttgtaccagtctatgaaaatgaatcataaagctagtgtgactgcaactattagatacattccattccatgaataacactattttatatgaaggtttgaggttaaaagggaaaaaataggcaaggattatgaaaatacaactttctgtcatagatttcagcaggtgtcttcttacaatacaggacatgtttttattacgaaaacaaagaaagggtgctgccatagtagaattccactgcagaggatgaatatactgctgggtccatttggttgtatcgtagttcaataacgctatgtgtatgtgtgtgtgtatgtgtctgttaggaattaggagagacagattaaggatcagttttaacgatgcatttcagctttttggtttagacaacttaccatgcttttcactctagaaacactttaaggtagttacaagatttctctactttacattttatatcagtcttaataaatgtgatatgctttcacatgcagtatattatttaagcttcacaacaat

SEQ ID NO: 470885 - DNA, 935 bp, Homo sapiens
gaaaattgttcagtttacctactttggagcattagattttagaatgaagctgtggaccttcgtggtgaatgttacagttcttaaaggtggctcagacccaaagagtgagcagcagcaagatttattgggaggagcaaaagaacaaagcttccttagtgtggaaggggacccaagtgggttgccgctgctggctaggtggccagctgttattcccttatttgtccatgcccacatccttctgattgatccattttacagagcactgactggtccattttacagagtgctgattggtccattttacagagtgctgattggtccattttacaaacctctagctagccacagagcactgattgctgcattttacaatcctagctacagattgctgattggtgcattttacaatcctcttgtaagacagaaaagttctccaagtccccaccaacccagaagtccaagctctggaaatctttgtaattttgagttggtctggcaataatttccaggccttctccctgcaaatggctacagaaataaaaaactctctttctccagttcatctgcatctcattattgggccatgagacatagcagcccgaatctcagtttggtccgggaacatttacaaagactaattctgtgttgtcatgaacttgcattatattgatgattaacaatggagatttcaatactcagcaagacccacaaagttgtggtctgaatatgagatcctggaaaaaaaatgttcaaatactgtgacattggtgcatttctgaattattcagttttcccttggtcatttcaatatacaaaggaagtgatgattgctgtaatatatgtttttaaaagggccattgaaattcaaaacagaaagactaaatctacctgaagaagcccagaaaggatgaagagaaaatggaacagttgacttc

SEQ ID NO: 470886 - DNA, 1417 bp, Homo sapiens
taagaatttcttaccagccagacttctggtctctctctctctctctctctctctctctctcaatctctctctctctctccctctctggctcaattatcctatggaaaaatctatgtgtatgtataaaacgcctttgtgtcaatgggcccgccgcgtccatggagagaggctgaggcggcgcagctccagcccaaggcactgagatgcagggatgggaaagatgtcgtttccttagtccgggcaactgtctgggctttgagcaagaggaagctgcagcccacccgggcaccctcaccccgacaccttcagcagtaaacaagataaaacaattccttaaagataagcctgagcttgtagatgtaaaagttggtgtccgaaccaggggctgtaatggcctttcttatactgtagaatatacgaaaacaaaaggaaattctgatgaagttatacaagatgaagccagagtattcatcgaaaagaaagcacagctaacacctttaggaacagaaatggactatgttgaagacaaattatccagtgagttatgttcaataacccaacatgaacttgtggctgtggagactcctctggccataggctccaggaaagctggtggaaaccttggggctcactgaagaaatcatgtgactgtcacatgcttaacttgcggctgccttgtaaagaaaataaagtgatgcattttgaaaatgaagccaaataaattgggtggtatttcacaaataaaatgaaattgaaagtataattaaatatacattcaattaatacagtatgaatatatacatactgtacgtatatattcatacatatatacagtatgaatatatgttgtaaagtattataaattataatacattcaatatgtatgtattataaagtataatacattcaatatttatgtattataaagtataatacattcaatatttatgtattataataaacatacatataattacaaaacataattatgattttaaaataattttgtatatgcaattataatgataatttatatttatatattaaaattataatgataatttatatttatatatcataatttatattaattatatttataaatataatttataaactataaatatacataatatatttataagctatacatatatcatttaaaaattataagtataaatgtaaatttatatttataagtataaatgtaaatttataagtataaatgtaaatttatatttataagtataaatgtaatttatacttataaatataaatatatttataagtataaattacaattatatcaatatataaatatttttataattttatataaattatacatatataattgaatatataattgaatataaatataattaaatataaaggtagactataatttaaaataaac

SEQ ID NO: 470887 - DNA, 657 bp, Homo sapiens
tggccatgacttggtgcagggctgctccagtatgctgggggtaagcttcaggccctattcatcttatgcattcccgtgcctggagatgtcactcaaggagcaaagattggtgcctgttccttcttctgggacctgtgacctcaagaggcgccaaactgatgccagaggcactctggccacagattgccacagccagcttgttggactgtgggggacaagtcttgggaccaagctgtccagactccctagctccagcaggggaaaagcacagcctttagctatagagatgtatgcagctcttcagccgcccagggagcttagcgtgttaggcagttgggagtcccagtactggctgctgtccctcacccaaggagctcaaacaggcttacacagcaggaaatcacagctgtggtgctggtcacccctctccccaggagttcagtaggcttaaacagattccagctgagaggctgttgagaatctgtgtgttccagggttgggacgctaggctccagtggtgtgggttcaattatgatgttgtaatttacttttaagatactttaacatagagagtgtgatattatctatgtgttattctaagctatacataaggcaaaaaacacttgttaagctaatcataaattaacaggccaggac

SEQ ID NO: 470888 - DNA, 591 bp, Homo sapiens
cagaagtaggcttcagaaagtggataataatgaacttcactgagctaaaggagcatgttctaacccgacgcaaagaagctaagaacttggctcatcccattcctgggcacaacattgacccagatctggagaaggagtgctctggaggtttgggcctgcggagcaggttatggctgcaattcaagagccagatccagtttggttcagaggcaacttgggtcccaagacatgaggcactgtgtagtgatgactctagaccctggaatagtaggacttggcaatccagactctgtgagaccaggtgcaatagcagcaaggaccccagaatggcagagcacagctattgtttgggtcctgggagacaggtagcagcacagaggcaatgcactgtttctgctctaacctgggggactgacagctcttggcagtccagggatcattactctgagatgcaggatgccacttcaacttaagtattggggtgcttgtctgctctgaatggccaaggcaccctttcctgagaggcagggtgctgctttaacttatgcaccagggaagcattactcttgcaggcagccaaggtactatttt

SEQ ID NO: 470889 - DNA, 709 bp, Homo sapiens
tgctgttggcgtcttcacagtggccacttcagataggccgctgctaccgtcatgggtttattatatagagctttggccatgatgcccaatggaaaaggagaggatcagactattaaagcagaagatgaagactacatcaagaagcagcaaagaagatccaaagagctaactgagaacgaacactcagatgtctgcgcgtccttttccacttggacaagtaggaagaacataaccagctggcataaggcatcagcacaaaaatgggcttttgctgctgaaatgtgtgatatattaaatagcatgatgaatgatacatatggaactctgggaaatttaaagagtttaagatacgtggatttgctacaatactttggagatatgtcttgcaagagacatacgaatctgaacagacttctgactttttccactgcggatggcttctgtggcttgatccctaaatggtcccttcagtggagccttattgagaggacttctatttgactgatgccaactgcaagatgaacaaaatcctacctctgaaacaatgtcatgcctgcatccttcaggatgatggtcagaatacacaaaagtgcagtaagcggagactatagagtttacagagcaggttgtataagttgttttgagcctcctccattaggaaattttctaagaaaggcatacctgtgtatcagaactgaccctaagattc

SEQ ID NO: 470890 - DNA, 713 bp, Homo sapiens
cggcgcctccccgccggggcgcagccgggatgcgctcggcagccaacgtgacggggctgggcgcgggcggctccgcgagcgcccagcgcccgcgaggatttgccggttctcctcacacccgagcgctccgctcagaagtcgggcgggcaaaagggagcgcctcgggaagtatctgggagccgggctggaaatgaatggggcccggaagcgagctcaaatcgctgacacctggcaccgggctgcgtccactttcatgcttcctaaggcagttctgcctgcaagaagggaacgcgcatcgcctttcagtagatcacaccgatcgtttgcacagacttcaggggcgctgctgctgctgctgctgctgctgctgctgctggaggctggagggggttgggagcagggaacgaaggcagtctcctcatctgatgtgaaccttcagactcttgcaggaagcaggacgtggaatctgcagctgagaaaggagagggatatttcagacacacagacacagagaaaagggccatgtgcagagactgcagtgatgcagccacaagccaaagaatgcctggggccaacagaagctggaagaggcaagggaggattctgccctggtgcctttggagggagcgtggccttgcttacacttcaacttcagacttctggcctccagaactgtgacagaaaagtttctgttgttttcagacactgagttt

SEQ ID NO: 470891 - DNA, 1127 bp, Homo sapiens
cttttgatgtaaacttggacagtagctgactttatgtccatctcttggctcccagtgaaatcggaccataataccatgatctctgttaaagttggggtgtgcgtgtatgtgtatgcttgtgtgtgtgtctgtgactgtgagagtgtgtatgtgggcaagtgtgtgcgtgtgtgtgagcatgtatatgagtgtgtgtacctgtgcatacaccaactctctgatccacctgtcaccaatccaattgttcattcctccatatactcttttctcttcatccccactgccaattccaaggcaaagcacccttcatcattcacccagagatcccagcaatttctaaagaaagctctggaccctaatctttcgtctctctccttcaatccttccacctcttcctgttggggcttcactccccggacaccactctcatcttccatataccaagtgccttcagacatgcagagtatctctccaacctcctcccattcctccaatcccagtgcaagctcagcgtccctcctccaaagccttctttaactctccaaaccccactcatttcaccctttgctcaaattctattgcaattatggtcattcacacacagcagaacacttattgtttaaatgcagtattgcctttccaccccctggtatccttagatgaatgatgtttttatttccagagttctaaattcaaccttccctaccccacctcctactagatacctggcttacttcctccttctgttttttgtttaaatatcaccttcttagccaatcttctttgaccacgctatttaaaactgcagcccctccaccatccccaagttcctccatccccctcaccacctaagcaagtccttgttttcatggagcttacaggagccgacatatttgcctgggcagaaaatatattcactttaccacttatttcattcacagacagttcaatatcgaatctgttctcagtattttattatgactccttatcagtgtccttgatcttgactttaatctctaaggacaagaaccttctctgttttgtttttctaaaatgaactttgaagtttagcatgattttagatttatagaaaagctgtgaatttggtacagagaattcccatatat

SEQ ID NO: 470892 - DNA, 2218 bp, Homo sapiens
ttccctggtcatctggggccgccagaattctgagagtgcttcagtggtctgaaggccctcttttgcatcttcctgcccttccctgccaccagccttccctggcaaggctctgcgatgatcgtggcaacagctttccaaggcgcccagatgtgtcctttctgccctgcaaactacatcagctctccataccctagagttcagggaggtttgcaagctcagctttcctgcatgccccttcgtccttgtgttttctcctatgtactcctcagcggagatggcagcgagctgagcatcccccccactcagtggtctgctgaggatggagtactggtgcagacacgactcaagactacatttgctaagtgtgaaaacgagtgcgtggtgttatctgacagctttttttacgagaaggaccttccttcccatacatctgctgctagccacatggcccatgcatctgtgccagttgtccctagttctgtttccatagctcctgaggattatccctcaaaactgtcaaagtcatcaaaaacaaagaaagtcactctgagaagttatcacaaccaagaggaggctaaggacttactatgactaaatgtagtgtggtgtccagggtgaggtcctggaatgcaaaaaggatattagggcataattgaggagatttgaataaaatgtatgacattttattttacaatgggaaactgaggcacagagaggttaagaaatttatccaagcagtggatgcagagattctgaaactgggcagaggttccagaagacaagtcatttttctagacctcccatagacgccatcgttgatcaagccattttcattttcacgaagtattttattatggaactcctaaagaccatcagccctacctggcactggctttctggttgaaaagcagcattgtggagcctgaaacatcatcagaggcaactgcttcccctccctgtggatttaggaccgctatgtgcagagttctcctgtttgttagtttgctgtcccagttgaattctgagtttccgggaatccctagtgcaatgagaaatgatggagaaccaattctcattatctgatgaaggaaagagccatgtacctacaacagcaaaggctcagacaagccttctcctgccttgggttcatggtcacgtgctgtaggtgtcttgtcttcccatgtgcacctgtctgcatcctcatggtgcatcctcaggatgtcccgtacagtgtcttacctatggttatgcttttataacaatgtgctaataaaagcatggattacaaaacaaaacagaagatatgggtttccttgttgatttagatatgcccaagctttctgggttggaagactgtagtgtctggactgtctggagtcaaagcagtgttgaatctataacagcaagaaactatttcagcagagccagatgtcaggttctgggctgagctttgatggaaactaaagacaggacaagaggagtttgcttcccatgcagaggaggctggaatattgtacagctcagacttaaagacataactttgtctgagagggaacttggcatgaattggcaacactctggacatataagtctccatttataactgaaggttggattgggcttagaactgttgggggaaaggctgaacaggagatggtccaatgtttattaaaaaaggacatctcagataggttttggtttatcaaagggaagcattaaaatgagtatcgtttttctaaagttaatctgtccttttatacctaaaaatataattttttcttgaatcaagaagaaacaacttcagctctgttcttggtcttaagaaaatctgctgcacacattttataaatgtcgagttaattagcactgagttagtgatgtcataatgaattatttctcatcaaagcagatgggtcaagaacaacttcctaggacaaacagttttctaaagcaaacatgttaacaaagtagtttcctataacattctttgcctcaagttttcaaaacagcaatatggagccaaaatgttagaaacctcaaagttgctttgtgaattgtatatgttttcctattgattgttttcatttcattttttatcatagttaccctagttctctgactttttttgaagtataataacatatctatggaaaagtgcacaaatcataggtgagcagtttgatgaattttataaactgaatatacctgtgtaatcagc

SEQ ID NO: 470893 - DNA, 2101 bp, Homo sapiens
acctcaaaatatgaaagtaaaaaataagaagaagaagaagaaggaaaaggaggaggaggaggagaagaagaaggaaaaggaggaggagaagaagaaggaggaggaagaggaggaggggaagaagaagaagaagaagaagaagaagaagaagaagaagaaggagaaggagaaggagaaggagaaggagaaggagaaggagaaggagaagaagaagaagaagaagaagaaggagaaggagaaggagaaggagaaggagaaggagaagaagaagaagaagaagaagaagaagaagaagaagaagaagaagaagaaggaggaggaggaggaggaggaggaggaggaggaggagaaggagaagaagaagaagaagaaggaaaaggaggaggaggagaagaagaagaaggaggaagaggaggaggggaagaagaagaagaagaagaagaagaagaagaagaagaaggaggaggaggaggaggaggaggagaagaagcagaagcagaagcagaagaagaagaagaagaagaagaagaagaaggaggaggaggaggagggaaggaaggaaggaaaaggaagaaggaaggaagaaggaagaaggaggagaagaagaagaaggaggacaaggaggagaagaaagaggagaaaataaaataagccacactgaaatttcctgattaaaaagaaatttttaaccatctaaaaactggaaacccccatgaggttgctacagtttctctccctttgtctggaaatgacaatatgagcagtgagatctaacaaagttctctgaaaaatacagaaaaaaattgtcaagtcctgaaatgcccgcagaatgcagtctaggccttgagccttctgtgagggaaagtaattgcggtttttcccattacttctacaccaacctaatatatagctccacataataacgttttacctggggttactattctaggcattgaataaatcaattaagaaaggcttttcccaaaatggagcctgcgcgatgtttgaattttgctatctcctgcttcacactcttgatctttcttcgcggtggcagctctggtaaccccctttcctgctgcccacagccagctgtgtaggaacgagagggacatgctgcatgaaaaggagtctgattgctgaggagcagggtctggggaaactaagagcaaaccacctatacagcctggaggtaatgagacctgggttgtccttctgtctgcaaattggaatcaaagtgattatttttactgtaccgttgttctgctagattttagctgaagctttatcaaagcctggttcatttaaaacagtgtttctaggggaaaaaaaatacattccaaattccaaacaacaaggttgcaaatgaaggtgtgggaaagagtctctttttaaagtggagatgccacatgtctttgttaattaaccagaagattggagtcagtattcctcgctgctttctcaataccttcagttcttactgaacttgtcattaacccaaacatcctgctttattcccatcaaaactgtttccacgtttgttgttcttcgtcatcatgatctttgtgcaatggatttttgaaactaaaaatctcaggacttcacttttgaccccattgaatttcatttggcttgttttgatgcctggctaccagactcttcagatcatttttaattcttattggtaatactatcaatattggttatcctgtataactgttgatcatcaacacatttcagaagcatttcttttatgacttcatctaattttttttaaattaaagtgctaagtaggaccatggtaaagtagaactcaaatgatcttcccctgaagatgttccctcacattaacacccttctattaatagcattgaacagtcaaaaaaggtttgtaagatatggcagccatcctaagcacaagggtaaagaagcttgatatctgcctcaaatccctccaccctgtcatgggtaccaaccaggtgttatcgaaaaggggtcccaatccagacaccaagagagggttcttggatcttgcacaagaaagaattcaggaatggctaactgcctcagaagcagcccagtagatttcagccttatttta

SEQ ID NO: 470894 - DNA, 1123 bp, Homo sapiens
attttctgcatttgtaaataactggaacctggaggatgaggggcgtcattcacaaggagagagtgagaggagaagggacgggagagggcatcctaggcagagaaaagagcacattcaaaggccctgaggtagagaagactgcatatcaagttttaaagcaccaggagccaccagagaaagatgcagcagggctcttgatacatattgatgatgatgatgacaacaatgaagatgaagctgcagatcaatgtggagaggcaggaagagaggagtgtagtcctggacttgttttaaccttgggagttcttgttgctttttctgattcaattgtccaattcattcagtccactaaatacatatttcatggggctcagttgctagggtcaaccaattgggatagaagatcacagcctctggtggaccagagcatcagccagttttcatttgtgttgatttccttggaagaaaaagttgtggcagaggctgccccatgtgtgcgaaagaccaccgttcctgggctgtggctgcagcctctgtttccgttagcctttccgtacggcagtgttgtcaggtcaccgattccaaatgtcaaatgacccaatagtgagcacgcagtggatttgtcagtgctacctaaggctaggtcaggacaaaagctgccatgacaatgtcacgtgtcattcattgtgcagccctgagaattgcatgagctaattcctgaaagtaaataagctaataaatacttgtatattatgttattgtattattttatataatacaatatataaactatatcacacaattatgttgtgtgatatataaactatatcacaattatgttacctttgtaattgatatataaactatatcacacaattatgttacctttatataatataataattacatgctatttctaataaaatttctattacattatatattctatattatgttatgtgccaaattataaattataaatacatgtaaatttatgtataaatactaataataatttataatttgctatataacataatatggaatataatgtatatattccatattatgttatatattatattacatattatgttatagattatattccatattatgttat

SEQ ID NO: 470895 - DNA, 947 bp, Homo sapiens
ctgctctctctctctctctctctctctctctctctctctttctcagttcccttatgaaataagggcacacagggaatttccacgggctagttgttcaaatgtggggcactgagaaagccagatccttgccacataccgactgggataggtgcagagcattttatttctcctctgcctctccacccaaggtttccctcgtgcttgagagttccagccctttctccatctgccgcctgttaagcagctgctgggttcagcaacaaggaggctggtgtggctggtggacggagaacactgttagtgtaacttggcaggaggttgcacgctggcacagaggggcggtgaaaacgagaggaggtgagaatgtctccacggggtggggggcggaggacagagaagggggacgaccactaggagacccactgcccccggtggctggagctcatagggagcggctggtccaaattggatggggatccagcaaaggcacagtgtctcccctcccagaccccaggagttctccagcctgcattttccagctccccacgaacatttccaaattaaaaaataaaataaaaatacgtgtggaaaaatacagtaaaagtgacagcgccttcccggtttccgactgttctgttttgacttcacaatcagccaaactggagcccctgagtagccagcttaatttgtcaccttgagttattaaccgtttccctgcctctctcgcccggggggcaagatgtggggataggattgcctataaaatacagaacacccagttacacttgaattctggatagacactgattttttttttcttgagtctaagtatgtctcagatattgcctggggcatacttatcctgaaaaccatatgtgttgttaatctgaaattcagatttcactgggtatcctgcatgtttatgtgctcaatcaggcaagatttta

SEQ ID NO: 470896 - DNA, 3673 bp, Homo sapiens
gcttacttccacatgaaggcagaaatcaatcttgggcagccaaaacacatatgctttctcagtgcttgcctgtcccatcccaagtatacttgcctcagatggcaacatgacaaagctcccttccttctctcgaatggtttgcaagcttctggtcttctttttcttctccctggattgtgcacaaaattatgccaatttatggtggggccagtacaccacttaccacagtgcaataatcatttgtttgagtgtccatcttcctctagaccaaagggggcaaatgttctcttaaaagtgccagataatggggacagatttaacccaaaggacatagttcaactcctggtcttgacagaggagaagccctcaaagatggagtctcactctgttgccaggctagaatacaatggcacgaacttggctcactgcaacctccgcctcctgggttcaagagattctcctgcctcagcgtcctgagttgctgggactacgggcacacaccatcatgcccagctaatttttgtatttttagtagagacagggtttcaccatgttgaccaggatggtctcgatctcttgacctcgtgatctgcccacgtcggcctcccaaagtcctgggattacaggcatgagccagtgcgcctagcaaacgacagctttttgagcctctgtttaacaatctcttaaaccttataggtaggcagttctgagacagctcctaatcatctcccctcctggtattcaagccctgatggaatactctcttcttcaatgtgagctggacttagtggttttcttctaatccattgaatacacacaagtgatgagctgtcatttccaaaattagttcacacaaagctgtaacttttgttttgttcacagcctctctcaattgccttctcagcttgtatgctttgaagaagcaagctgcagtgttggagaggcccatgtggcaaggaaatgagggtggcctccagtcaatggctggtgagaaactgagaccttccttccaacaattgtcaagtaactgaatactcccaacaatcatatgggttaggttagaagtgaacctttctctagttgaggtttcagataagaccacagatattatactaacaccttgattgcaggcttatgagaaaccttgaaatgagaagactaagtaaaaccatatctggattcctgacttgcagaaactgtgtgatgataaatgtgtgttatcttaagccacaaagtttttggggtgatttgttctacagcaattgataatgaatacttcaacctatagtgacaactggatgtctatttactcattttccccaccaaagtgtaaagttcctacaaggcagaggttacaacatattcatcctgctacctctcacagcccataatatacaacctgacccataaaacatgattaatcaatgtttgttaaattaacatgtattttgagtttcattgaaatcagttagttgaagtgataataacatttaaatgtgcatgagcagtaggacaaggcagatagctggttaggatagaaagtttttgaaaattgtgaggggaaaaattatttctatttgtaccctgttgtacccagcttaggtttcaaaaactttcagggggtttttattcatttaccaaagacttcaaagttggtgcctccccaccactctaaagaggtctttgcccttattgacccaaccatactgatttgcctggtgcacagtgggagctattataaggagaggggagaagaaggaaatagaaacaactgtgaaaaaggttgaaaaaaatagcgaaaaggatagaaaaagagcagaggaaagagaagaagtagtcaacatccaacccagatgcagagaaatgattcaaaagaaaaagtctgattttcctgtcggaaatatttttaaaaggaggtaggcatttatcaaaaaggaaaaaaaaaaaaaaagaataacagagtttgtcttccaaaggacccaatactcttggaattcaatgacctaattctgtgtatggttgcagtgtggagattgcctcttgtctgattctcatggcattgagacctctgatttctcaacagcacatgccacagcactatcagaagtcaggaataaagaacagagggtgtggggggcagtctagatattatgctcagcaaacatatttttaaatcagtgtaaattctatcttgctggttgcttatcttagcagttaaatcaacttttcgttacttttgtagacattatataatatcttctccccgcagctccagccaccagctgttagtcagcagaatgggagagggactgggtcagcttaagctgaataacttccatggtgacatttgagggaaccaattcccagccactgaacaaacctaaatgttctgctatggccatagaaccaaatagatcttaacaaagaaacctgagagcattcaaaggtcaaaacaattggagctagttccttcaagcttaaatatgctcatctgtaaagtggggacaataactgtgtgtcttatagggttattttgaaggctaaatatgtgtaaaagcctcagtctactgaaaggttgctcaactgtaacactcttttcattttgtgagggatcattctttgttggaggttagggacactgtctcgtgcattacaggatgtttagcaacatcctcagcttctatccatcagatgttagcaccccccccacggaccaccatcttctccatcatcaccatcaaatatgtctccagacatttccaagtgtcccctgggaggctaaaactgcccctggttgagaaccactgttctagtacttggcattgttccataaacatcagatgatatttttatcattataattattactaaaggcaacatcaccctgctatggagacaggtccttggtctcacggaatccctgcaatagttgctgcatttctgcatctttctgagagtaagggttgaaaagagataaggtcaattcatctgacaacaatccaatgggaaacctactgtctccgtagaaattcttttcatggaaagaaaaggggctaccattttgatctgctgcaggaactaggtctattcctcagcctcacagtttgcaaaacgctacagacttttccatgggcataaattctccagctttagggattgctggtatagttgactcttgaagctgctcttggatttccaagggtagcaccatttttacctgagaaaagaaggaaaaagatattcaagaaggagaacttttcaacagaagttactccatttgctgtttttgtggttttgtgcttgtttaggtttgcaagtgtgttttctgcccaaattgttcttgcatattctaacagtgtttgctttacgtgttttgatgccacgctgttttgaaggtacaaatgtttttcatggcatgtcttgtgttaagtgtacaaactgagacgtgaatgtcagtgactgaatagagtacagtattcctcaaagtttgtaactaaataaaccctaagagaaaagtgaagcgagatttctggaggtctggaagtggccagctgacaatatacatctctgtatctcctatttttatctttatgctaaatgcaaattttactttctgtgctaaaataatgtttcattagtttcaaggtaaaaatgtgtaaatagactttccgta

SEQ ID NO: 470897 - DNA, 1356 bp, Homo sapiens
ggcactctccctctcctttgcttctgctcactgattttggcttcactcgtggacacatatgcatttgtgtccctcaccttacaaaataaacatccttgggcaacttcatattaagattttaattccacgttggaagattgagtcaaaatgcctctggcgatttcagggtcccttcttgctctattctgaagacagctcctacgacactaattcaaggatcagtggctggattcgagaaaaaatggaaaacggttgttgcaagggtgtcaactgcttggaatgctgccggcaaccgggttctgaggttgcctatgttgcagaaaatgacggagcatgttctgaagaaaacactaagggtgtggctaaacaaccatttgataaggatattagcatggctgtgacccacaggtctaagcagccattgcagccgaagccagaaagagatgcaatcataacagcagagaaactccagttggaactaaaaaggacagagaaagtgaaacagaacaaagggaggcagttggacttctgggatgctacaggacaagtccgtagagctatctggctttaaacatgcattgtccttcaaaaaaagggaagaatgacctttaaggcaattcagagaccataggacttccactgctcctacaggcctagggggactgattcgatgtcttgattgaaaatattggaagaaaagtattgactttccataaagggaaatctttactattgacttttataataactccctgttggcaaaagcacattctcaacccttcttccttcactctaatttatttacatataggcttgaagagatttctcaaattttgtattcatattaaaatgaattatttcaatgaaaatgttttttaaaaactgtttttaaaaagtggtttcaggtctaactcattgagaactaattaccttctaggtttcagcaatgagtgcttgaccagagagagagacaaactttctaaggtcaactgaaactgccagttgtgtcaaataattacttcctgtgtcgcaaaatacctaatcatatttaataacagtaatgcatttcattgttttttaaatctaaaataaatgcagaagctctacttatgctttgtcatatttagaaaattatgctaatgagggaagtggcttattttcatggaagtttccagaaggtaaagctctttcagtgctgggccatggtaaagttcagccaggggaccttaaagaagggactggtactggactgagagatctcatttcttcttattggattaaccccatgcccgtcaaatgtaaattctagtgattagccatccatgctgctttgttaataacagtcctattcagctc

SEQ ID NO: 470898 - DNA, 1135 bp, Homo sapiens
cctttcgatagtcagcagagtcttctgcgtggcatagaaatgctggttcatcctcggggatgggaggacaattaaagattaatgggaaatgtggaggcatcctggtggaggttcatctgcaaaagtgctccaacaggaaggtgggggctgtcagtgaaggagctatggtggtggccactggcaagcatttcagcagggcagctgaggctgttctgcaaatatgtgtggcaaggcagggaccctgggagaggccagcagaagaggtcgttcagataagactggctccatcccatgggaacagaggcataattcccagtggaataatgagcttcagccctctggcgcccaaggaactcacacaatgggcagatgtccgaactccactggccatgtcccagacgcaaacaatagaacactggccaactcctactaaagagaagcagtcagagatgcagagagtaccatatggctttcagcttcaaggaatcaggcagggagagagaacaacagctgtggaagtcctagatgacatcatcttccaacataaggctgtttcatctacattcaacatctgttgcttagtgtagccacttcatcaatgatcataactagattttctggacaacttctgcaacttctttgtcagcacatgctgcttcaccttgcactttaatgttatggagatgtcctgtttccttaaacctgatgaaccaacctctgctagcttcacacttgtcttctgcagcttcctcgtgtctctcagctttcatagaattgaagagagttggagatttgctatggattaggctttggcttaagggaaatgttttggctggtttgatcttccagccagaccatcaaactttctccatgttggcaataggctgttacgctttcttttcatttgtgtgttcactggagtagcacttttaatttccatgaggactttccttttgcattcacaacttggctctttgacacaagaagcctagcttttaacttatctcagcttttaatgtgccttcttctctaagcttgatagttgctagcctttgatttcccatttgtcctgagaaaagagcactggcaacgagctgtactttttttttttttttttctaaataggaaataggtt

SEQ ID NO: 470899 - DNA, 2968 bp, Homo sapiens
tttccttgatataattttaaagccagcgactctgcgcgggatgcgggagggcagcagcattcaaactgtggtcgggttatcccggaagcttcgactggggacccgccaaggggcccacaagctggggtgcgagtctggcggttgctgggccagcaggagcgtcgccatggcaacggggccgcgcgcacgccgccacctgtgggtggagaaatgcccgcgcggaagtctccgcccccagcctggggcgccggtggtcgccgccgccgggaacgtcgccatggcaaccgcaccgcaggctagaggggtggagtagggggcggggaaatgcgagcgcgaaagtccccgcccccgggctgctgggcggcggcgacccagcggcccgcaaggatttgaaaccgtttggcaggggcggcggtggcggcggcgttggcggcagcggccgagcggaaagcttgcgtgtggtggtgccaggttctcgtttttttctgaatttccttcccccgcccctcccaccaggttcttgagtggaattttgcgccggtggctgccgccccgcccttgcgggcccgttcgggaaggggcgtcgccctcaggccctgggcccgttctccgggcctggggggcgcgcgcccctggggtcccggcgctgcccgctgtggtgtccccggcaggcagagcgcgatccaggccgggacgacttgggaaagttctaagtaaagtttgatcagccggtttgatcggtctgacgtggtccaagagtctgacccaagggtttgcgactgggagaggaaatctgtgtcctggacaaggtaggagcgcggcctgggcctgggcctcggcgggccgaggaagggactgccaggaacggcaccgctggagttttcaattccgtcccagaaaagagtctcagaacaatcagctggatttgcggggacagaaccagggcgctggttggtttgcagaaagtcataggccgcttggagaggcccaagcccagcaccgccgcatgtaggatgctaccctgtgtttctgagttaattatttttaagtgttcaagagaacgacataagcagtcacgagagatttttaaacaggaagctataggcttagctttgtcattaggaaactcattctggagcaggagcagggagttgtcagaagtggaagatgctgtggagatgtcaaataggatgcaaactgaagacagccctttggatttggcaattaattggattatggaagtgggaagtgaagaagaaaaatgggagaagctggatgcagaatttgatcactttgtggttgatatgaagccctttgttctaaaattacctcataggacagtaacaatttttgccattgacataggactgtttacactgagttgttcaagggtagatagacattcagtgataatgtcctgccaaactgtggaaagatcttattgtgatgcctcgtctcacatgtcatgaacttatagcacatggatctctaaagttagctacaaccttttttcttgcatctttttcttttctctatggaaatttttcttgcaaatttttcttctttctatggaaagggccagagacaggaggagcctagtgttctcctgttctccggccctgtctatcaaagcagaaaataatctattggttttttatgcttatttgttggcagaacaaaatccagtgtgaataaagttttgttgctatcttgtctccaattcctggcctgttatttctaattatggaatgaaagtctttttctcaagttagagaattttcatgtaacttaagacactagagaacaattggggagaattttggggactgggaagattctctaaggcgtagtaggtgtgagattgtctgtaaagtattggtacatctatggcattcttttatttaattagtttataataagcaatctgaaactcacatcttaaacaagaactagaaattcataataaattacatcttattgctaaattcaacttgtgataatgggttttcccattattttacatagaggaatgctttcattaaccaaattgtactaaattctggacattagaatattatatagatttcagtttgctatgggatgtggaaagtatgtagattgaaaaactatttacttaagtttatcagtttcacttttgtattttcttcttgttcaaagtgttcccaatatttcatgaagtttattttatgattatataattttcatatcaaaaaatacaaaaaattttaaaggcataagtttccaacctgaaatgatgtttgcaccatagtaaatccggtcttagtgtatttttgtaggtaaaacaataaatgaatatgacctttgtaaactaaaagattagagcagatttatgatttgcattagatatataatcctcaaattgacttagactgataaaaaattaataccagaatagttttcctgagacctaaaacaatcctgtgtcatggcaagataatatagaccattatatgtagattaaactgtgctgtgatttttaggtagattttgaaaagaataattatttcacaaaatgacatgtcagtagtgctcaattatttttaaagatgttaaaaccctcaatcaatcagctacaaatccctgggtattattggatttcataaataaaacattcaagatttaattttagagtaagttgaaaatgcttagataaatcagagattgcattttatctctttcaaggtttacataattaaaattatagaaagatttttcaatatatctaaaattattttagagatgcaaaattataacaaaattttatcacagaattttatttataaaaagtctcccagcaaaggaaagccctggacctgatggcttcactgatgaattttactaaacatttaaataataactaataccaatcttactcaaactattcaaaaaaatagaggagggaggaatattttcaaagtcattctgc

SEQ ID NO: 470900 - DNA, 662 bp, Homo sapiens
cgacctagtatttgacagcacaacagatagacttgctgtcattccgtttgctggttttggaaaatgcagctgccacaaatcatacatgaatcagatagccataaggaacggaatgctgctgacatccacacaagtcgggaagtgaatccttccctagttgagcctctagatgagaacccaggcccctctgctgcaggtctgctggagttttctggaggtccacttcagaccctgtttgcctgggtatcgccagtggaggctgcagaacagcaaagattgctgtctgttccttcctctggaagctttgtcccagaggggcatccgccagatgccagccggagctctcctatttcttactttctcttgagccccactggcaatatcctcaaattccagattcctactaatgacctcttcaaatcaactttgtctttagcacactacacacaaagatgtttccatattcttaggctgtactttactttcagataccaaaatctgtattatctataatacagatatctgcagttatctattgcatgtctttctagctatacctagctatacgtgttttcattatatgcttagtatttgttctaagtatgtgctaggcaacatctaagagaaattccattacaaattactctaaatcttagcagctt

SEQ ID NO: 470901 - DNA, 1079 bp, Homo sapiens
tggaatcaaacgagtggaaaggaatggaatggaatggagtggaatcaacccgatcggaatggaatggaatggaattgaatggaattcaatggaagggaagggaatgcaatggaatcaactgtaatggaatggtaatgaatggaatggaaaggaatggaatagaatcgaatggaatggaatggagtggaatggaatggaatggaatggaatggaatcaacgcgagttgaatgcaattacaatggaatggaatggaatgcaacggaatggaatggaatggaatggaatgcaaaggaatgttatggaatggattggaatggaatggaatggaacggaatggattccagataagtggaatggaatggaatggaatgggaaggatttgaatggaatggaatggaatggaatggaatggaatggaatggaatcaagcgtaacggaattgaatggaaggcaatggaatcgaatcaacccgaaaggaatggattacaatttattggagtggaaaggaacggaatggaattgtatggaatggaatggaatcaacacaagtggaatggaatgtaatgtaatggagtggaatggaatggaatggaatggaatggaatggaattctatggaattaagccgagtggaattgaaaggaatggaatggaatggaatggtttcaactggaatggaattgattggaatgcaattgaatggaatcaacccgaaaggaatggatggaatggaatggaatggaatgggaaggaatggaatggaatggaatcaacccgaaaggaatgcagtggaatggaacggaatggaatggaatggaatggattggaatggaatggaatggaatcaacacgattggaatggaatggaatggattcaacccgagtgtattagaatggattggaatggaatggagtggaatggaatcaacaaaagtggaatggaatggaatggaatggaatggaatgcaatggaatagaatcaaccctaggggaatggaatggatttgaatggaatggaatggaatggaaaggaatcaacccgagtggaagggaatggattggaatggaatggtaaggaa

SEQ ID NO: 470902 - DNA, 9077 bp, Homo sapiens
ggaacggaatggaatgtaaaggaatggagtgcactgcaatggaatgcaatggaacggaatggaatgcaatgcaatggaaaggaatggaatggaatggaatggaatggaatggaatggaatggaataaacaagagtggaatgcaatggaatggtatggaatgaaacggaatggaatggaatggaataaatccgagtggaatggaaaggaatggaatggaatggaatggaatggaatggaatggaatggattggaatggaatggaatggaatggaatggaaacaactggaatggaatggaatggaatggaatggaatcaacacgaatagaatggaatgaaatgaatggaatagaatggaatggattggaatggaatggaatggaatggaatggaatggaatggaatggaatcaacccgaagtggcatggaatggaatggaaaggcatggaatggaatagaatggaatggaatggaatggaatggaatggaatagtatggaaccaaactgactggaatggaatggaatggaatggaatggaatggaatggaatggaatggaatggaatggaatcatcgcgagtgaaacggaatggaatggaatggaatggaatcaacccgagtggaatggaatggaatgaaatagaatggaatggaatggtatggaatggaatggaatggaatggaatggaatggaataaatcctacagtaatggaatggaatggaatggaatcaacgcaagtggaatggaatggaatggaatggaatggaatggaatggaatggaacggaatcaacgagaagggaatcgaatggcatggaatggaatggaatctatccgagtggaatggaatggaatggaatggaatggaaaggaataacagaatggaatggaatggaatggaatggaatggaatggaatggaatggaatggagtggaatagaatggaatggaatggaatcaacccacctggaaatgaatggaataaaatggaaaggaatggaatggaatgcaatcaaaccgagtggaatggaatggaatggaatggaatggaatggaatggaatcaacccaactggaactgaatggaataaaacggaaaggaatggaatggaatggaatcaacctaatggaatagaatcaacgcgagtggaatgttgtataatggaatggaatggaatggaatggaatgcaatggaatggaatcaacccgagtggaatggaatgcaatggaatataatgggatgcaagggaatggaatggaaacaacccgactggaatggattcgaatttaatggaatcaaccccagtggaatggaatggaatggaagggaatggaatggaatggaatcaaacggagtggaatgcaatggaatggaatggaatagaatggaatggaaaagaatagaatggaatggaatggaatggaacggaatggacttgaatggaatggaatggaatggaatcaagcgagtagaatggaatggaatggaatggaatggaatcgaatgcaatggaatggaatttaatagaatcaactcgagtgcaatggaatggaatggaatggaatggaatggaatggaatcaaaccgagtggaatggaatggaatggaatggtttgcaatagaatggaatggaatagaatccaacagagtggaatggagtggaatggaatggaatggaatggaatttaatgcagtcaacccgagtggaatgtggattggaatggaaaggaatggaatgcaacggaatcaaccggagtggaatggaatggattggaatggaatggaatggcatggaatggaatcaaacccagtggaatggaatatattggaattgaatggaattgaatcaacccaagtggaatggaatggaatggaatggattgaaatggataggaatggaatggaacagaatgtagtcaaccagaggggaatggaatgcaatggattggaatggaatgcaatggaatcaacccgagtggaatggagtgaatggtgtggcatggaagggaatggaatgcaaaggaacggaaacaacatgagtgcaatggaattgaaaggaatggcatggaatggaatggaatggaatggaatggaatggaatggagtggaatcaacccgaatggaatggaatggaaggaatggaatggaatggaatgaaatggaatggaatggaatggaatgcaaaggaatcaacacgagtggaatggaatggaatggaatggaatgcaatggattggaatcaagtcgagtacaatggaatggaatggaatggaatggaatggaatggaatggaatggaatggaatggaatggaatggagtggaatcaacccgagtggaatggaatggaatggaatggaatggaatggaagggaagggaagggaagggaatgcaatggaatcaactgtaatggaatggtatggaatcgaatggaaaggaagggaatggaatggaatgagatggaatcaacgcgagttgaatgcaatggaatggaaaggaatggaatggaatggaatggaatggaatggaatggagttgaatggaatggaatcaactggaatggaatggaatggaatggaatggaatggaaaggaatggaatggaatggattggaattaacccgagtggaatggaatggaatggaatggaaaggaatcacttggaatgcaatggtgtttaatggaatggaatggaattggacggaatggaatggagtggaatcaacaccagtggaatggaatggaccggaatggaaaggaatggaacggaaggaatggaatggaatggaatgcaatggaatggaagggaatggaagaaagctgagtggaatggaatggaatgggatggaatggaatggaatcaagcgtaaaggaattgaatgcaaggcaatggaatcgaatcaacccgaaagaaatggattacaatttaatggagtggaatggaatggaatggaatggtatggaatgggatggaatcaacacaagtggaatggaatggaatggaatggaaatggaatggagtggaatggaatcaacccgagtggaatggaatggaatggaatggaatggaatggaatcaacccgagtggaacggaatggaatggaatggaatggaatggaatggaatggaatggaatggcatggaatggaatggaatggaatggagtggaatcaaccagagtggaatggaatgcaaggaatggaatggaatggaatggaatagaatggaatggaatggaatggaatggaatcaacatgagtggaaaggaatggaatggaatagaatggattggaatcaacccgagtggaatggaaaggaatggaatggaatggaatggattggaagggaataaacccgtttcgattggaatggaatggaatagaatggaatggaatggaatggaatcaacccgagtggaatggaaaggaatggaatggaatggaatggaatggaatgcaatggaatggaaacaacacgagtgcaatggaattgaatggaatggcatggaatggaatggaattgaatggaatggagtggaatcaaccccagtggaatggaatgcaaggaatggaattgaatggaatgaaatggaatggaatggaatggaatggaatggaatggaatggaatggaatcaacacgagtggaatggaatggaatggaatgcaatggattggaatcatgtcgagtacaatggaatggaatggaatggaacggaatgaaatggagtggaatcaaccagagagaaatggaatggaatggaatggaatggaatggaatggaatggaatggaatggaatcgaatgcaatggaatcaagtgtaatggaatggtatggaatggaatggaaaggaatggaatggaatggaatggaatggaatgggatcaactggaatgtaacggaatggaacggaatggaatggaatggaatggaatggaacggaacggaatggaatggaatggaatggaatggaatggaatggaacggaatccactcgacttcaatggagtggaatggaatggaatggaatggaaagcaatggaattgaatggattggaatcaacccgagtggaatggaatggaatggaatggaatggaatggaatggaatggaatcacctggaaagcaatgtggaatggaatggaatggaatggaatggaaaggaatggaatggaatggaatcacccagagtggaaagtaatgtattggaatggaatgaaatggaatggaatggaatcaatccgagtggaacggtgtggcatggaatggaatggaatggaatggaatggaatggaatggaatggaatggaatggaaaggaatcaacccgtgtggattgcaaacgaatagaatggaatggattggaatgaaatggcatggaatcaacacgagtggcatggaatggaagagtggaatggagtggaatggagttgaatggaatggaatggaatggaatggaatggaatggaatttaatgcaatcaacccgagtggaatggtggggaatggaatggaatggaatggaatggaagggaatggaatggaatggaatggaatgcaaaggaataaattggaatgcaatggagtcaactcgagtggaatggaatggaatggaatggaatgaaatagaatggaatcaatcccagtggagtgcaatggaatggaatggaatagaaagaaatggaagggaatcaaaccgagtgaaatgggaaggaatggaatggaatggaatggaatggaatggaatggaatggaatggaatcaatccaatggatcggaatggaaaggaatggaatggaatagaatcaaccggagtggaatggaatggattggaatggaatggaatggaatcaaaccaagtggaatggaatatattggaattgaatggaattgaatcaacccaagtggaatggaatggaatggaatggaatggaatggataggaatggaatggaacagaatgtagtcaacccgagtggaatggaatgcaatggattggaatggaatgtaatggaatcgacccgagtggaatggaatggaatggaaaggaatcaaccagagtggaattggaatcaacccgagtggaatggaatggaaagaatggaatggaatggaaagaaatggaatggaatgaaatggaatggaatcaacacgagtggaatggaatggaatggaatggaatgcaatgcattggaatcaagtcaagtacaatggaatggaatggaatggaatggaatggaatggaatggaatggactggaatcaacccgagtggaatggcatggaatcgaatggaatggaagggaagggaagggaagagaatgcaatggaatcaacttggaatggaatggaatgcaatggaaaggaatggaatggaatggattggaatcaacccgagtggaatggaatggaatggaatggaacggaatcacctggaatgcaatggtgtttaatggaatggaatggaattgaatggaatggaatagaatggagtggaatcaaccccagtggaatggaatggaccggaatggaaaggaatggaatggagtcaactggtatgacatggtatttaatggcatggaaaggaatggaatggaatggaaacaaccagagtggaaatcaatggaatggaacggaatggaatgtaaggaatggaatggaattgaatggagtcaacgcgattggaatgaaatggaatggaactgaatggaatggaatggaatggagtggaaaggaatcaacccaagtggaatggaatggattggaatggaatgctatggaattgaatggagaggaatcaaaccgagtggaatggaatggaatggaatggaaatggaatgagacggaatggaatggaatgaaactggaatggaatggaatggaaagggaaggaatggaatggaatggaatggaatggaatggaatggaatggaatcaacccgaatggaatgcagtggaatggaatggaatggaatggaatggaatggaatggaatggaatggaatgcaatggaatggaatacaatggaatggaatcaacacgattggaatggaatggaatggaatggaatcaacccgagtgtattagaatggattggaatggaatggagtggaatggaaacaacccgagtggaatggaatggaatggaatggaatgcaatggaatggaatggaacggaatcaacccgatggaatggaatgcaaggaatggaatggaatggaatggaatggaaaccacactagtggaatggagtggaatggaatgcaatgggttggaatcaagtcgagtaaaatggaatggaatggaatggagtggaatcaacccgagtggaatggaatggaaaggaatggaatggaatggaatggaatggaatggaatggaatggaaaggaatggaatggaatggaatggaaaggaatggaatggaatggaatggaatggaatggaatggaaaggaatggaatggaatggaatggaatggaatggaatggaaaggagcaaggaaaggaatggaatggaatggaaacaaccacagtggaattcaatggaatggaacggaatggaatggaagaaacggaatggaagtgaaaggagtcaacgcgattggaatgaaatggaatggaacggaatggaatagaatggaatggaatcaacccaactggaatggaatggaatggaatggaatggaatggaatggaatggaatggaaagaaatcaacccgttggcatggaatggaatagaatggaatggaatgcaatggaatggaatggaatggaatagaagggaatggaatggaatcaaacgaagtggaaagcaatggaatggaatggaaacgaatgttactgaatggaatggaatcaacacgaatgaaaaggaatcgaaaggaatggaatggaattgcatggaatggaatggtatagaaccaaaacgagtggaatggaatggaatagaaaggaatggaatggaatacaatcaaaaaaccagatggaatgaaatggaatggaatggaatggaatggaatggaatggaatggaatggaatggaatggaatggaatggaatggaattccacgagaggaatggaattgaatggaatggaatggaatggaatgggatggaatggaattgaatggactgaagcccagtggaaaagaatggaatggaatgaaatggaatgcaatgcaatggaatggaaaggaatcaaccgtattggaatggaatggaatggaacggaatggaatggaatggaatggaatggaatcaacccgaaatggattggaatgaaatggaatgaacccgagtggaatgcaacggaatggaaaggaatggaatggaatggaatggaatggaatgaaatggaatggaatccactcgactgcaatgaagtggaatggaatggaatggaatggaatggatcagaatcaaccagaatggaatggaatggaatggaatggaatggaatggaatggaatggaatggaatcacctggaatgcaatggtgtttaatggaatggaatggaattgaatggaatggaatgcagtggaatcaaccccagtggaatggaatggaatggaatggaaaggaatggaatggagtcaactggaatgacatggtatttaatggcatggaaaggaatggaatggaatgcaaacaaccaaagcggaattcattggaatggaacggaatggaatggaaggaatggaatggaattgaatggatggaatggaatgcaatggattggattagaatggaatggaatctacccgagtggaatggaatgaaatcgaatggaatggaatggaatggaatggaatggaatggaatggaatggaatggaatggaatggaatggaatggaatcaaccagagtggaatgtaatgtattggaatggaatgaaatggaatggaatggaatcaacccgagtggaatatggaatggagtggaatgtaatggaatggaatggaatggaatggaatggaatggaatggaatggaatggactgaaccactgtggaaaagaatggaatggaatgatatggaatgcaatggaatggaaaggaatcaactgtattggaatggaatggaatggagcagaatggaatggaatggaatggaatggactgaaacccagtggaaaagaatggaatggaatgatatggaatgcaatggaatggaaaggaatcaactgtattggaatggaatggaatggagtggaatggaatggaatggaatggaatggaatggaatcaacccgagttggaatggaaaggaatggaaagaatggaatggaatggaatggaatggaatggaatggaatggaatggaatggaatggaatcaatccaagaggaaaggaatggaatggaatgggatagaatggagtggaatcacccaagtggaatggaatggaatggagtggaatggaatcaaccagaatggaatggaacgaattggaatggaatggaatggaatggaatcaagccgagtagcacggaatgtaatggaatggaagggaatggaatggaatggaaaggaatggagtggaatctaatcaagtggaatggaatgcaatggaatggaatggagtggaatctaataaagtggaatggaatgcaatggaatggaatggaatggaagcaagttgagtggaatggaatggaatggaatggaatggaatggaatggaatggaatggaatggaatacaatggaatcaagctacaatggaatggaatagaatggaatggaatggaatcgaatggaatggaatggaatggaatccacataagtggaatggaatggaatggaatgggaaggaatggaatggaatggaatggaatggaatggagtggaatcaacccgaatggaatgcagtgcaatggaacagaatggaacggaaaggaatggaaaggaatgcaatggaatggaacggaatcaacacgattggaatggaatggaatggaatggaatggaatggaaaggaatggaatggaataaacacgagtgtattagaatggattggaatggaatggagtggaatggaatgaacccgagtggaatggaatgaaatggaatggaatcaactc

SEQ ID NO: 470903 - DNA, 816 bp, Homo sapiens
cacttggacagagggagctgctcctggcctcttacaggggcaggaatccttccatcctcatgacctggtcacctccccaaggccccagctccttataccttcaccttggttcaggtttcagcagaggaatttggagaggggcacacaaacattcagtgcattgctgtgggcttatatcttcttttgcgtcttctggccccttaaaagtgagagatgaggggactcagcccagcaagggcagagcagatggagcggctgtggagaatgcaggaaggagaggaatccgggacgcccctcagtgcctgctgctgctgacatggagaagactcggatcaagagtcaggcgcaaggtggctttcaacatccaagtggagaaggtatcaaaagtcaacctgctgcccacccgcattcacagcagcactctgaacaatagcagaaaggtggaagcaacccaagcatccatctacagataactggataaacaaaacatgattcatttatataatgggatcttattcaactttaaaaaggaaagaaattctgacaacagtgctacaacctggatgaaccttgaggacgttatgctgagtgaagtaagccagacacagaaagacaaatcctgtgtgattgcacctacatgaggtagtagagtagtcagattcatagagacagaaagtagaatggtggttgccaggggctgggggaaggggaaaatggggagttagtgtttaatggggacagagtttaagttttgcaagatgagaaagtaaagctccctgaggccccttggaagccaagcagatgctggcactatgg

SEQ ID NO: 470904 - DNA, 540 bp, Homo sapiens
ttccacagcccaaatggcgggacagtccaggggctccaagaccaacaggagcatgtggtacccaagtcacaacccaagaccatgtggcatcagatctctctcgggctcaccctgcgcttgtgggacatgtatttgctggaaggacaggtgttgatgccgatcagaagcattgcttttaaggttcagaagaagcgcctcatgaagacatccaggtctggccttttggcatgttttcggaaccagttcttccatacctgggccacggacgatgacactgtgctcaagcatcttagggcctctacgaagaaactaacaaggaagcaaggggacctgccacccccaagtgggctccagtgccatgtcccctcccatgtcaccctctggggcagtcaatacgtccctttagcagatgctgcagatgaagtttcacaccgtgccacagaaaaggcaaagccggcaagcaaggtaaaggggggaggtttggaactgatggcaatcagctcaacagtgcaagaaaaatgagttttcttttgaaaagac

SEQ ID NO: 470905 - DNA, 1335 bp, Homo sapiens
ggtgtattgttttaaacattagattgattctcagacttgccttaaaacaagaaaatgaggagaaaagaaatgccgatatgttgtataataaagatagtgaacagttaagaataaaagaagaggagtgtgggaaagtggttgaaacaaagcaacaacttaaatggaatctgagaagacttgttaaggaattgaggacagtaagaaataacttggatctgatttctcataggcatcagaaagaaaaggatctctttcatgaaaattgcatgttgcaggaagaaattgccttgctgagactggaaatagatacaataaaaaatcagaacaagcaaaaggaaaagaaatattttgaggacattgaggttgtgaaagaaaagaatgataaccttcaaaaaattataaaacgaaatgaggaaacattaacagaaacaatactccagtacagtggacagctgaacaatctgacagctgagaacaaaatgctcaattctgaactggagaatgggaaagagaaccaagaaagactagaaatagaaatggaatcataccgttgtagactggctgctgctgtacatgactgtgatcaaagtcagacagcaagagacctaaaacttgatttccagagaacaagacaagagtgggttcgtttacatgacaaaatgaaggttgatatgtctggcctacaagctaagaatgagattctttctgaaaaactttctaatgctgaaagtaaaattaacagcctacaaattcagctccataacacaagagatgctcttggaagagagagtttgattttggaacgtgtgcaaagagacctcagccaaacacagtgtcagaagaaagaaactgaacaaatgtaccaaagcaaactgaagaaatacattgccaagcaggaatctgtagaggagagattatctcaactacaaagtgaaaatatgttgcttcgacagcaactggatgatgttcacaagaaagctaacagtcaagaaaagacaatcagtactatccaagaccagtttcattctgctgccaaaaatcttcaagctgagagtgaaaagcagattctttcactacaagagaagaacaaggagctgatggatgaatataatcatttaaaagaaagaatggatcaatgtgagaaagagaaagcaggaagaaaacctctaatacccacagttctactctctacttccgtgaacgtttttttaaattttagctcccacatgagtgaaaacatacagtagttatttttctgtgcttgaattatttcacttagtgtcacttaatggcctcatccatgctgtaaatgatatgattttattctttttttat

SEQ ID NO: 470906 - DNA, 2340 bp, Homo sapiens
gcaacacaaagcatgagggcaggccgggaaaccacagtgggtgtggaggccctaccatgcaatccagctcgagtggagaaaatcgccttctagagtctggagtccgagaagaggaaaaccatcccttacttggaagctatgagaagaaggaggccactgctgtcactgccactgccacctcctcagctcgtcaatgccgctggcagtgtagcccccatggcacccctaatctgccccctgccactagcatctccgacgtcaccaccaaccacagcgaggcaagccatggtggcacaggttccagcctccagcatgtggcagtgcctcttccttctagtcctccagcctggcaggagaagctcctgctgctgaccgctctcctactgctctatcgccactaccaaccgcagcgaggtagtgacccaggctccaggctccatccatcctccaccctccagcaggtggaaggttgcggcttcttccagttctctaagctggacacagagttgctcctccgctggacacagaagagcctgaaatgacctgacgccacctcagcatgctttatatatgagtgttgtatttgtgcatatactttaatagccctgagttttaataaagttgcttttaaaaaatgtatcttatatttcagaaatacaccctaaggcatgtgattagttgggtggcatgttgtttagtttttacaattgaaggattgtcattcctttgtacaaaaaaaaaaaaaattaaacgtgaatttttatcatatgctagaggaaagaaggcagatactaaataataaatattgtatgcttccacgtaaataaaatttgaaattatataaagacaatgcattaaacttttctggggttgaagtggggaattcactggcaaaggtcttgcaataaatgtgtaggtgaagggaatattctatatttgattgtgtaggtggttatctagctttataaatttgtaaaactgaactggactaaaatgtgtgccttatacgcagattattctataaaactgattaaaactagttagagaatcagtcaaggggaaaagaaagaaaaggcacgtgaaaaaatgccaatgcactagaattatctttgatgacattaaatatagcctggtcttctcttaattctttttaaaatttacgtagatttctcaatcctttgatactttttcctcaacacatcttatattctcatatatgttaatgtatggctacataagagagggctctcttacagttggactggaacagcttgatatttatatctagagatgcatcggaagcataacactgacccgtgagcaagatgaaaatggcatgtgctagttagtgattcctaatgttgctttaagtttagtgccaactggtctacatcgttgagaatgtttagtttgatggtttacacaacttggcttaagaagtatatgaccaacaatgtatgagggagcctgctgtaaagacttttctgcacttccctttaattattatagtaagctcaaatcttgaaggttcataatatacagataaactgtgtccgtgagactgagaaaggatctttagggagaaaggccctgttcctgaaagacagacattcaatgatttcctgcattttatttctgttgtactttacctttacctttattaaacactaataaggtggttcttacagggcctcataggcctttttagttttccaacctattcatacttggtgcaaacctagtaattttttgcgtgatagtgttgggattttactctgaggctaggcttcacactgtaaaaacagctttttggaattgtatcattttcagtcttcccatcgtgttccactgtcccagccacacacacaccagatatgaagactacaagcaaccgcgaaaggtgtaacacatgtatagtagatgtttttacctcttgtaaaatctaaggaaaatatactaaaaatgaaggcatcagtaaaacagtatcattttaggttgacctcgagtatttcaacatcagtctagcttcagaacaatacatttgcaaggggaaatggtgtacttttgtggtttttttacacctgttatttcaattgaaattgaaaaaaactaatttgaactaactataaccccataaaagaaggttttgttcagtattgaaataaaataaaatgcatttgtgggactgacctcaggacgcattttaaatagtcaatactacctctaaatctcattcccccttctctgagcatcagctttattcttattccatctttaatttggcactgacagatacagactcattcttacaacatataccatcagaagtgaaacctcact

SEQ ID NO: 470907 - DNA, 2689 bp, Homo sapiens
agcagtctgggccgagacagcatgagctggggccctggggaggaggccccagacatcactcctgaagaggccctgcctgagctgccccctggggagccggagttccgttgccctgaacgcgtgatggatctcggcctgtctgaggaccacttctcccgccctgtgctgcggcaggtgatcgaggagtgcaagcaggtgattctggagctgcccgagcagtcggagaagcagaaggatgccgtggagaagagcaagagcgtcaagcagacctgtgataagtgtaacaccatcatctgggggctcattcagacctggtacacctgcacagggtgttattactgctgtcacagcaagtgcttgaacctcatctccaagccctgtgtgagctccaaagtcagccaccaagctgaatacgaacttaacatctgccctgagacagggctggacagccaggattaccgctgtgctgagtgccaggcgcccatctctctgcagggtgtgcccagtgaggccaggcagtgtgactacaccggccagtactactgcagccattgccactggaacgacctggctgtcatccctgcatgcattgtacgcaactgggactttgcacctcgaaaggtttctcgctgcagcatgtgctacctggcgctgatggtgtctcggcccgtgctcaggctccgggagatcaaccttctgctgttcaactacgtggaggagctggtggagatttgcaagctgcgccaggacatcctgctcatgaagcggtacttcatcacttgcagggaggccatggaggctcgtctgttgctgcagctccaggatcagcagcattttgtggagaacgatgagatgtactctgtccaggacctcctggacgtgcatgccggccacctgggctgctcactcaccgagactcacacgctcttcaccaagcacatcaagctggaacgcgagcggtgccaggccaagggcttcgtgtgtgagctctgcagagagggcgatgtgctgttcccattcgacagccacacgtctgtatgcaccgactgctccaccgtcttccacagggactgctactacgacaactccaccacgtgtcccaagtgtgcccagctcagcctgaggaagcagtcactcttccaggagccaggtcctgacgtggaggcctagcgctgaggaacagtgctgggcaccccacctggcccaccgggacccaccctgccaacgtcaagttgttcgttctgctctggagacccctgggttgcggcccctggacccctccacccctgctgggccagagcgggtgggcagtgtcaaggcccgttgtctcccaggtgcttgctgggactcggggtggccgcacctggctgtcacctgggtgtgctgctgtgaggggtccttgcgtggcccccatccttcccccagtgcagaactccatgggcagggagttggggggatatctcacctcccccatggcacagagccctccacactcctgaaccagagcatccgggccctagagattccacagttcccatcctgaccaccctggaaactcatcaggccaagaccccgagagagcttcagaggagtgttgagtaacacctgaggatgcggctgcacacactcagccaagggccgagtctcacctgcagtggggtttcggctctgcctgggggctccatcactttcagccactcgtcgccttggggatttctggttgtccccagctggggctgttcacagttgtcacctgtagacctgcctctccctggcctgaggttcaaaggcctcattgggtggtcagtccagtggggtcacctgttgttcctgtacaacagcaaggaaggggaccatggagcttttccctgctgggtgctcctgctttggcccagcccagctttcctggtgctccaagctaggaggccatggccccagcctaaagagggtgtcctggtctccaggtgtggagcaaggactgtgcactgggggaggttccagttaggtgatgggatcctgcagtggtctggtggcatttcttggaaccagatttacccaaggagatctgtcctgctgcctgtggagggctccagatagctcagaaatgaccagccaatggccttttgtttgggggcctgagatcaagagctgagagtattcactcgactgagcccattcaggaagatcagggcaggggcgtgtgggaggtccctcactccacgggacagaggcccctggacagcagaggaaacctacagctctggtggtgttttgaatatttcttcatggaaagcttaggacatttttaatttttttgtttcagattcaggggtcaatttttcctttattttgaactaattatgcatacatatgaacaattgttttctgaagttactttcacagggaagacctttactgaattttcttaatgttgtttttcaaggtactggcttatgtttccaagaaacaaataaagataattttactttgtttttaatgtttatgcttcttgttgtactcccttctctaagttaatgtgcctgataacttttgaaagtaagaatagagacacaggaaagaggccagaaggttggaataagggctaaataaagaaacttattgccaccaaaataaagacgaatccaggttaatcctctctggtattgacttgtgagaaaagatggacatc

SEQ ID NO: 470908 - DNA, 604 bp, Homo sapiens
gtattttaaatgaatgccacctgtcataattttaagacttttgcttgacactggggccacctgggagtcagattgctcccagcagcaggagcgtggtactgaggctgggcagtctctgctgcctcatctccatggcgcccctgtatccaactgtattcaaagctctctagccttctgtcattttgaggccaacgtgatgctggggctgctagttgccatttatctgggccaccatgtgctgagaccccacctggctcctggggagccttcctgctggctcctggggagtcttcccggtcctggctgcagggcctcttcagatctgctggtccctttgctggggcagggtgggcaggcagcctctgcgccctctctcaggggtgtggcctgcacgctgcatgtccacgctcgtgtactctcttcctttgtgcccacgtcttgctgggtccagagacacccctcagtccagattggaggcattaatttcattcacgagggcagagcactcatgacctaatcaccaccttgaaggcctcacttcttaacatcattgcattaggtcttaggttataacatgaattttggaggactcaagaaaaaaaaa

SEQ ID NO: 470909 - DNA, 2391 bp, Homo sapiens
tctagaggatttagagaactataaaggtgatatttcaaagcgatggagaaaagaaggaatggaacacgtctacactgctggtgggaatgtaaactagtagagccccaatggaaaacagtgtggaaattccttaaagaactaaaagtagaactactacttgatccagcaatcccactgctgggtatccaccgagaagaaaagaagtcgaaaaagatgctgtacacgcatgtttatagcagcacaattcacaactgcaaaatcatggaaccaacccaaatgcccatcaatcaactagtggataaagcaactgtggtatacctatatgtaatggaatactactcatccataaaaaggaatgaattaattgcatttgcagtgacctggatgagactggagactattattctaagtgaagtaactcaggaatggaaaaaccgaatgtcctgtgttctcactaatatgtgggagctaagctatgaggacacaaaggcaaaagaatgatacaatggactttggggacttgtggggaagagtggaagtgggcgagggattaaagacaacatatatggtgcagtgtatactgctcggtgatgggtgcacaaggatttcacaaatcaccactaaagaacttactcatgtaacctaataccacctgtaccccaataacttatggaaagtaaataatgaaaaataaaaataataaaatgatatttggaaacattacccacagaaagtgaaacagaatttgaagtctgatattagtgaggtttattgtctgctagacaaacaaaatagcagcattctccagaggattataacaagatccagagtctcacgacatgattttcaaaatgttcaaaagacaacattagttattttgatgtacaaaagaactaggaaaataaccaattgtaaaggattatcttttgataaccaacagatatcatcctgagatccctagaggttggaattatcaaagacttcaaatcatctattataattacattccatgaagtaaaggtaaacactcttgaaataaatcagaagtaaaagccctaggcatagaaatagaagttatgcaaaagaaccaaatggaaatttttataattgaaaaatataatctctgaaataaaaaatttactgaatggactcattagcaaaatggatagaactgaggacagtcaatgaacttgaagcttgaatcttttcagattgtttcatgtgttctttttaattaaatgcgagaaatacagaacaatactattaagaaaattataattatctacaactccaactctaagaaataaccactgttagcactttatcatatttccatctggtattttctgttctctctgtgtgtatgtgtatttggatatatatttgcatgtattatatcgcatgtatgattttgtatcctgttctctcaaaactgttacatcaatagcatttttaatttatattttttaaatgatgattttagtgagtatatttaattatatgaatatactacaatttaattaataattccttaactattatgcaataggttgtagaaaatcattagttccatgattcaaccaatgttttgaagctcttacctacagttcaaggtcctgttcttgttagttggaataaaataatggctttgacagtcagggttcctcttctaatgtaacttcttaaacaggattgtaattggtactttacatttttgttcacatctctaattatttttagaataaattcttacaagcagtattataaggttgaaagacaggaatatttttactattctttaaacctaaataaactgctcaaatacattttcaaaggccatatcaatttatgtctttcatgtgaatgggaatatttcattatctcactggaccttcacacacatcacatatataatttttgagagaaacttcttgctgtgatttcatattttttattgctagttgaacacattttccatacttatatttctcttttattttttcttattaaactgttctaattactttctcattgattgacataaacttttcatatattaaggatattgagccttttctgccatatatgttgcaaatgttttcactttttttattatttgttatttatgttttgacataaaaaagtttaaaattttatccagtcaattatatcgtttgcttccttagagatatctcccattagttttaaacatgaacagtttgccttatcaaggatgggacaattattcatttatattttcttccaatttatttcttttttaatgggaatctttaattcatctagattttagattttattttgatgtttagttttatatgaggatctaaattgatttctttttcctcataaacttagcctattttcccagaa

SEQ ID NO: 470910 - DNA, 1089 bp, Homo sapiens
gagactttctacatgccagactgggtttaggtggactgggtatgttaaacccagagaagagaggacttcgattcgagattgcaactaccttcgcaaaacagaagacccacggtgactgtaagctttattcaacattaaaacgttggtgccaacttggatgtagggccaagcatagcgtagttgggaaattgtctgccctgagcaggcatggagcaggggaagatgagatgggacagatagaagcaccagcagtatgtaaaggaaatgagagagagcaagccagagggctgtcttggagaagaggtttcccgacagagacaacagtgaatgtaaagggcccaggtggcagtgtgaccagcttgttgaaggagaccaaggagacaggcagtctgcaaatatttgcccttctggaaacaccctctacctgcctttgtcttgctctctgcccgaagaagctggcctatgaggaaatctttggtgttctcctgtgtcctatggcttcaaggggcaagcattgtccagccttggtagcagcagaaattttgcaggaagaggaatgacaggttctcagagagagagagagagagagagagagcttgctgccttttattcttggcttccctatggattcagtcaatggctttgaacctcagactgcatagagtccccaattcactgttagtcttcatacgtttgccccttaggacaaattaataaaaattttaaaagaacagaaaaagcattaaatgaatatatttttgcggtcgtttgaaggtctgtaatgagaacagaaaatacataattgaacacagagtagtacaagaactgactgttttgatctcctacaatgaggtgccagcagctgaaaataaaaggaacattgataagattctattctgaaacatatagaatcaaaaggagtgggttgtgttgatcacactgccccatctaattcttctcatatttaatatgagattccttatttcaaagggaaagccatatttatctctttctttagagtctagttcccctcattagttcattcattcaaccactcaattaatacttattgagtgccaaacagtgtac

SEQ ID NO: 470911 - DNA, 2238 bp, Homo sapiens
agcagctgaagactgacactacccgatcgcctcagaagccccctagaccatcatggacgccgagctttaagtaactctcacagtagaaactaagtccgtccccttcttaatcaatatggaggctacccacaccacattaccttcttctcaaaggcctatacctagttttgccatcctaacaaaaccattatataaactcacaaaaggaaacctagctgaccccatagatcctaaatcctttccccactcctctttccattccttgaagacagctttagagactgcccccacactagttctccctgactcatcccaacccttttcattacacacagccgaagtgccgggctgtgcagtcagaattcttacacaaggaccgggattgtgtcctgtagcctttttgtccaaacaacttgaccttaccgttttaggctggccatcatgtctccgtgcagcggctgctgccgccctaatacttttagaggcccttaaaatcacaagctatgctcaactcactctctacagctctcataatttccaaaatctgttttcttcctcacacctgacgcatatactttctgctccccggctccttcagctgtactcactcttcgttgagtctctcacaattaccattgttcctggcccggacttcaatccggcctcccacattattcctgataccacacctgaccctcatgactgcatctctctgatccacctgacataatgttcagtggaatccttgaaaccacatgtttttctcttattactagctttttagcaaaaacataatatttacattttgatagatgagaacaaaataagagtgaaatgccacactgaattacaggcttgagcagaattacctaaaaggtatgtccaatattcagtatggccttgaatactgaaacattaaccaattagcaaaccttcagctggtttgaaatgttaagcattcctcttcaggttaggtgagaagaataagaatcccaggaataagttaaaactgagaaatagaattagaaccataattagaatcagattggagataagacggtacaaactgtaatctatgtgttttgataaacaattcattgtatgggcagtactgaattttgtaactgtatcatgtttctgctttttaagatatgcttttgataaaagatataggagaatctggtatgtcagtcatctaaaaattcaagtgccttaatttataaacatattaaacatttaagaaaatataaattatgttttgatttgaaattagtgtttgattagaatgatgttaaagataatagactatcaatcagacaaaaatccaacaaaataatctttatttagtaaataatctttcccttacaaaattgtctaatagtgtagattctatcaataactttttttcttatgaactctccatgtgctttgcacatttggctgtcctgttgttactatttttcttcttaaaaatatgagctttcacaaatttaaaaaattagcattgtccttcatacattgttcaaagattttccctcatcgctgcttgccactatactcagtttttagcacttttgataaacagaagattttggggtttcatttgtcttaaatgttacaaaatcaacattttcatccattttctttatgactttaatgcattaaagtttatcaaataacatttattgacatttctcaatgatcaactacaaaaccaaaataatagatttttctttatgtatgacatataaataacttcagatccttgtgatgtttcctcattcaagtttatttatacttaaaatttgatatgaaattagtagtttatatttaacatctgatatcaaatgaatcttgttcattcagagaaggtaattatttcacaaattttcttagaaaatatgcacatttgaatattaccattgcgcaccaaggagactttggctggatatacaattttcagattattagccattttatctaagtatttagagattgacataggtcttacagaaacttgatattatgagaagtctgaagttagtgtgttttgtttagtttttaaaaattttgttatgcaattccatacaggattctaaacttttatcattaaaattataaaggaaaagctaagaaatatctagatgaggtttctttgattaactttgcacaagcagcgtttcttttctaattgtagcttgggaattttttttttcagttttggaattctttctatgt

SEQ ID NO: 470912 - DNA, 3704 bp, Homo sapiens
tcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcagggaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagatcaggaaaacggaatgacatcgagctacacgctgtcatcagacagtcaggaaaaccgtgaattacgtcgagctaaacggagcatgacagtaagatttctcagagaccttcatacacccacgtgcaccatgtacctccaagaaagggtggattatgcagtatttcctaaattcgatggtgggaatgctctcacctccccagtgggaatgctctcacctcgccagtgggaatgctctcccctccccagtgggaatgctctcacctccccagtgggaatgttcacctccctagtgggaatgctccctccccagtgggaatgctctcacctctccagtgggaatgctctcacctctccagtgggaatgctctcacctccccagtgggaatgttcccctccccagtgggaatgctctcacctccccagtgggaatgttcccctccccagtgggaatgctctcacctccccagtgggaatgttctcacctccccagtgggaatgttctcacctccccagtgggaatgttcacctccccagtgggaatgttctcacctccccagtgggaatgttctcacctccccagtgggaatgttcacctccctagtgggaatgctccctccccagtgggaatgttcccctccccagtgggaatgctctcacctccccagtgggaatgttctcacctccccagtgggaatgttcacctccccagtgggaatgctctcacctccccagtgggaatgttctcatctccccagtgggaatgctctcacctccgcagtgggaatgttccctagtgcaaagggcagattggaggctgggtcgccagaagcagatgagccctcgttcctgccttcgtatgtgctggtgttttcaaagtttccccacttgtttttcactggatagaggcttttcttccacaaatttctcaatttggtttgaattttatgttcctcaaggaagtggcaagagggtgcccttgtacacagttga

SEQ ID NO: 470913 - DNA, 1397 bp, Homo sapiens
tttcagaggagccggtgggggatgaggagcccgtgggggatgaggagccggagggggttgaggagcccatgggggatggggaaccagtgggggatggggaacctggtgggggatggggaactcgtgggggatgaggaacccatgggggatgaggagcctgtgggggatggggagcccctgggggatgaggaacccggtgggggatgaggaacccggtgggggatgaggagccggagggggttgaggagcccgtgggggatggggaacccgtgggggatgaggagccggagggggttgaggagcccgtgggggatggggagcccgtgggggatggggagtccggtgggggatggggagtccggtgggggatggggaacccgtgggggatggggagtctggtgggggatggggaacccgtgggggatgaggaacccgtgggggatggggagcccgtgggggatggggaacccggtgggggatggggagcccgtgggggatggggagtccggtgggggatggggagtccggtgggggatggggaacccgtgggggatggggagtctggtgggggatggggaacccgtgggggatggggaacccgtgggggatggggagcccgtgggggatggggaacccgtgggggatggggaacccggtgggggatgaggagcccgtggggggtggggaacccgtgggggatgagaagctggagggggatggggaacccatgggggatggggaacccgtgggggatgagaagctggagggggacgaggagcccatgggggatggggaacccattggggatggggaacccgtgggggatgagaagctggagggggatggggagcccgtgggggatgggaaacccatgggggatggggaacccgtgggggatgaggaacccgtgggggatggggaacccactggagcaaatcacacccggctggccaataacaacactccacaggccgacaacaacaccccacaggccgacaacaacaccccacaggccgacaacaccccacgggctgataacacctgacaggccaataacaccccacaggctgataacaccccacaggccgaaaacaacacccgcaggccgaaaacaacacccacaggccaacaacaccccacaggctgataacacccctcaggccaataacaacaccccacaggccgataacaccccacaggccgaaaacaacaccccacaggccaataacaccccacaggccgataacaccccacaggctgacaacaccccacaggctgacaacacccacaggccaacaacaccccacaggccgataacaccccacaggctgataaaaacaccccacaggctgataacagcaggggattctttagagtcgaaaacgcagttagcaaga

SEQ ID NO: 470914 - DNA, 694 bp, Homo sapiens
ctcaccttccttttccacctacacggttgccacccccttctgacctccagccttttcccaggcccagcttcaggctcacctgcaggaagagagatgtcctctttgttgggtcccagtgaaactccaccatgttgagttgtgagagcagcacttggggttctatcactcccacggacagtggcacatctgcaggcacagggtggcaagcagggagccaggctcagccttcccagtccacaaggactcctgagccagagctcaggctcgaagggcccccggcctttccccactcatcgatgtccaggatgcggtccctgggcccggctccacctccacccagccagctgccgctgctgctctgtgtactgcagaccttccctctggggaacccacagtttcctgtagcaggtccccaagctgcagccagggccaaagggacccccattcagctcctcaggcctccaggaggcctccctgaagagttcaagcccagctgtgtggccttgggcaagtgacttaacctttctgagcctcttgttgcaactgcataagggggatgatgagagcttttaccccagaagtaaagacaataattgagccctcaataaatattcccctttactccatcgtttccccagggcctagtacatcaaaggtttatttaacacttaaggatataggtttatttgtataa

SEQ ID NO: 470915 - DNA, 511 bp, Homo sapiens
ccccagggcccagcacggggcctggctccgagcagcttgaccaatgaggtggtccatatgtgtcccaccattggcagcaacgtggaggagatcattctgccgaagacccacttcttcatgtgggacatagtgagacctgaggctctgagctttatctggaacacatactactccaacactgagtttatcatccttgtgattgacagcacggaccgggatcggctgctgaccactcgggaggagctatataaaatgctggcccatgaggctctacaggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggttagtggctgccctacctggatctctagggcctggctgaaccaatggatgactgaccatcagaacccttctcctgcctctctcctgtgaga

SEQ ID NO: 470916 - DNA, 658 bp, Homo sapiens
ggtcctgcagcatgtaggctgacagcaaggggaacagcagtgggtcatggtgtcaggggtggagggtgggtttctgttcagagcaacaagaatgctggcagcagctggacacacagcaggctgggcagtagcagggctggcagcagctggatccacagctctggttgaggcaaccaggcaggcagacagtcgtggggtggtagcaggttcttctgcagtacacaggtgcacaggagctgctctggccacagctggacccacagctggtttggccacagcagctggacccacagcagatgggctggtagcagggtgtgctgcagcaggaaggctggcagcagctggtcacacaggtgggctggcagcaggtggtcctgcagcaggtgttttgacagcaagttgggtggcagtaaggctggcagcagctggacacacagcaggagggctggcagcagggtgtgctgctgcaggtggtcacaatggtgggctgccagcaggtagtcctgcagcaagtggtcctgcagcagacaccagtcacattgaatcagaagcacaatttattccaatatgaccttatcttaccatcttgcatttaagtgaccctatttgaatatgagttcttggggacacaattcgacccataaccttggaatatctc

SEQ ID NO: 470917 - DNA, 1453 bp, Homo sapiens
gcaaattgttcattagcgtgaaccggccagaacgttggctggtgtagaacaccggacctggttggtgatgcggagccaggacaagcccggaggaaaagcagaagggccaagaaacaaggtcagcaccagcaccatggcagacggctgttgtcctggaaacaccacagccattccagctgtgcccaccatcaccacatacccagttaaaggtggatttcgacatgctctctgtttgcctagttcctgccacagcagaatgtggcaactggtcacatgccaagaaagctgtcagccatccattggtgccccaagtggctgtgatcctgcttcgtgtcaacctacccgccttccagcaacgtcttgtgtgggttttgtttgccaacctatgtgctcccacgcagcctgctatcagtctggcactggtcagtctccttgtctggttagctcatgtcagccatcctgctcggaatctacttgttgtcaggaaaagtgctgcgatgccagtccctgccagcaaagctcctgccaggaatctgtctgcatgtctggatcatgtcaggcagcttgtggccaatcagtctgctgtgatgctggatcctgccagccatcctgctctgaagtgacctcctgtccggaaacttcttgcctaccaaccatctgtacagctagtccatgccaaccaacttggtgccaaggaagttcatgtcaacccgtcagtggtgaaggccagccctgtaaatcaacttattatcaacccatctgctatattttcaagccttgccaatcagccctctacatgcctgttccctgccagccatcgacttgtgtgttcagttcttgcaatactacttgctgtgtgccttcccattgccagccacctcactgccaactggttccttccacatgcttcatctaccagccagtggctaactgccaggccccttgttccacaaagaactgttgcaaaccagcttcttgtgacactgtgatttctggccaaccaacttgtgatggacccccttcctataaccagagtggctgcaaatcagcttgctgtgtgactggtttaggcacatcacccagtagtggctccaattgcttgccgacttcatgccaacccagctgtgaggcgtgcaacgggggcgtggctcgcttcttccgtgccccactgctcacacttctaggggaagcatgcagatgggcaggctttggggctctgaccccacggcagcgtctagggcgagtttatacaatctatccaatttaggctttcttgatttatattctagaataatgtctatatttgtttatttaagtgggaatcattttaattttatttctgatttttaatcctatattttctgcattagttatctccaaacctacaatttaattaaatttatcccagcgtttgatcttagaatataacattcattcttgtttcctgcatatt

SEQ ID NO: 470918 - DNA, 472 bp, Homo sapiens
caaagtttggagggaaagagtaatgcttgggacaagactggctccagggtctattgaagttggcctggacttttggtttgctgaagcaggcccactggcacctggggccatggggatcaacctgaagcctctggctggcctggtgctgaggcagtgtggagtgggcctgaagtctggggccatggaagccagcctggtgctggggacaatctggagcctggggttttgtctggcagtatgtcaggccctaagaccaagtctgccaggcatgtgtgaagctcagggctgtgggatctggcctggcaccaggattgacagagcagcatgtggagactcactttataaacttttgctccaagaactactgcagaaacatttcaggaaagccaagagaatccacagaccctttaaaggaagcagctggctgctacaggctccatgagacagctaaaaaactgtgagtgcctgaagt

SEQ ID NO: 470919 - DNA, 616 bp, Homo sapiens
tctgcagcttcactcctgaagtcagcgagaccacaaattcaccaggaggaacaaacaactctggacacactgcctttaagagctccagcgagaccacgaacccaccagaaggaagaaactgcagacatgtccgaacatcagaaggaacaaactctggacacaccatctttaagaactgtaacactcaccgcgagggtccacggcttcattcttgaagtcagggagaccaagaacccaccaattctggacacgattcttcacctgctgactaaggaccccctgggccctgaatacccaggaagtacaccaggggccttgggctatgagacgtgctggctacaagggaaaccaagcacattctcagttgtgctggctatggtgaaagcctcctgtttgagaaaagcagagggaaaagtaaagggcactttaccttgcaccctagcatttctggactttctatgggccagagggaaacctacgtccttgaaggatgagtcccaggcttggcaccatttaccatacgctgatggaagagaccttggcctttaagtgaacattacagggtgccaagcacaactccccatggactggtgctcataatgaccacagagagagg

SEQ ID NO: 470920 - DNA, 776 bp, Homo sapiens
gtgccctggatgtgatacttggggtcaaaggagattatgttggagctttaagatttaatgactgccctgctggattttggacttgcatgggaaggccatgtatgctctgaatcagtgtccaatatatgagactgtttctttcacagctaggattcacaggtccagaaatcaaggggtgaaagtggaagtggcaccactcaccatcttccctagtgatccactagcaaaatttttgcttccttttaccgtgacattttgttctgctggcctagaggtcttagttccagagagaggaatgctgccaccaggagacacaacaaaaattccattaaactggaaattcagagtgccacttggccactttgggctcctcctacctttaaatcaacaggctaagaagggagttacagtgttcgctggggtgattaacccagactatcaagatgaaatcagtgtactactccacaatggaggcaggaatacaaatgacccagacccttcaggaataaaggttagtgttagtccaccaggaaaaaaagaaaaaaaaaaggaaaaaaaacctgctgaggtgcttgctgaaggcaaagagaatacagaatgggtagtagaagaagatactaaagcataatcaaaggatccattttataggtcgttttgctgttccttcacaggtatctaataccaggtgaactgtggaggcttacattataaattgctagtcagataattaaggtgttttttccagagagtgtgtattagtccattttcatgctgcc

SEQ ID NO: 470921 - DNA, 817 bp, Homo sapiens
tcccaatttggcttttgggtgcaactaaagttcctcactgaaatgtctcctctttcttcccaatgtgggataggactatccaggattgagccttcccagcaacaagggacaactcagggagtgggctgtaccttcatctcatctggggctaagggtctgctggagttttttggaggtccatgcgagacctgtttgcccgggtatcatcagtggaatctgcagatcagcaaacattgctgcctgttccttcctctggaagctttgtcccagaggggcacccgccaaatgccatctggagctctcctgtatgaggtgtctgtagacacctgctggcaggtaactcccagtcaggaggcatggggagcctgcaggcaagaacgtttaagtctgctgaagctgcgcccacagccaccccttcccccaggtgctctgtcccagggagatgggagttttatctataagcccctgaatggggctgcattttttcttttagagaagctctgcccagagaggaggaatctagagaggcagtctagctacagtggctatgccgagagctgtggttccatttcattgccaagcccaccagagcaggtcttctacaacactgtgctgtatgggaaaatgggacttcactcttcaccagctgacttgtccagagataaagagcactatgctttagaagtggctgaaagtagagatttttaggttttaggtgccaaaacagcattagaagcagtaaacagagctgagaatagtaaagcacactacaaatggaaaagttgagtgtaaacatagaattgaggtaactaatgat

SEQ ID NO: 470922 - DNA, 642 bp, Homo sapiens
cgcccacagcaccagtgtgaacaggtatcattcaagtgtgtggatggtcctggagaatgccacagagcaggcagggcctccgaggagacgagaatcttgaccagagctttaaattaagggatgatccaactatggcagcggaggaggcagctttgccccaggactgttgcttccagctcttctttgcacagatgcctccaagtgcccactgtgtgccagaggcaaataaaactgccaggttccctgccctcccagagagcaaagaggtatctgcacccatcctccaccctgccccccacccacaccccatcccaggcataaatcgcaaagttggccacaacccttacagcgactttcgacaaggtgctctggaaccaaggcacagcgcgggggtggggggtcacctagatgcagtgttgagctgtgctgagatcacagagatgctggcgcggctgacccctggggtgcaggaactggcagcgccccccatcctgggccagcagggtgatatgcttcagtccgcaaagccagcatctcataaaaggtcgcccctttcttatttcaacgtgcgctaatttccttcctcccctcctcttcacagcaccccatctcctggccgcttacctcgctccagacaacctg

SEQ ID NO: 470923 - DNA, 732 bp, Homo sapiens
tccctgacttcgccagctgctcctttggcacacccccaagcacccaaggactctattgccttataaggatgaaaagacccagaattggaacttgcagctctaaggaagtcccccgcgaagggagagtaagtcagtcacccggttcacctccctggagtcaaccaatgttatcagcttcttgcttattcttcaagagagattccaggcatgtacaaatacatctatctattagaaggagggctctagaggaacatcacgaggcacagcagaagaatgggcttctcttcctggttcctgagttcaattcctgttcccaggacacagctgccagcagcgtatgggagacccagtggaaattacacattacggatatagctaaagtcccttctaatggccatccctggttctataccctttctccaagagggaaccattattatgagtttgaggatgttaagaacccaagctgctattatgagagttccaacaatcatgtgacttaaaaaacaaagtttatattttatgcacataaccttgcaagacaaacacatatttaagaaatatttattggacacctattatgtgtgtagctttgtgttaaacgctggcaatacagtgacaagcaaaacagctacagttcctaccctgatagagtgtacagtctagtcaggggagcagacactaagaagtatgcttataaataaatacatacagttgttcctctgtacctgc

SEQ ID NO: 470924 - DNA, 1043 bp, Homo sapiens
gtgaccttgtaacttccccatcaagaggtggggtctaattcccctcctcttgcatctgagctggctttaagtcttccctcttaaagacgccacccctgggaaccggatgacaagctgtcagaagtccaagctacattcagcccgcgtgatctctagaataatccatgctgatgtcccctggtccatccccttgagcgtatccaagggcacagtcagtcatcccaatcccagggcaagtcggctccatcagaatgagaactgggaccacggggcacacccagatggtcactgggcactgactctgtttctagggaccctgtcctatgatggagcccaagctgcaagttcaggagcaggatgggatgagatgaaaggagaggggcagagaggaactgcctcccccaggcagttcattgcttcttctcccctctctggaatggagcaaagggagtctattctaagtgaggaagaacaaggctgtttccaatgccacatcaattaggtggtgagggagctttctttgttgagtgtttccgcttcagactaggaggcagggagggaaaagcaaattgttcaaattgtctaaaacacaatagaactacttaaagtacacgaaactagctgtcaaaattgtgaaccataatcacagttttgattgctttctgacagtgtaaaaattacaaatatttcatcaggcaagaaaagaaaaacaaagaataaatacagtcaaccccatcccccctcccatttgtgttctacgtgcccatctgaattagtttgctcatgttgacacatgcacagctttgtatcatttgagacacacgtttcttattcttcctcagtcatttagtatttaggctatagttgtagagtggttggtttctttccaggcaaccaccattgtttgaaaactatgtcaaaacagaagtctctcttcttctccctgacaacttgtcacagctatgcctctggacagcttctgcccctgtgcccctctctgtcagtgacctctcttctgccccacgaccccctctcctcttcct

SEQ ID NO: 470925 - DNA, 743 bp, Homo sapiens
ggcatggtaggagcgtgcatgatgagctctaggtgttcggggctctctggtgaacgcgcatcaccttgtttacctcctttcatactcctgtccacttcgccagctccacactgccccctggcagtgccttgtgtgcaccagaagcgcctggccagccccacggtgcgtgtccaccagtccccggacattccctccctcttcctggcccacgatgaggtgtcatttgccgcctgtcccttctctcctgtttctgatccctgggaccctgatctagggagtaaccttgatgcctacctgctgctggaggtgggcagaagagatgtgcccccagcccggacctctcagaagcggcctggctcccaggttcctgccggagctggagaaaacctagcctggtttgggcaatggttcctggggaggggggtggcctcagccttgggggttcagggaagccacggtgtggtgggcagggtgatggggactgtagcagaggatgcccgctgggaggcagaagagccctgcctgggggcaggggatgaggggtgttggtgaacgtctggggtccccgccccaggcctggggacagtaaaccctcgaaagaacttctcacccactattttccaagctttagtcacttgcattctgctttcataatgttgaccatttccaagttcccttgtatttttaaacttaaaataaagtgcatgtatcttaagtgtacagtttcatcagttttcacttgc

SEQ ID NO: 470926 - DNA, 755 bp, Homo sapiens
cccttcgaggtccttgtcccctccctgctaggttgtcaaccctggcagctgatcccccagatgctggggaggccccgggccccaggagcttctgattctgacgctcctgaagtcaaagatggggacctccatctgggtgctgggaagaaaggcagcacctggagccccaccccagacctgcagaattggaatggacatcttaacaagatccccccaccagaattcaggtgcacgtggaagtttgagaagcaccgctccactggagtaaataaaccctttgcctctctctgggaagaagatataatccctgtctggaataaaaatgcagtagagaggaaagtaacccaacgcagcattaactggcacaggacaagctttctattctgcaaaaatgcctcaatcctggtaactgctgacatcaaagcagccaaggatattagtgtttttaataagtagctaagtcaggagtagcttacagtttgaaattactctatgtacaattgaaggtgttgggggaacaggggtaaggaaaacaacagctcaagtgttattagttagatttaaaaaaatttaataaaataaaacaaaacaaaataaaatgcagcccatgcaccaggagcaagttctttgtaggggttgttggagatttttgcattatttgtgtaagccacgtggaggcctgctgtgacacctgtttcccaaaacctcctgcatgtgattctggtggcccattctagacacacgaagtgccattc

SEQ ID NO: 470927 - DNA, 1128 bp, Homo sapiens
tacaagtggattttggttacatggatgaacggcatagtcatgaagtctgagagtttagtgcatccatcacccagtttaaccgccttgccccctttgaagtcttatatcttgcctgggcgctccaaaacattacataaaaacggtgagagcaggggcattcgcatccagctcgactttcataggaatgcgtctggcgtttcaaacactcttccgatgctttctcagaagaagagcacgggcggtaggaaagaaggacgctttcaggaaggatggagggcccaggacgatttcgctccccggtggacgtggagggcgggcagggtcatcctttctcctgaaactggggagccctacgaaggggttccggagaagacgcacggatctcgaatacctccccgcccggctgccactggatggcgcgcgcaacctgcggaaccacagggcgacatccagctgcgggcggcgaagggaattggagcgtggacctctccaggcttttcattcgctggttctgccggtgtcccgccttttccatctcctcattggctgtcgctccgggcctgcgactttgctcagcccctccggggagtggaatcgggtgtgcaacaggccgtgaggtccggctttgcgaggaactcccattggtcagtcaaacaggagtcccaccctcctgggcttcccattggttgctgtcccaccgctgctctcagtttcccagcggctggggatctgggttttctgggggtggaggggtgcagtacgctgctggaagctcgtttctctttccaccgttgtgtgcctcgggctcgcggtcaacggggctggacgaggttcagaaccctccagagcggcagctgtccccggggtgggttgtgggactcaacagccctcaggggaaaatggcgggaggcaggtggaggtgtcttctttgcactgaagacctggataccctgctgcgggctgaacgggaggctggggtggagccctggctcgggttatggccggggaggagaccacgctgggcgagtgggaggcagccccagccaggggctggaagaccaagtaccggaccttcaagggccttcttgcacccgcatcccacagtaaacaggatacgtgataattatg

SEQ ID NO: 470928 - DNA, 1473 bp, Homo sapiens
ctgctgggacatgtccttacagaaactcatggagccagaagctgggaccaataggaccgctgttgctgagttcattctactgggcctagtgcaaacagaagagatgcagccagttgtctttgtgctcctcctctttgcctatctggtcacaattgggggcaacctcagcatcctggcagccgtcttggtggagcccaaactccacgcccccatgtacttcttcctggggaacctatcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtcctgggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgtagcagcagccttcatggctgtggcacccttggtcttcatcagtgtgtcctatgcccatgtggtagctgctgtgctgcaaatccgctctgctgagggcagaaagaaggccttctccacatgtggctcccacctcactgtggtgggcatcttctatgggacaggtgtcttcagctacatgaggctgggttcagtggaatcttcagacaaggataagggggttggggttttcatgactgtgatcaaccccatgctgaacccacttatctacagcctcagaaatactgatgttcagggcgctctgtgtcagctacttgtgggggagcgatcactgacctgagagatgacctcctttcctgccttttctggaccgaggaaaatttcccgagaagatagtaaccaacaaaccttgtttataaccattatttctatctcctgatgcctgaggagtggtgttatgtgtttggcctacaaggaaaccctatataattcattcatttattcattcaacaaatatttattaaattacttctatgatccaaacaatcttctagggcattggtgagcaaaatggacaaaagtctctgcactcaagcaaatcacatgctataaaggaagactgtttactgcgtcctagcaacactactgtccctctgctgttcatccctaaaactgtccatgggtgcacctgaaccttggcttctctgtgatttcctcttggggttgactggaaggatgggctgagataaggttgtgaagacaagatgtgagagtgggaggtaggaacggattggagcggagcaatgaagatgaaatgagcatatcgagagggatggg

SEQ ID NO: 470929 - DNA, 1177 bp, Homo sapiens
ggaggcaggtgttggtcagagcatgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggattcccatctccacacgcctatgtatttgtttctcagcaacttgtccttctctgacctctgcttctcttccgtgaccattcccaagttgttacagaacatgcagaaccaggacccatccatcccctatgcggactgcctgacccaaatgtacttcttcctgttatttggagacctggagagcttcctccttgtggccatggcctatgaccgctatgtggccatctgcttccccctgcactacaccgccatcatgagccccatgctctgtctcaccctggtggcgctgtcctgggtgctgaccaccttccatgccatgttacacactttactcatggccaggttgtgtttttgtgcagacaatgtgatcccccactttttctgtgatatgtctgctctgctgaagctggccttctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctgtctgtggtgtcactgttctatggaaccgttattggtctctacttatgctcatcagctaatagttctactctaaaggacactgtcatggctatgatgtacactgtggtgacccccatgctgaaccccttcatctacagcctgaggaacagagacatgaagggagccctgagcagagtcattcatcagaagaaaactttcttctctctctgatgataacacttggagctattacatagtttatccaggtaacaccagtttctcagtgcataatacatcagaggtattagaggcaggaaaaaagattgatctttaaatcactttcctttatgccagaaaaacccaatttaaaaatcaataaaaaatggatttaattcttaatagcaagtaaaggtaagtacaagaactaaggaagaaaccttt

SEQ ID NO: 470930 - DNA, 1004 bp, Homo sapiens
cagcagccagcaactggcaaactcatggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtcctgggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgtagcagcagccttcatggctgtggcacccttggtcttcatcagtgtgtcctatgcccatgtggtagctgctgtgctgcaaatccgctctgctgagggcagaaagaaggccttctccacatgtggctcccacctcactgtggtgggcatcttctatgggacaggtgtcttcagctacatgaggctgggttcagtggaatcttcagacaaggataagggggttggggttttcatgactgtgatcaaccccatgctgaacccacttatctacagcctcagaaatactgatgttcagggcgctctgtgtcagctacttgtggggaagcgatcactgacctgagagatgacctcctttcctgccttttctggacc

SEQ ID NO: 470931 - DNA, 1337 bp, Homo sapiens
gaccctattatattctcttaaagatactggagacagagcatgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctgtgtatttgtttctcagcaacttgtccttctctgacctctgcttttcctcagtcacaatgcccaaattgctgcagaacatgcagaaccaagacccatccatcccctatgcagactgcctgacccaaatgtacttcttcttgtatttttcggatctagagagcttcctccttgtggccatggcctatgaccgctatgtggccatctgcttccccatgcactacaccgccatctgcttcctcctgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccctatgctgacccccttcatctacagcctgaggaacagagacatgaagggagccctggaaagggtcatttgtaaaaggaaaaatcccttccttctatgacagtaatacttgggagtcttatataattttatctaatagatacatggacattaatatttcaatattatttcagatctctttttttctgcacatgaaactttttgtttaaatgtaatattacataatttctgagttttctaatttgttggtatatggttgttcataatattttctaatgatcctttgtgtttctgtggtatcacttataatgtctcctttttcatttctgattttatttatttgggttttctctcttcttaattagtttagctaatggtttgccaattttgttaaacttttcaggaaaatcaacttttcattttatt

SEQ ID NO: 470932 - DNA, 910 bp, Homo sapiens
cagcagtgaacctctactgtggaggccaggccagagaagccagcctgatgaggctttgagaggacctgaaactggagatgggatttaatggccagagagaaggaggcagcaggcttgtcatccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctaccc

SEQ ID NO: 470933 - DNA, 623 bp, Homo sapiens
gtcagcatcaaggtgagatcttccaccagcaaaaggattataacttgctgaagggtcaggtgattgctatcatttctcagcaataagaaagttgggggaatggatggagataaccagagtgagaactcacagttccttctcctggggatctcagagagtcctgagcagcagcagatcctgttttggatgttcctgtccatgtacctggtcacggtgctgggaaatgtgctcatcatcctggccatcagctctgattcccacctgcacacccccatgtacttcttcctggccaacctctccttcactgacctcttctttgtcaccaacacaatccccaagatgctggtgaacttccagtcccagaacaaagccatctcctatgcagggtgtctgacacagctctacttcctggtctccttggtgaccctggacaacctcatcctggccgtgatggcgtatgatcgctatgtggccatctgctgccccctccactatgtcacagccatgagccctgggctctgtgtcttgctcctctccttgtgttgggggctgtctgttctctatggcctcctcctcaccttcctcctgaccagggtgaccttctgtgggccttgagagatcca

SEQ ID NO: 470934 - DNA, 601 bp, Homo sapiens
cgctacgtgatctgctttgacaccttgtaaacatttgttggtgttaatgttgcagagagttggggaaatggatggaggcaaccagagtgaaggttcagagttccttctcctggggatctcagagagtcctgagcagcagcagatgctgttttggatgttcctggtcaggtacctggtcacggtgctgggaaatgtgctcatcatcctggccatcagctctgattcccgcctgcacacccccatgtacttcttcctggccaacctctccttcactgacctcttctttgtcaccaacacaatccccaagatgctggtgaacctccagtcccagaacaaagccatctcctacacagggtgtctgacacagctctacttcctggtctccttggtggccctggacaacctcaacctggccgtgatggcgtatgatcgctatgtggccatctgccgtcccctccactatgtcacagccatgatccctgggctctgtatcttgctcctctccttgtgttgggtgttctctgccctctatggcctcatccatatcctcctcatgaccaggtgaccttctgtgggtctcaaaagatccactacctcttct

SEQ ID NO: 470935 - DNA, 667 bp, Homo sapiens
tagtttttctaacgtaggggtcatgagtgagcataatattacaaaggaatgtcaacaggaaaaccagagcatagagcagtggggaaccataactcacaatgatagcaagaaagtttcctggttacatgaagtaattaagacatatttaaaagccaagaatataaaattagacctgatgaaaaagctgaaggagttatcatcccagccaagcaggaaacccaagccttttattccttctcaagaaggaataggagacagtgatgtgatctgtgatatgaaaaagttccaaggtagaacgaaccacagcccacacttgtcctattgctaccctgatgcttccgagctccccttcttactcaccacggggattgctttaatagtactctggtgtcctccagctagttccactttctccaatcgttgctccagcgatcctttgacctgtattcgagcccccatgaatgggcaccacttgctgagaccaggtcggttggagagaccctaacccagcagcactagaggaattaaagacgcacacacagaaatatagaggtgtgaagtgggaaatcgggggggggggggcgtcttacagccttcagagcagagtcctgaacagagatttaccgacgtgtttattaacagcaagccagtcattagcattgtttct

SEQ ID NO: 470936 - DNA, 546 bp, Homo sapiens
aggaaatattccttatttgaaggggcctgaaagtgtggcatgtcatgttgtgcagtggaaatggtcatctgacgctaaagcacagcgtgttgtacagtggaaatggtcattgtctgctaaagcacggcgtgttgtgcagtggaaatggtcatctactgctaaagcacagcttccatcataagagggtgtatggttccgagtgtggagggacccttctgagtttcagatgtaggaggcctctaactcgaactggattcaagccagttaactactggatcaaatctgatcctggacccggtctcttttctgccataacgtctaaaacatccagccagtcatggctggatagcagtttggaacagaaatttgctcaaagaaactcagagctcaaaacacaaatccatggagctctgaaatccgagagaaaatttaccatgatccctagctgctgcaagagatcaaaggacacaagtgttagagaatcctgaggtgtcacttttctgcctgaaacctctggctggtggagcctttacctgtgctttgttc

SEQ ID NO: 470937 - DNA, 3331 bp, Homo sapiens
gaagggaccagggcatgacaggaacccttggccactgttgattgccccgaggtggggacagggatggtggggctggggctgcctggccctttaagagggcaattctgcccgccgccctgaatgccccctcccctagccactggagaagagatcccgtttcttggcaacaggaagctcttggtttactgtgtcacccaagcaactgggagccacgtcctgctctgcgacagagccgttggagccgaccgatgactgcactgggctgaccgcaacaagctgaccacacacactcctcactcccctggccctggtgggtggcagacaccatggtgcagacggatatgctcctaccagagccggccccgcagacagtgccgccctgcgagctgccctgcaaagagtatgacctggtggtgtggttccagaactgctatgctcgctaccaccaggccttcgccgactgcaaccagtcggagcgggagctgcaggggcacaagagccagcagctggctgcagagatccaggcgctggcacagccgacacagcaagactccaagtgcagggtgggcgagcgactgcaggacatgcacagctggaattcggagctgcagggcgaggtagaggcgctggctgcggagactgacctgctgctggcccagaagcaacggctggagcacgccctggatgccatggaggtgcccttctccatcgccactgacaacatgcagtgcaaccagcgccaccagcacgccaaccttgtgcgtgaccatgtggagacggagctgctgaaggtgccagcagccttgggtggccaggactttcctggcacagtcatcctgaccctgtgctccccagagaccttccctggttgggacagttgctcccgaggtggaaacccaggtctgggccagcactgcgggtgtggacaggcctatccccctgcaccctctcagtgcctcaagaactgctgcagttcccgcaaaccctctgccagcaacaagggtgtctgcgaagtgatggagacactgacagtgcaggaagaggcaaacccagggacagaggggtgcaggactcgggccctggcacacaaggaggaagctgagctcatccggaacattcaggagctgctgaagagagtcatcgtgcaagcagtgagccagatccgcctgcagcatggagggtccccagcggggccctccctggccacacaccaagaccctgccccaccccgccccagactgaaccgagagcacatggagatctgcgagatggactggtcggacaaggtggaggcttacaacctcgacgagacttgcgggcgccaccgcagccagagcaccgaggtgcaggctcatccggcactccaccaccttccaagagaggggggccccagctctgcccccgtgcttgccctggctgtggtcttgcctccctctgcctggggtccccagcggcgctgcttcccccagcctggcccagaggccctcgcccccgaagacacttgggcaactgtctgcccctggcatgagaaagcatgcaagacctcctcaagtgcccagcgcccccgcagcgcctccaccccagagacccggaccaagttcacacaggacaatctgtgccgcgcccagcgcgagcgcctggactcagccaacctgtgggtgctggtggactgcatccttcgcgacacctccgaggacctgggactccagtgtgacgcagtgaacctggcctttgggcgccgctgtgaggaactggaggacgcgcggcacaagctgcagcaccacctgcaaaagggccactggtcaggaccaccctctggacacagccccaggacctgggtaggaccagactggtctctgcattccatatgcccgggcatgggggcacaggcccaaggggcactgtcctgtcggcagatgctgcgggaaatcacagatcaggaacacaacatggtggcactgaaggaggccatcaaggacaaggaggcacctctgcacatagcccagacccggctgtacctgctctcacaccggcccaacatggagctgtgccgcgatgcagcccaattcagatatagacatgacactgggcaggtcatgggtcgggggcctcccagtgccagggacctgtgcccacgtggtctcaccccaccctctgctacctcatcttcccaggaggaagctccttcagacaagccccagctcacaccccccaacacccccaagctggtgagtgagttggaggagctgtacaagtccatcacagcgctgtgggagaagcttctacaagcggagcagtccctgcacaacctcgaggacatccacatgagcctggagaaggacgtcactgccatgaccaacagtctcttcctcgaccgccagaattgcatggcccatcatacttgctaccccaccatcctgcagctggctggctaccagtgagcagcggcacggtgcttccccccaatcccccaaataaacagtgcattagctttctgcacagtatgtgtgtgtgcctggtgggacctccagttgctgtccatctgaactggcctttgggtcccctgtgaggctggctctgcctatggactcgtcatcccagcagttggagatgaggggtcagagctgaggggccctccccatttcctgggagcaccccaaacatcttccatgggaaaaataggacacggaaacccaggcatccaggagcccaaggtatcacacccagagagcgaagggcttgccaaggctcttacctcagtgcccagcaccactgccagcatcccacagtacaatgggggagatgctgttggctgtccattgggagccagccccaggagcacaatgtacagcagcactttcctgtcgccatggctatgctgcagccatgagtgaccagggctctttctgtccaggagacacctgtcctgccccatatgctcacactctgctttccctgcccaccctactctgtcctggcctggggtccccaagccacagtggctcagccaccagccctgccagctgcctgcccagatggatgctccccaggccaaccagatccgaggaactggagagagctcttctcctgtccattcaaccacccctcagcctccctccaccctgccctgcacttggggagtctctgtgaccagtcccccacacaaggaactcacaggaatgcccctttctgttcgggggcaggactgctgtcatcagggatcattgagggaagcacatggagagggggactggggtttcccatgactgtgccccagcagcccccacacattcccccacaggggatgctcccagacacttctaagctgcca

SEQ ID NO: 470938 - DNA, 873 bp, Homo sapiens
cgttaggtcaaggtgtagcccatgaggtgtgggggagaggacgatgttattccccatattgcagggggtgtacaaccccctagaatattgttcataatatccacgtggggaggagatgatgttactacccatatcgccagggtgaacaatatcacagaaggggtgtacaccccctgtgatattgacagtaatatcttctccccccccccggatattaggagcaatatcacagaagcgttgtacactccctgcgatattgacagtaatatcctctcccccccagatattaggaacaatatcacagaagaggaacaataccacgggggggtgtacaccccctgcgatattgacagtaatatcatcctctcccccccagatattagtaacaatatcaccgaaggggtgattgtggatgaaatggtgaaaaggaaaggcaagaatggaatttcctgctagtgggaagtagaagagagtattaaaacttttttctttctaagtcaaatcagtgtcatatacatgagaaagctaggcagtatggcattatcagcttggctttctccttaaatgaaatagaaagtgccctgttttactcagacagtgttttttttttttttctaaaaagctaaaagaagttaaatactttgaaaacaattaatttctgttctaaattatacaaatgttatatttgtaaaactagagaagtttgttccattgcttctaccaagcatcctagcttatgtagttggggcagctagaaatctaatgaacagaatgtatattttaggcttatataaagtattctgcaacataagctcaaaaataccccctaccccctttttgataaaaataaagtttactactaataatcaaata

SEQ ID NO: 470939 - DNA, 970 bp, Homo sapiens
tctgtcctgcagcagctgcacaggggcggtaaccggccctcagccccatccccggtggctgcagagggcccctggatagagatctggagctatggcagaggaggagacgggtgggggcagggtctggcaggctctcagcccaggggtacccgcgatccagaggccgcccagggtatgctccaccaactgggtgcccagctacaggcgccgggcaactctcaagctggctggcggtcccagcctcgcagaaccggggctagatgtcgccgtggctgcgaccaagccaggcggtctgcccgggggcggctgcaccggggcaggaaccgaccctcagccccatccccggtggctgcagacggcccctggggtggccccgatctctcttcggaggagaagaggggcgggagtcacggccaggcgggccctcaggcaggaagggatgcgcgcctgcgattccgggacgtcccgcgccagcccaggagaacccgcaagccagcggcgcctgtttctctggatcatggcacaagttgcagtttccaccctgcccatggaagatgaggagtccatggaagatgaggagtccattgaagatgaggagtctgttgaagatgattccgtggaaagcaggatggtggtgacattgctcatatcagctatcgagtccacggatactatattaactcttaattgaattaatacaagtttaggtgtaaagatgatgtttatgttgacaaaaattattaatgttttacatatatgaaagtaacaatatcatatatttttcatacttgtagaatactttgaaatctattattagctaatattttatattcattttgggttttcacattattgttagatccagagaaaagtaacattttgtgaatactcaaatcataaacattttgctggattcattcatagagactttatttaaaaagtgcactaattgaagttttacatcatttta

SEQ ID NO: 470940 - DNA, 703 bp, Homo sapiens
cctggattaacaaagttgtacactaggtcctgcccccagaggtggagtctacagaggcaggcagccctcctggagctgcggtgggctccatccagctcgagcttcccggctgctttgtttacctactcaagcctcagcaaatgcgggcacccctcccccagcctcactgccaccttgcagttcgatctcagactgctgtgctagcaatgaaagttgtttccggacagtctatgaaaagctctgctggccacggaggaagtaggcagctgacaaaaagttctgcaattgcctgtgccaaactgtgtaaagcaagtacttacatcaattgggaagataacgctgtcattttcctacttgttcagtccatggtggttgatcttaagatcttcctggtgcagaattcacattctacatttcactatgtgctggtaaattcactccatcaaatcatcaccaatgctctgctggttcttcgtcagttagatagcattgatttgtggaatcctgatgctcctggagaaacattttgggagattagatttcagtgtggttactactgtgattttaatagattttcacagttttaagcctagaatgataaaattttgtaaaaatattgttttttcagttttttaagctgtgtgatctttcacaaactttctgtaatacgaatgcttttgatgaatgaattaatcagggacaa

SEQ ID NO: 470941 - DNA, 595 bp, Homo sapiens
tacgtgtgtgttcatgctaaaatggagttaagatgtgtaacttcgttaatgcagaacagattctatcttatgcattgtagctggacccacggttactgggcagagctctgtggtggctgcagtgccatggagagtctgagatcctctgtggacctgggccctggactgacccttcagaagctgggcaaggtggtggtggagctcctgccacatgatctcagtccacaactcactgtccacaaactccaggtggagacactggtgtgtttgcctctcatcgggttattggtgggtctcatggttttattgaggcttgttcagtctgttaggggtcaactttgtgagaagcaccaaatcctgctgctctcttctcaggagtggacgtgggtcttaaatccgtgctgctccctcccctccccttgggcctcatgggctgccaggctgcgtatacccaccttgactccttctgagggtcactgaggccagttggttcaggggagctcctcactgggctggaattcctccaccttcacatgctgttcatagcagtcagcttcttcacggttaatattgatatgtgaagttttgatcatat

SEQ ID NO: 470942 - DNA, 510 bp, Homo sapiens
gaattcctccacatcacagccttgatctagttgctgcaataacaagatatagttaagaaacttcaaagagaataaatatgaaaatggaaagctccagctatccccttcgcctctatgatcagctgatttgtgaccatcgaagagacaggtctgtctgccctggcaatagtttgaacaattaccctcactatacaactcagaaacaggaaggagcaacaggaaggacaacagacaggaaggagcaagtctcctatttctcctccatcctcatggtctttctctacatcccttttggctcaggggtaaatgtgcagggtttttatattggtcaattgcatgtcacgggagttggtgtacagattatttcaccattcaggaagaagacaaaaatgccactgatagagctcttaaaggctaaaatatccagggtaccagagaaagggaagtatatgaagggggcagcaaaatacctgctcccacaacgcacacactaacacacctatctcacat

SEQ ID NO: 470943 - DNA, 851 bp, Homo sapiens
ctgcagtcttgaggctctgccttttgtttagcttttatgatcaacaaatttggagccaagtgaagacaagacaataaagtggggaatggggggtcgctctgaagcccttgtggacaagatacatgctcgcaggagacggaacttaaacaaatttacacgaaaaaaaacaaacaaccccatcaaaaagtggatgaaagatatgaatggacacttctcaaaagaaaacatttatgcagccaacaaagatacgaaaaaaagctcgtcatcgctggtcattacagaaatgcaaatcaaaaccacagtgagataccatctcacgccagttagaatggcgatcattaaaaagtcaggaaacaacagatgctggagaggatgtggagaaatagaaaagcttttacactgttggtcggagcataaattagttcaatcaaccattgtggaagacaatgtggtgattcctcaaggatctagaaccagaaataccatttgacccaacaatcccattactgggcatatactcaaaggattataaatcattctactataaaggcacatgcacacatatgtttattgcagcaatattcacaatagcaaagacttggaaccaactcaaatgcccatcacaatttgactaaaggttgtaatttttcttttgttcatttaaaaaaattccttaatatggaaatgctacataaagaccttcatgcctaagagaacagggatctacaatgcaggaatattatcactcccacacttcaaataaaaaaaaaaatgagaaaaataacaagtttgtggtgttccttgaatccatcattctgcttcctggttgaactctgactcataaaaaaaga

SEQ ID NO: 470944 - DNA, 581 bp, Homo sapiens
tgatacattcttattccttccatgatttttcccccaattcaaattattaaaatcaactgggaggaggggcggaatccatcaaataaagagcttaaatgcttacttcgcttttttgcaaattcaaacaaagtgagaggttgtatgatgacccataggctggggaaaaggctgcgtcccattcaagctgctgcttgtggctgctgggtcttccaagggcactgtggtgaaggctcttgtccggcctctgcccagcagctcagggaagggccaccacgcagatggcttttggaagggttttgttgtatgactcctagtgaaaatttaggctttgcgaggaagaatggagaaggccctcactgcagccctgcagctgttcatgcagcatggggccacatttgcttatggagagagcagttcttccactcccatcagaacagcaggccaattgaataaaaaataataaattataacataccgttcggattattagccaggtaacactgcctctggggaagcattttggcctctgttcaataaagttgttaaacttgatttgggtcatcatgacacatggtttgatt

SEQ ID NO: 470945 - DNA, 842 bp, Homo sapiens
agcgagctctgctggctgcagccagtcttcacagtgataagcgtaacttataactctgtaagatcaacatcagtatgttgtctgaaggtagtcactggaagtctgcatgttgttaccctggtctgacgtatttaagtctatattcgctggacactgcaatttgtgggcccaacacagtacagaatgaattacctaaagcactcgatggagaccctgtcatagatggcgcaaagccagtgactccagagcaaggtccagaagccaaagctacccgctgcactcatggtggccctgggatgcctggtgccctgaagggagccctagtgctgagtgtaactggagcagcctcagcccagccaggactagaccagggaccagcagcccctggtcagggaaccttctggcagcagctgtctctcctccaggcaggctgcaggaagctgtacaagctccccctcaggcactttgtagtatatgttttaaataccaaaatcagaaaacttgcaaaacagcaagaaacacacttttttaatcttctccacttgatcaacagagtcaacacaatccctgtcaaaagtccagaaagctattttgaagatgtcaataaacttattccagaatttctgtggaaaagcagatgagcttgaagagccaacaaaacagtgaaaaagaacaacaaagtcagaggactgtcactccttacttcacagatcctctctttatccttgatctatgagagtatgattattaaatgccttgaggtagtcttatttgggttaaatatgcttgatgttctataaccttttacttccatattggtatctttctctaggtttggggag

SEQ ID NO: 470946 - DNA, 519 bp, Homo sapiens
accacttcagtgcttctttcagcaatatgaagttaaaaccagaatttgctagtgccagtggtatttcagctcctagtcccctgcactttcagtcccacatgcagccttcccagggtgctaaccaccccctggagctccgggccaaaaccagttacccgggaagatacaaagaagagggtgtcaaatttgccaacctttcagggcactgcccggctgctcaggagacaagacatctacacttaaagcagacttttcccaagagcagagagtgtcgcctgccacacgcaagccaagaacaaaacacgctgtggtgttgtgatggcacagacaggtcgcgtgggttgatatggagccagagaccttcaaaacatttgatcttgtttgggcttaaacaaatatatgatttagacagaggaaagattcgaaaagttcagagggagagcagtactaaaaaatgtgacaggcaaaaatgagcaaggcatcttagagacaataagaggcctgggccagctggaatgc

SEQ ID NO: 470947 - DNA, 1682 bp, Homo sapiens
ggagggtgctgcttgggaggcagcgtccctgacatgccgttcaccatatggagctcccgggggtttgtggggtgggggcagtgcggggagatgaaattagggtgcggcggctctgagaaccctgcatcctatctaaacctcgcatcctatctaaacgacgcatcctacctaaacaacgcatcctatctaaacctcgcatcctatctaaacctcgcatcctatctaaacctcgcatcctaccaaaacctcgcattctatctaaacctcgcattctgtctaaacgacgcatcctgtctaaacctcgcatcctatctaaacctcgcatcctatctaaaccacgcatcctacctaaacctcgcattctatctaaaccacgcatcctatctaaacctcgcatcctatctaaaccaggcatcctatctaaaccacgcatcctaccaaaacctcgcatcctacctaaacctcgcatcctatctaaacctcgcatcctatctaaacctcgcatcctaccaaaacctcgcattctatctaaacctcgcattctgtctaaacgacgcatcctgtctaaacctcgcatcctatctaaacctcgcatcctatctaaacctcgcatcctatctaaaccatgcatcctaccaaaacctcgcatcctacctaaacctcgcattctgtctaaacgacgcatcctgtctaaacctcgcatcctatctaaaccatgcatcctatctaaacctcgcatcctatctaaacctcgcatcctatctaaacctcgcatcctatctaaaccacgcatcctacctaaacctcgcatcctacctaaacaacgcatcctatctaaacctcgcatcctatctaaacctcgcatcctatctaaacctcgcatcctatctaaaccacgcatcctacctaaacaacgcatcctatctaaacctcccatcctgtctaaacctcgcatcctatctaaacctcgcatcctacctaaacctcgcattctatctaaacctcgcattctgtctaaacgacgcatcctgtctaaacctcgcatcctatctaaacctcgcattctatctaaaccacgcatcctatctaaaccacgcatcctaccaaaacctcgcatcctacctaaacctcgcattctatctaaaccacgcatcctatctaaacctcgcatcctatctaaacctcgcatcctacctaaacctcgcattctgtctaaacgacgcatcctgtctaaacctcgcatcctatctaaaccacgcatcctatctaaaccacgcatcctatctaaaccacgcatcctaccaaaacctcgcatcctacctaaacctcgcatcctatctaaaccatgcatcctatctaaacctcgcatcctatctaaacctcgcatcctatctaaacctcgcatcctacctaaacctcgcatcctatctaaacctcgcatcctatctaaacctcacattctatctaaacctcaagtcctatctaaatttcacgtcctatgcaaacctcacatcctatctaaaaattcactaagatagatcagagatttcaatgtaaaactacacaactttgtttaaaacataggagaaaagctttgcaaactgagggcttggtggagagttcttagacatgataccaaaagcacaatccataaaataaaaaatcagacattggactccatc

SEQ ID NO: 470948 - DNA, 933 bp, Homo sapiens
gggtgacaccgctgaagtggccttgctgggcctggaagagacttgcgagaaagtgcaagcaacagagcccgaggggtcactgcaaaatgccagccctgccgccctcaccactgcggggaacacagaaaccagagcctgtggtggcagaggggagctgtgggcggtggcagcaaacacttgagctctccgccggccacttatgtccccgtgagccctcactcagacatgtgccagcccacgcatcagccatcgccggcctccacctgcaggctgggaaggcagctgcccgcaaaaagcagggtgctgctgtaccaaaatccttaaaaatgcagaactgggtcatggacaggggacagaaggtgggtgctagaaaaacagatgctgctgtgaatggactgttgaacttacttggatctatcatttcttccttctttcctatttcttccttttggaatgcctatcctatgcctgtcccaccactggatcttggaagcacataactcgtttggcttcgtaggttcacaagtggagagagattggcttcgggcagttgtaccttgagtttcacccatatcagatttagatgctgtttagatgagactttggattttagacttcagagttggtgctgaaacaaattaagattttgagggttgttaggacataatgaatgtattttgcatgtaagaaggacatggatttgtggggggcatggcaagaatgtgatagactgaatgttcctgtccctccaaaattcataggttgaaatttcatccctggagtgatggtattaggtgttaacctttggcgggtgattaggtcaggagggcagagctctcatgaatgagattagagccctgataaagagaccccagagagctctcttgtcccttctgccatgtgaagacacagagagaagatggctgtctatgc

SEQ ID NO: 470949 - DNA, 1491 bp, Homo sapiens
attttgcatagcatcagtttaatcctcctcatttcaaagatggagaaactgaggcccagaaagggacagtggttgaactgggggcaaagccaggtcaaccctcttacatcggcccccaaccctggccctagctctgccctccgagaccacttggccgagctgtccccttctcagggagacaacctctccctgagctctgtgacgctggcctgggcacagaccctaagccccctcccagttccagcccacaccctggccgtcctcgctcaggcacttccagaaaaatctccaagtccattggtcagcagccgtcagacactcagggctcctgggctcccaaccctctcaccaggtctagagctgcccccgagcccctcccccaggcctccctccaggcccactttcctgccccattgtccttcttaccccagacccagagctcacattgaccttggtggggtctggttcttcagtgccccccatgtggaactctgagtccattaaaccgctttcctttataaattacccaatctcaggtgtgtctttattggcagtgtgagaacagataaatacacacaaacatttagaaactgttaatttctaaatgtctttcctcattgatagtttttgatgattttctaacttcatctttccttccatatttattagttttaattcttctgaaggaagaactttcccttctccacatttatttctttattcatttcagcatagatgtggatttctcttatattcaatgggttgaaactcattactatcattatttatctttgtgctctaattatcctgaatttggccagtggtagcttctttcatctggttcctgtttttttggcaagtgctcataatttttttcatagattttatattttagagccattttagactcattgcaaaattgagttggaagctctgaggtcccatataccccctgcccccacacacataatccccctgcccattatcaaaattctgcaccacatggacgtgttttctgagcacttcctccagatatttgtgcttgtttttattccccagtaccttcaaaattctttattatgtccaggttttacaattgttttctgtagggtgtgtgtaggggtgggagtgtttcagtagggtattgcctcaccacgcctgaaagcagaaatcccacgcctatcttttattatctggagtggagatgtttcattttaattagggggtttagtctacttgcagttaataaaatgattgatacggttgggttcaagtttactatcttactgctggttttctatttacccccttttatttgttctttgctttcttcttccataccttcgtttgagttatttgggggtttttttgtattccattttatttccttttatgggttttcagctatacttctttgtattagttttacttgtttctgcaggcttacaatatgcattcttaacacataatggtccaatgggaatgaatgtt

SEQ ID NO: 470950 - DNA, 908 bp, Homo sapiens
aaaatattatttatctcaattactgagtttttctgcgcatgccccctcccaccaaactaaaggacagccccctcccagcccccacctgcacagccagccccttctttgccgcaaaccttcgagaatcaggcaaagccactgctgtaggcagctggtgccaagatttgcttcgtgctggggacacaggactgggcttgtgtccctggggagctcactgtgccaaaggcctggcccctgtcctgagagagttacgagtccaaaaggagctcacagccccgatcctgtccggagtttgcccagagcttgaagccagggccctgtctgtgggagctcatggccccaaggccccagtctatttggccttgttctggggcagctcccaacttcacagttgtgatagccctctcctgagagcaactacagtgacaacagagaagacctcagactttcagaacgagcctggcatcaagctgctaacaggagcagtgtatgtgtgtggtgtgaggtaagggcccaagaacatctctttgcacggatatccggttatctcagcaccatttgttggaaaggttttggcaatgaattgccttagcatttttgttaaaaatcaattgaccataaatataaggatttatatctggactctcaaattctgttctgttgatctatatgtctatctttgtgacagtgtcttattgccttgataagtgcagcttaatagtaagttgtgaagttgggatgtgaacaccctctataatagaatggtggcctccaagaagatatgtctacatcctaatccctggaaactgtgaattcaatcttatttggagaaagggtctttgcagatgcaattaagtgaagtattttaagatgagatggtgctggattgtcagagtgggctctaaatc

SEQ ID NO: 470951 - DNA, 696 bp, Homo sapiens
tcataggatcggggctccaggtccaagcttcggtgccatccagaatgcaatatcaacaatcacatgggggttggtggaagccgacagtcacagagcgccttgtgctgggtgctgctcacgcagtcatccatcctccaccctgccctctgggggcgggaactggaatcaagcctgttgtcagagggcttccccggcgtgcccagagatggcccagcaagaaggcccttgccagatatgggccaccgacctttaacttcccaacatccagaactgtaggaaataaatctttattcttcatcaattacccaggctcaggccagcggctggctcctggcttggtccctaagtgcactctggagctattggtgagaggaggaagcagcaggagggacaggtatggggagctgacgattaactcatggccctccttgttcagcagtgcagagatggtggcagtggccaagcagcctggacttgggctggggggcagagtggaaaaactggggaagtgtttatggcccagaactgacctgagcctggcgagctcacgagctaccgtggccaatgtctaaatctttgaaatgcagacttcagggaaatgactcatcagaaggaaagcataaagagaaactttttagaaataaatggtaaatgaaaaatcttaaaagtccttttcacaaatattaataaaaggct

SEQ ID NO: 470952 - DNA, 584 bp, Homo sapiens
ttcgtgttttctgatccacatcttctaaatgcctccaccaccagcctctggatggcccagcaagaaggcccttgccagatatgggccaccgacctttaacttcccaacatccagaactgtaggaaataaatctttattcttcatcaattacccaggctcaggccagcggctggctcctggcttggtccctaagtgcactctggagctattggtgagaggaggaagcagcaggagggacaggtatggggagctgacgattaactcatggccctccttgttcagcagtgcagagatggtggcagtggccaagcagcctggacttgggctggggggcagagtggaaaaactgggggccacagaggaaatggggggctcctatcctgtgcccatcagcccctcgctgcactttgtgcactttagtgggcatgactgggagattctgggaagccgcatgtggcaggaattctctgccatgaaacagaaccaagtgctaagtggtccttgcagagaaattagatgacatggataaggaaaattagaagcacattgaagaattaaatcgttttgaaacctgcccctccctg

SEQ ID NO: 470953 - DNA, 923 bp, Homo sapiens
cacagttgttggatgacgcgacatggacagttctctttcgaccagatccttgtctcccatcgaggggggattctgctctcactgctgcttatgtcaggagagggtcactgttgcctccatcacctcaggaccatcctggcaagacccactccttgggacacgaatgatgtctggccacacagaatacatgtttatgactcagaccgtccaattccctaaccagctatgtcccactggttctcaacagggcctcgtggaggcagccccgacctgggggaagtggccttgctctggctgtggtggtggtggtggtggtggtggtggtggtgatggtggtggtggtgatggtggtgatggtggtattggtggtggtggtggtggtggtggtactgatggtggtggtggtggtggtggtggtggtggtggtggtggtggtggtactgatggtggtggtggtggtggtgttggtggtggtggtgttggtggtgttggtggtggtggttgtgatggtggtggtactggtggtgttggtggtggtggtgttggtggtggtggtgttggtggtggtggttgtgatggtggtggtggtggtggtattggtggtattggtggtggtggtggtggtggtggtactgatggtggtggtggtgttggtggtggtggtgttggtggtggtggtggtggtggtggtggtactggtggtggtggtggtggtggtgttggtggtggtggtgttggtggtgttggtggtggtggtggtggtggtggtggagggtggtggtggtaggggctgagcccagtccttctttggtatttaaaacgtggatattccttctatgtttacgtgattcctggttaatcatagaggaaaatccatgttttcagtatcaaatgctgctttggaaatgtttctggaagagacc

SEQ ID NO: 470954 - DNA, 674 bp, Homo sapiens
cagtcttgggatggttctcaactattgtcttgacaggagcctgctcagttattcacagttacaatgcacatcttttcaaggacggcccgaggtggctggtttcccccagtggttaaccacccaggtgcccccagtaatctgtttgttctgccagaagctgatatcagattacttatgtacagaatgttccccttacatccaccccaatatgcccaaacctaatgcctgtgaatatggtgattatcatggatcattacactggcagccactggggccaatgtcatcacaagggtccctaacagtggaagacagaggcacaggaggtcagagggagacacgactgccgacaaaaggggccacgagcccaagaatatgggcagcctctgagagaaggtggaagaggcaaataaactcacccagagcctccagaagaatgcagccctactggcaccttggctttagcccagagagacttttgagctctggaaccagtgcattatatattccggatacaaacctctttgctatactttgaatgtttgtttccccaaacttcatgttgaaatttgactcctagcgttggaggtgggctcggtgggaggtatttgggtcgtgggttgggaatccccatgaatacgttaatgccctccctaggggaggaggactgagttggt

SEQ ID NO: 470955 - DNA, 1355 bp, Homo sapiens
tttacatccctcacctctctgacctcagcacagttgtgtaataaacacaagcatggataatgatgtgggctggctctcagggcagcagggagcaccgggaggaccctaatccaaatcaccaaacccacctctgccatgcaaggtggaggacagccctggaggagccggggcctgcaggaaatttgtgttctgagaggttcatgacctgtgcaggcttctttggaaggcagctgggggtgtgttggggccgcccttttcttcttgctaacaccgccaggcagccgaggtccccaagtgtttctggaggaggagacagttggctgcaggctgaggagccctggtaccaagtaaaatcagaagcccctgacaggctgtccaaggcccgctgcaagcagggcctccccatctcctaccctagcttgcctgatgtggctgccccttgctctacccacggctgttctggtagcttcttttcctccttattccagtccagaccctcagaaataatctgaaatccttccacctagctttgttccttggcgcttatcatttgtatttatacaactatctgtacaattattatatgtccaaatgtctcttagattgtgaccgtgacccacaacaagaaatgccttgtattatacatcgcaactcagcacatgtagttcggaaagcactgtgttctatgtgctacattcccagccccaagcatagggcctggcactgtgtaactatttttggtagagtgttggattaaacaatagatgcacaaggctgcacatttctgggtgatttttaaaaattgcctttctatgaataaaggctacagagctttcactttcctttctctttttcacacgttgtacaaatgctgctattaattccactgaacactgtggttatattgtcctacagagtacacatcatttattacaatgacaacatttttggtgctcaggatataaattaactcacaatggcgtggaatatcagtctgttaaaatgtttagcaaaaacatcacacattattaattttcagagatttttcttgaactttccccaaagatcttttttaatgctgtgtagattatacctaagtgacttaacatgcatatcattgtaattattctaaatttagcttttttttagagtaagattttaccactgtgggaaaaacatagctgtttaatactctaggttaagagagcaatgatcttctttatcatctcaaaagaaagtggactgagttcttaattgtcttatttgtaactttagtggaaataatatcttctaagaaaatctccagctcaatttggcagctgaagttttaaatatatgtctcctttcccatgtct

SEQ ID NO: 470956 - DNA, 1044 bp, Homo sapiens
gatgagagaggaagtgactcgcccaagatcactgagaagttagcaggggaagcagccaagggactgagttctcctgctatgggctcttgctaataacgctgggtggagccaggcctcggagcaggcaccacgtgccctggccgaggacaaagtggcaccaagctcctcgcccacagccacacccctgtggcccacttgctgattggcccagggcttagggtggagccaaagagcaccataggtgggcttggctctgtccaataggaatgctcgttactggagccaaacaatctgagccaatcagagcctctcatggtggggcagggctataaatacccagggaagtctgcgctagagcttccagggcgtctcctctggaacagtggctgtctcgggtccccaccatgtaggtgcagctccctgccttccacagcagcttctggtgcctggctagagttctgggactgaattcacagatcgtgccactggcccaagtgcacattaggaatactgttccctgtccctttgaagttaagtatggccaagtgacttctttcgctaatgaaatctagtaagagagattcaccatggtcctcttctcccgtgatgacaatcacggaaggagggatccacgtggaccctccagttattctaggtccctgaaggaccatgatgagctgagcttccctgccaagctatgtggaatgcatcgtgtgaatgagaatcagtgtcgttgtgttaagccactgggagagtggaggtcttactgcagcatgacccagcccatcctgactaaggaagtatgtgggcaccgtgctcttgggggccaagagcagaggaagtgtttcacaaatggcactctgccaccaggggaccggatcaaattcatcacctatagagggaaggcagtcatctttcccgcattggtgaagactaaaacctacgtgcaaagctgtcagcttggtgtctggcaatgagtaaacattcctgaaatggtagttgctacttctgtttatcatcatcatccgcatccccatcatcctc

SEQ ID NO: 470957 - DNA, 922 bp, Homo sapiens
ccagtgctgtgggttcactgagactccacgttgtcacgccatgctgcagggaacccttaaaatttggggaaaatacggcagcgtctgtgccctcggaggcccacagcccgcgtggggagacggatattcccagccattcgatcctcagtgtaagacaggggtggctttgggccctggctgccagttccagggtgccaagagaagcctcactccgtatctgcgacattctcacatatttcaggaagaccctggggagaggcagccaggcctgcggggctccagggtccctaagaccataaccttcttcaaactgctgctggcttttcctgaccctctgccccaggcccggaagtggcaagtgatcagcaagtggcagcggctggcaatgacactgaaaggagtcatcagcatccccatttcacaggggctgccccttcataccatgcccttctgctttcctccacctcccccagcccactaatctgttctccattctgtacaaataataatagttaatgtcaccaggcactgaccaacgctgtggtctaaagaggggatggggtgtcctgcactaagatgccagaggtgagtggacaatgaaaaggctccgtgtggtgccaacaagtgactgccttttcttggagttggagccatggaagccctggattgtggacctctgtgtgtatttccactgcttcctgaaggcatttgacccgtttctcacaacaaaaccatcacaaaactctcctctttgtctcctggggaggcaagggctagagggtgtctggctatgcactttccctcttacagcaccaagtccaagtgtgattttcaaaactgttagctcatttggtccccttaatacccctgggggggcagaagcccattttgaggttgggaaaattgaggccccggcacttcc

SEQ ID NO: 470958 - DNA, 704 bp, Homo sapiens
cagtagcctccccaccagccatgagggctgcctgctgccttgaagtagaatggctcccctgccctgcaaaccctggcctgctacatgctgccagggtgcccatctggaagctcaggctttggctgagtcggctggggaaagggcattcatttctcaggctctgtggtctccctgtcagatgggcttcaccgctctgtataagcggtgatgagtgggtcttagcaaagcgcctggcccggtctctcgccatgcagcaaggaccatctcccctggaagcttcacaaccaacctttgagagctgcgcttccagccccgggccatggcggcaaagcgcccttgtcatcggcacccacgtcctgatatctgcagagaacatcctgtccctgggcagggagccccagtgtcccccaatagttatgagaattaaaaacaagagaaactattaactaactactagtagtaaattactgcacaggaaaatggaattacataaaagacacatttttctggtgcttactgaaaaccctcctggacataatagagtgaagaagccccattttccctcctccccccagcgccccacaaaatgaaattatctaggcacatagctctacccctgctcctgcacatggaagatgaggaagaaaccactttacctttctgccccatgagcctcttaagaaagctcaggcctggggcaggac

SEQ ID NO: 470959 - DNA, 729 bp, Homo sapiens
tgtgggcaacccccgcccagccatgataaggtccaagtgccctgaacaagggtccaaggccttcgtggcctggccccagtggccctccggacctccccctccgcccaaactccatgctgtcctagaagtcggggtgtccagtggggtctgtgtggtgtggataagccccctacacaccacgatgtgccatcaaggggagctgcgatcacagatgcccaaacagtggatcgggggcacagggtctgctctggtcctactcaagcatctggagcaagtgtccgggacaggagcaagggactgcaggaatctggagactcctagccagcaagggcaacagggaatcttccagtccaatgacaggaagcagcaaaaagtagttggaagagccaggaccccggagttccacccagccagtgcccttatagaagctcagaccgctggtggtctgcaggcgggtgccatgcatctgctgctctttcctttgcacgttcaggagactcccatggggagtgaggtcagcctgttcccctttcgttcacttcgacttgatggttttctcaaaaacacaatggaactgctgggctggagatgttcagttggtcagaaggctgtaggctgctcaggacccacagtataatggtggccttgaaggtttatattttcttagatcattaagatgttagatggcctcatttctcaggtgtgtttctagctcaggtgtgttttact

SEQ ID NO: 470960 - DNA, 1165 bp, Homo sapiens
agcaccaggcacagtcctttcgtggttggcatcaaatgctgatggactgagcgggaggcagagaacacttccattgcttctcctccaggacagagcagtggaaccacggagcaatgggacccactctcaaactcggcaaaatatgcacctgattcttgatgcaagggagcggcctggagaagaagaagaagaagagaggaagaggaagaggaagaagaagaagaagaagaagaagaagaagaagaagaggaagaagaactgaagaagaagaagatgaagaagaaagaagaaagaagaaggagaaggagaaggagaaggagaaagaagaaggagaaggagaagaagaagaagaagaagaagaagaagaagaagaagaagaggaggaggaggaggaggaggaggaggaagaggaagaggaagaggaaggaggaggagaagagaagagaagagaagagaaaagaaaaatttgccaaatagttcagaccgaggggctgatcagcacccccaacccttgctcagattgctctggagggcttgctgagcctgagcaggcccagccggggtctgtctgccaaggtcctggccaccaggaaggatctggcacccacacgcccactccctgtgcagcctgccctgccccaccctgtgctgcaggagatggcctcccagcgagctgtggatcaagcgtcatcccccaactcttggaccccagcctgctgctccaccagcccaaattccacggccaccccacccaggccatctcaaaggccacgcgctctacagacgtgctgccccttggtcacttgtgagcacctgctatgctgtgcaacttgctgagccacaggagacctgctgttgctgctgctgctgctgctcagctctgtgggaaggagagtgaggtgggcgggtatttcctccccagcactctctcccaggctcaccacaggcagcttatttttatatatatatatatatacatatatatatatatgtatatatatatatacacacatatatatatgtatatatatatatgtatgtgtgtgtatatatatatgtatgtgtatatatatatgtatgtgtatatatatatgtatgtatatatatatgtatgtgtgtgtgtgtatatatatatatatatatatatatatatatatatatatat

SEQ ID NO: 470961 - DNA, 673 bp, Homo sapiens
gacctcaccccatcgttgctcccctgctaccctggtgttccgattccatgatcccaggcttccgtggaaccacagaatttgctgttgatgcaaactttcctgactggccggaaacatgcacgggatctacattttcctctgggtctgccagcagttcctggtactaactcccttcgtcgctggccctttctctcccagccccatgggtgggcaatgtcctgtggagactcagatgacatcatgcaatgatgagagggtggaggtgcaggagaaatggactcagcatgccagtgctagtacctacgaccaaggcccctggtctcgggcactggttatatatgaaatgtggaggaggagagatagacgccgaacactggatcaaacacagagacatcccctggaaaaggaaaagctccccttcaaggccaacaggatagagacatgtttcagggcaaaggaaatcacatttaagaaacaaggaccccagcctgtgtccaagttcatgatgtcccaattcatgatctttctcacctcactctctctcaagtcaatatgtggctagctccattcaacatgaaaggttacacagagaaaccagcccatgacctactgtactgcgaaaataaaataatcacagccatggtgggaagaaatcccttatcaaaaggcagat

SEQ ID NO: 470962 - DNA, 2668 bp, Homo sapiens
tctgctatgccaaggtggatcctgagacagaaaaagccctgggcaggcggtaatcataaagaagtcgagatatttctatggcagctccaaaaaacagtgagcccctcctccaggggatgatggatgcacgtgggcaacgccttgtagccagcggtggcggcttaacagtggcagaaacgcccgcattgcctcaccagctgctgggcacttctccttgctgctgccatatgaagaaggatgtgtttgcttccccttctgccatgattgaaacaccaggatgggtgtgcaatggcaatgacagaggtgggaatacaggattggaggcatatgccaagcacctcagcaccaagttctgccaatgcaccctcgtcctgggaaatctatctaaggatggcacaaagaatccacccaaaactcaaggcagctttgatgagcaccagccgatggaaggatatgggatgcagcccacagcagggcacagctactgtcaactgagtgcaggataatgaatgacagaaccgtatggcaccaccctgcgcagccaatgataattattacataggaacttttaacctcagtgcgttctttgctctcccccgtgagatattaaataatgcgttgatgtgaaatggatgccagttcctggacggcgggggctacctggcgataactatcatttgatgatagcctactttgtgccaggccctatttgaaagtgatgttcctagagtttatttcattattacaaccaacctatgatgcaggcactctgactgcctccactttacaaatgagaagagtgaggctctgagagggtccagagccaggcagtgtggagctgggacttgaactgggcatttggggccaacacttgtgctcctgttatatttgcgtgagcctggggcatgaggaattgctagtggttgaattgtgctaaatatatgaattaatgaccacagccagtcatgagcaataatggaggggaagagttgtgtacaacccggatggaaagagtgtcttgaaatcaacatgggaagtggatttgtacaaggctatgaggattgggacaaccacgggctccaagacgtcaggcccactcagattcaaattcttactcagtcccttcctggtcatgtaacaatggataaaaaaatcatgggttggcaagctatggcctgtgggccacacctgtcctcctgcatgttttagtaaatacaattctattggaacacagccatgcccattcgtttatgtatcgtccatggctgtttttgcactcctggatcaaggttgagtatttggaacagggaccactgggcttgcaaagctaaaatatttactctctggccctttacagaatatgtttgctgatccctggagagatggtgacttctcttgaatcttagtttctgcaggaaaaagctagctgtgagtgagagtatgagatgacacaagtgaccacggattatttgagacctgtcagtgctggttcttggtaggtgctgattaatggttggatgatgtggggaaagccagtgcactgcccaatgccacaggaggcaggagagaagggtgagcctctgttttctctgtaaattgcaaattgtaacaattcccgaatctgtgggggtggtgtgtatgtgttttgttttacgtatttacatattgaactgaatgtttgcatttcccccaaattcatgtgctgaagccctcatcccctttgtggtggctgttcctgtctcctgagctgctgctgacttcaggccagtttctccttcccctggagccttgcccctttctttgagaagaagatgttgattggagcagaagtctcccactgatggccaggcatttatttttattttacacatttttggtgtctgtaatcttcttgttactcaggttgtagcttaaacatcatgaggcccagtcagattccagtcttcaccactgcatggggtgggggtgcagcaacattgtgttgcataggagcgggattcctgcatctggaggaattcaaagcctttaagagatgggaatgaaaagagctccctctagtatccccaccccaccctggacccagatccactggcttgcggtacttagttagtcacttccacagtcttctactctctcccttgtccctcaccctccaaggggacataagtacaccctgtttagtcctctgggctcctctctccctgccccattcttctggctcctgttctttcatgtctgggaggacgctggcctctatggaggaactcacagggatccaccattgctggaagcatggaatccaggagaaggagcccagttatgtgtttacttggcatattattcaattcttagacctactgcctgctatatcctgtctacctctgggcctttgccgttactctctcctgcctggaatatgcccccttcctgtacccaggccaggccttgggttctacccagttacctccccactcatccttcctctgtggattcaaatgcccagcctcagggagcctgtctgggtttgattgctgttgctgttggtactgtttttcccgtaggtccatcctgttttctgcctttttgcgtgtcatggccgtgaatccccatgtatttatttgtggtattactccaagctccaggagggcagagagtgtatccccttctc

SEQ ID NO: 470963 - DNA, 663 bp, Homo sapiens
cacctcagagcatacactgtcctgtctgcccagcatctgcgtctgtactggggactgcttatccccagaggaaacgggcagctgtgcagtttactggaatgtgcttcagcatccagcccacactactcaggtgctcctgcctccgccaagcagcatgacttcggacaagtcatctggtctagattttggcatctgcaatggaggtgtcaatatctgcaggcagatgcagcagtaccggtcaaagaaggctctggagactgcctcccagttcagggccagctgcaaccctcacttgctgtggctgctggacaaatccttttgcagctctgggcctctgtttcctcacttatggggcaagggagagacgagcttggacctccctgggtggtggtgcttggaagcccatcacagacccccaatctctggccggatgcctgatccaccaagcactcggtccctacacaggaaagttggatttccctgcaaatctgattctttccagaaagtttcttccttcttcttctcctcccaaatgtgccctggaagggatatgggtacgtctaatattgcacaataaacgtctgcaacgaacaccagaggcagtccatggtgcctgcccagaacggaatcccagcctgcctgtgctcctccatacctgttcac

SEQ ID NO: 470964 - DNA, 848 bp, Homo sapiens
tccagtgctgtctctagcaggggacctgagaaggtgaatcccttgcttcagtctctctacgtgtgtcccacatgggctcacattgagatgatgggccacagccttcaaccttattcacaggttactgctcagcacccgccatgggtggtcagtcaggccacactcagatgtgtggactcagacatcctgtatgtgggagaaaccgagggctctgtcacacgctgcaaggcaaaggggaatgaagactgcgggtgggatgaaggtttcccaagggctgaccttaaaatggagactatcctgggtgatcctggtgggcccaatgtcatcacaagggtccttaagactgagagcaggaggtgggggaggaggccacagtgctgcccccggaggcaggcctgccctacctctgctggctgcgaagatggaggaaggggcccagagttgagggacgtgggccacctccagaagcctggaaagataggcattcaggccctcttctgttccatgtatctgtgataggctggctaccttccagaggtcctgttttctgacttgcttatattggcctagtgtgaactggtctctggtgaaacacagattttttctgtgaacactcaagagtggttctccctggaacttcccagctccttctgtcctctcatcaagcacttgttttcaggctggagaagctctccacctgctgtgattgacattctctgggccccactgtgtgatggttagaactttccaggctcaagttatcagctcttcagctctgcccatccctgggctctgaaagtccacccattcccattcccatgaatctcttcccactccctgtacctgac

SEQ ID NO: 470965 - DNA, 751 bp, Homo sapiens
ctttcgagggcataagatttcagaattttactaccattagtctggggctgggtcccagctgacactgaaggggctgacatgtacacaggcacctctctattggctgctaaaatacccaaattcttctcaacaaaattggagagattgggatcacaagtgggtagaagccacagggacaccgatttgtggtcaaatggaagaaatgctttcagaggtgactggggctatcccaagctggagtgggccacctaccagctgggaatttggttcttggctcttcggagggttgaggtcaagaaggacccaggtccagggctggagtgtgggagtggaaggggcccatctttaggcagattcttagtcaaagttcccctggtttgtcttcctccattattcttggtatttttttgtcttgaaactgatcatcaattcaattttcacaactacctttctgagttggaaagaacttttccattttgcttgtcaagaaagtaaatcttggagaagttaaataatttaatttatttaaatagacaattcttctaatttttaacaaccaaaatttcaatccatgttttatttgaatgcaaagaacatccactttctgtgataacacactagttgaatacactgaatagaaaatgatattttatttctttctccttgaaaaatcattttaatactcaaaagaattgaaaacagggacttcaacagatatttgtacatccatgtttatagaagcattattcac

SEQ ID NO: 470966 - DNA, 637 bp, Homo sapiens
agcagacacattggtgtccccatgatcactgctctcctgcagtgcacaccagcccagcttgcagctgtgctcctcagagataggctctgtgctgtctcccagggtgccccatcagggttagcctctaggtgtgtccacaggaaacacttgcacagaaatgacctcgttcttggccacctccaggaggtctccctggaccaccctccaaactatgtccttgcacacaatcctctgtctcagcatctgcttctgaggggcctcaaatcaagaccgacagtattttcattttctctcagccccatcctcatgcagaaactgggggtatcaatgcctacccccaaatggtctttccaatgcaacttctcaacagagttgcctgaaagtgagagtaaatgtcattgcacgtgcatttgtttaccaatcaatcgccgggggtcaactggacccgagtccaggctgtttgtgaggtttactaaggtaataacgataatgtagattgacaaccatatttacctgttattccagagtcatcaaaatgccttcacatttcttatcccatctaaatcttgcaataacctggggaagtcattcatttcagtccagttttacagatgaggaaagtgaggtgtagaaatgt

SEQ ID NO: 470967 - DNA, 622 bp, Homo sapiens
cataagggaggacgtttagctgatttttctccttaatggttcgcttagttactgaataagagatgttgcacaatggcggcaggagacagaataagcgcaagcaggggaaatgcccgatgcttaaaaaaaccatcagatctgttgatgataatgagactcactcattatcatgagaagagcatgaaagaaactgccaccatgattaaattacctccccctggttccacctttgacatgtgggaattacaattcaagctgcataaaacagtgaacatgctggagataatgatgatgatgatgatgatgataatgatggtgaggataatgatgatggtggtgatgatgatggtgatgatgatgatggtgatattggtgatgatgatgataatagtaatggtgatgatgataatagcaatgacaacggtgatgatagtgatggagcaagagatgcaccattccagctccccactgtttctaagagaggaagcagaaaagtgaaatgtggagaggtatgtaggtgggagagaggatgggtggttatacatgacaagaagctaataaaatgaagaagtaatataacatatgaggaaatgaagataatgaaggagggcaaggatgcaga

SEQ ID NO: 470968 - DNA, 1007 bp, Homo sapiens
ctcagataacagaagctggcaggcgacaaagtttgtgtttctcatgcaataaactttcatagacctgattcaaagaggccggaaaaaatgtcctcattttccttgacagacgacgtgctgtgttctccgggttgctgatcggcaaatcggaacagacggtttttcctttttatccctcctcgttaccccgatgtggctttttggtctttctccaaatgaagccctcggtgagacattgcaagatgaaagggacggtggtcgaactctcctggattacactagacctggggatccccagggacaaagaagcaaacccgggcagagacaggggcctcagatgagtggaaccaacaaaggatgggatgaatcttaccaaatgagagagctgctccgctgcaaggcagtggtgaattctccgcagcttcatgtgaagggatgtccctgtttgcagaccatccccaggttgccagtgaatgtgataagtctccaaccagtgccagggactatggaaatgatattggacaaaaagcaaattcgagtgatttccttattcgagttgaaattgggttgtaaagtagtggagacaactcgcaacatcaacaatgcatgtggcccaggagctgctaacaaacgtatactgcattggtggtgccagaagttttgcaaaggagaagagagccttgaagatgaggagcatagtaactggccatcagaagttgacaacgaccaattgagagcaatcatcgacactgatcctcttacaactacacaggaagatattcgaagatatgtatctgattttaagcaatttttgatgcataacataaagaaattaaggacagtttggtagactaaatcagatcatggcatgtgagggacagaattgtaaggacaaaaaacatggtgggcattggaatcacaataagacacttgttagcaagaaagactagtaggttttcattaattcattcatatgaaagtattgaatatctgcaatgtaccacatg

SEQ ID NO: 470969 - DNA, 675 bp, Homo sapiens
cagccagtctcccctcatcctaactggctctggagggtgggcgtcacgagctctctgttgctttctctctttacctgatgctgatcttgacactagactttcactaacaactccctcggtctccaggtttatcttagagggagtgtgttaggatatgccagacgcagttgccaggctgcatgggggagatggggagaagcagatggggacttatcctcatggagcctctgatcttgtggttgagaccagcaaggcagcagaaggcaggatggagagctgcaggggacagaggaggaccaatccaccctggggaggctggggccagggaagacttccagaagagatgacatctgaagacaggagttacaggctcctcagcggtaggaacctgatctggagagaaaacagcctctctggcatggaagaccttattgttgggagtcctgagcccttggccctgtggcctgggagcccgagctgttgctgggacagcaggagagaatcgatcagaattgcctgtcctagaattgaaccatgcgggcttgagccagaaactgggctgcagcattcattcatcctggagggaggcccagggttgggccccattgcccaggacaggttcacgtgtgataaaaataccatggaagggcccatggctgactcttggtaatgaat

SEQ ID NO: 470970 - DNA, 599 bp, Homo sapiens
gcacatagctgactgctgaacagcagaaaccagtgtcctgccaagtcctccgcggtgctctggacccagagccagaaatctgctcacctccagcgtcttaagacactgaaatgagaacccgcacagcttggaaaaccagcacataaaaccaggctctgtaagcagccagcagcagccggtccaattatgaagaaaaatcaggcaaagatggttcagggcacccaggggttccatgctgccacagaaaccaccctggggcacttgagtcctcatcgcagaaacactgagacaccccctgagggtggaagccaggggctgctcatccccaggcctgcaggagatgcagatgctatgcataatgggcaaaaatttgagaaaacactgtggtatttgaactccaagcagaaaataactaaccgtcctttctataaccacagcacatggaaaggacaagggcctcttggaggacctcctacaggatgccagacacagagagctgcagcaacatgcattcaaccccaacactgcactagacagactgagggcatctgcaagcatctacagaagcagactcgacgtttacagactacatgagagct

SEQ ID NO: 470971 - DNA, 629 bp, Homo sapiens
ggctgggaagggaggattgaggagcaatgcgtaagagttccgatgactctacatcctcacagatgttagactaccactggccagggttacacaaatctaacatgaagccagacccctctttgccaccagtcttccgccccagccttcttcttgtccttggtgtatttagtgcgttggttttctccactactatttccttggctggaatgctcttcaatcggatctggtctgtggctctctcctctgatgtcattgaagttgtcttctcagagaagatctccggagggaggactggacaaatcacacctaacagcgtgtcctgtgtcacagtaaaatgggcaggtgtttattgccacttggctcagtcacaaaatgccttggccctgggaaggacaggagaactgcaggcagagcagttctctgcagggcgggtggaagctgaaggagctgacagccaaatgctgtttacagaccacactccctactcctgggcaggcaagtctggacttcaaggggaaggtcagcgactcagcctcttatgacttccacacttccttgcaggtatgactttgcatcagctggtcataaacacccctcacaatgatgaaagcaatggactctgtctctga

SEQ ID NO: 470972 - DNA, 614 bp, Homo sapiens
tactgccgcaaggcttcacagacagccaccattacttcagtcaagccagagttcttacacaagagccgggaccgtgccctgctatcactatgcccccctccactacctctcagcaagctgaactcgttgccttaacttgggccctcactcttgcaaagggactacacatcaatatttatactgactctaaacatgccttccatatcctgcaccaccatgcttttatatgggctgaaaaaaatttccttactatgcaagtgtcctccatcattaatgcctctttaataaaaatgcttctcaaagccactttacttctaaaggaagctggagtcattcactgcaaaggccagcaaaaggcatcagatcccattgctcgagacaatgcttatgctgataaggtagctaaaaaagcagctagcattccaacttctatccctcacggcagtttttctccttctcatctggccactcccacttacttccccactgaaacttccaccatcaatctcttcccacacaaggcaaatggttcttggaccaaggaaaatatctccttccagcctcacaggccaattctattctgtcgtcatttcataacctcttccatgtaggtt

SEQ ID NO: 470973 - DNA, 570 bp, Homo sapiens
tgcagcctgcagccactgccaagggtgacacctagtatattgccatcgctaatgcacgaggatgtttgttccattgaaacctatcattttactcaaattgatgacttctaccacttgctaccagatcgggggctcttgcagggcttggtaaacttttgtgatccagggcccctggtgcttcattctaacctggggaagttccttgctgccaagaataggcaagcacagaagtctgggatgcaggtcctgccaacagaactaattgtacagcaacattctttggcagttccacaaagaacgtcaggactgtcaaaggaagtatctcccctccttgttggagaggtgagtggcatggagctcttgataactttctatgtgagaatgcctgtgttcagagagaaattcagtttccacagtgagggctccaggaggctaccacaagtggtcttggagagaagctgcatctgggctctagaggaacaaggtccagacacacctctgcaaagtcccagttctaagtcttagtctcaaacataatgatgtctccacccatggctgcccatttgtccc

SEQ ID NO: 470974 - DNA, 826 bp, Homo sapiens
gatttccggagtgaaggcagaaaaccaataccacttcttcttaaaatagtaacagctaaactcctagtgcttacatgtggcagatgctggaccaaggcatttatgtttctcgcgaatcggcagttagtgcaggactcagcggaaatggctccactcactgtcagtggggaagcttcagacctaggactggaatccttaagcgtttgcatacttacagttacccaagtttacacaactggcgagtggtagagtccagtccaaagagcctgtccccaaagcctctgactccccaccctggacttcgctgttttttccatatacctggaaaagaagggaaccagggagaaaagaggtacaaaccacagaagaccctcctctctccggccctgcttctgtacccgaatcctgtaaaaaaaacaggacaaacaacaggaggagagagcccacatacaggagtgccattgccaatggccaacaaaaatggcagaccggtgtgtggagccttcttggccactgcaaccttagccatgttcctggctgaaggcggctcacaggggaccaaagaaccacccaaccgagccctgcacaagtggttgaattacacggatgtctcttattcttgtggtggtttgttccacagcaaaacgtaactgatacaccaggaaagatccataatatttttatcaccacagagcattaccttatgatcacctgtagtcaatcctgcactacacgcacaggaccagtttactttggtttttcacttagttcttgctcttatgacatagaatttctgtgttttcaatgagaaatcaaatgttttatg

SEQ ID NO: 470975 - DNA, 570 bp, Homo sapiens
cgttccttctggttcccaagtattaatcaaccactgtgcagtttaaaaacaaatatcagccatgagtatgaaggccatggcggcattattaaaaatgtacgggacagggatgggaaggatggggctgggggatgtggatggatttcaaaacctggaacaaatgaaaactgacttccaccaacagcccaccaccccgggggcctgcctttacaaaagcgtggtggccggtcacagtcagtgccctggaaatgatcagaactactgctgggtacatgccctgagagatgctcagagcccatcctctcctccaggagcagcccatctgacccctgtaagccggctgactaagtgttatcaattcatactgaaatttacactcgcctcctcgctctgttcccatcaaacactgtggaacattttgtcctctgttctcaagcaaaagaatggtccctgcgtacctcctagatggtgatgctgggtatcacatgtgggccaaaggaagcctgggagggtctggttttctcaatgtggagatgtgtcccctgtctagtgctttctgagagagtccat

SEQ ID NO: 470976 - DNA, 597 bp, Homo sapiens
cactgtcactaagattttttctgtgtggattaactttggagtatggtgataccttcagatctgaagacctgtaatgcagaggtaagcatagttctacaccctcacctttctgacacctgcctctcagaataccaaggattaaaggaagcctggatgtgcagcttagaatccagatcccagcagagagaagtgcgcacatcctctctgctgtgtgtgttggtgttggtgggatttgcagccagcacccaccttccactctcgtttgtcgggagcataaacagaagccaggacagggacaaggtgacatttgatgaaagtcacacagccatcttgagccacactgggcagcctcttgccttttacctagtgcatgtccttcaaagaggggtaagaaaggagaagagtctaggagtgatagacaagataaaagctttaaaaagtggcctctgggaactcagtgctctggaaccatgtgggcatgtggatgctaatcagcaggcggctgtccttgcttcacagcaaagccagggcgtgggaggaaacactgactgtgccatgtgtgagggctgcagctgacccgatcgactggttgactgg

SEQ ID NO: 470977 - DNA, 1467 bp, Homo sapiens
ccctgactaatgaacaaggtttggaagagagatgttacaaatcagaggacatcatgaagcagggtgtgagcttctactgctacatgagcctgttcttgcaagacatgtaggggagaagatgaggagaattgcaggtagaactgagactcagcccattgaggcaaggaagcctccagactggtgtaggtatttctggagcccagaggagaagccagagacccatactctgggcaaaggagctgcctggcaggtgctgatatctccgagcaggtttgatgcactggatctctggaaggaccacacggaaggcaagtccggttattggaaccacctttggctgccagggatacctagcacggggccctggagaatctctgaaaagagaacaaccaacaagcactgtaaggagacaaggttcttgcatcaacaggtaggggccagcagatatcacgatttggatgttgatgaactatgaccccatttttgtattcacgaacttttgaagcatgccaattatatgaataatattgaatggaaggcaaatgtgatggtatataggaggtcactggctaaataaattcagacacacttacacaatgaataactctgcagctattaaaaataatgctgtaaaataatatttagtaatatgggaacatgttcatattaggtttttttaaagtttatgaatgtgttacattttcaatatacaaatgtttatttttatctttattatatattatatgtattataagtatattatatgtatgatacatatatatattatatgtatgatacatatatctattatatgtatcatacacataatatatatgtatgatacgtattatatatgtataggcatataatgtatgtattatatgtacatatataatatgtaatatatgtattatacataaactacatattacaaatataaattatatataatttatatattaatatatactatataatatattcaaatattgatagcttgtattagtatttataattaatatgacatattaatataagtaatatattacttatatatgtaatatataaataatatatcattaattttcatgtaaaatatataaagacaatatttacatagagtaaatttatatatttgtgtttatattttttatatattacttatgcagaagtttctacaataattgttatagtgtatctgtataggttcaaccagatatgatttttactttgcgtgtttatattttttaatatgtcctgaattttctacaaaaaagccattttttacttttataaaaatatttacttttttaaattaaagaataatgtgaaatgattggaatatcatcttctcaaatccttctcaactatttaaactcctttctatcctgtctcgagcgtagaaacataccttcatgtactatagaatacatgatagaatacatacttttctatactctatacttt

SEQ ID NO: 470978 - DNA, 583 bp, Homo sapiens
cctgtacatcctcagggtttagaatagggctatcgttataataggtgctcaataagtctttgtaaaaggaaggatgtatgggatgtggttgtttgaatggtgtgaatgatggtggcagtgggcatgatgatgatgggagtagtggttgtggaggtattagtgttgatgatggtgacagttgtggtagtgataatagtactggtagatgtggttgtgattgtgttgacagtggtggtggtggttttggttgtgttagtggtagttgttttgacggtgacagtgagtgtgatgatggtaatggcagtagttgtgatggtggttgtggaggtgatgatgtggtagtagtggtgatgcttgtgatggaagtgatggtggcgatgataatactggtagatgtggctgtgctggtgttgatggtggtagtgatgatggtaatgatggttgtagtgatggtgctgatggtattgatggtgggaatttgggtaaaggagatttaggaatttatttactgacttattttgcaacttttccgtaaacctgaatgttttttgaaatagtttttttagaaggaagggaggaaggt

SEQ ID NO: 470979 - DNA, 608 bp, Homo sapiens
gacacagctcctgggtcccactcgttcctccgtgataacagaatgccaattcagatgctgcctgaaatcggcaatatttacatggtctctagactacatcgattcgtagagcagaggtgggatctttatgtcagacagtatggagaatttcaagttaggaatatgtattgccgtttcaccttcatgaacgtattccacccctacaacagtgagcgagggatttgtttctctgtagagcccccatccatagctgtccctctcaacctggagattgtattcactttgaatccagaagctggtctctctggggcatctggagtgactgattttacccagttacagccaatctctttgtttagcttaactggtcacattaatcaaaatagcagctctggttccataggcagtcctcctctgaaaggctcttcctctcttacatccataacaatcagtgggtccacaatggtaagttaatgcaaaagtcaacattgcctaaaaacacagtctgccaagaacagcacatctctgaagggctcgaccataagcctgcaaatgcactatttgcaattgttctgtttgttaatttttctttgaattctcagcctctc

SEQ ID NO: 470980 - DNA, 704 bp, Homo sapiens
ccatttgcagcaggatggatccactgcaatggtgggaagaagaaaagaagttagaaagcataagggcagtcaaactggcatttgctttactccgtgaacttctgcaaacttgtcctgacttagaggctttgcaactgctgttccctcttcctggactgctcttttcccagatctatgcagggctagctcctacctgttctgagcaggagtcagcagatgagatgcaaggaaaagcacagaatgaggcctggcaggaagaccccaagctcctgcacattggtggtcttttgaggaattggtgggatttgaggaatgcaagtagcaatggtggatggagaaaatggaaagagaaaagaaccacatacaggaaggcctatccagaggtcactgatgggcagagggtcgtccaggcaatgaccacaccaagcagcagaggaatgacttaaggagcttgtgctgagggaggaggctgtgtggttatgccagtttttccaaattgttgcaaatcttaaaaaatttcccaatatatttattggaaaaaattcccatataagtgtacctctgcagttcaaactcatgttgtccaagggtcaacaccataaatatttaggtttttaattttgtcttatgtcagttttctaagtactttgttcattttatttagattgtccataatattctcttattatcctttcaaagtctgt

SEQ ID NO: 470981 - DNA, 614 bp, Homo sapiens
agtgacctgtcagctctgggaagtcagccagtggcctgacattacctgacattagaaagatcagctctggcttctgagaaaggtgatcctatggttatcacaggggcaacattacccccggggggttgcaatgcaagtgcatgtaactaatggtgtaaggacagatagaaccccaagacacttcccctgggcaccagtgtcaaacagcagcttctccttttttcctgtgggagcatctggactttcatattcaaagagaaatcctgtcaggcctcatggtcccctgaggaggtcatggtctacttcaggcctgacagcaacttggccaagttcactctgcttggcgattaggcaagacccatttatctccattttaagggggaaaatcccctactgggatgctgaagtaggccagtttgtcctggctcagctgagctcagactcattcagtggtcttgcaattaagcaggacttaaaagctctttggaatgacttcccctggcagatattgctgaaatgtgagagagtatttctggtatacatggtagccttgcatcgaattatcccagcagaatgtttgaaatggaaaaagtcaatgctatgttggtgacatt

SEQ ID NO: 470982 - DNA, 597 bp, Homo sapiens
cagagccctgcccatgaggaatgcacagtgtgcagaccaacgaaccacgacaacgcagtgggcaagaaaagcagcactgttcaatcacttactcaaggaacacatttattaaggcctacacgcattcaggaaatagatgtaaaagtacagtcctctccctcacagtcatggtcttaggggaagaactttgcaatgttattcccgccagccaggaatgtgatggctgttgggtgggggtgaagtcaaggctgtgtgcgctgagatacccactcccttttgaatctcccccaaggacagagtccacagcccccagaaaacttgttcttgagttttattatctccatggccaaaaatgttctttgtctaaccaaaatcagtattaccttgaattaaaatctacttcctcttatttgggctttgaaggggtaggacagtgtttgtcaccctaaattatgagaaaatgctttctaagctatgaagtcttatgaaaatattaagtggttttgttttcatcataggtaagatcatgtagcaggtgaggtggaagctaaattttattgaataacagcctgttccaggaactgtgctaagcacatt

SEQ ID NO: 470983 - DNA, 1515 bp, Homo sapiens
aggccctattgagtacggagaggatgcattacactgggagtcatgtgactagtcatatgaccacaggaggccatgttacttctctgagctccagtgttcttatttatgttattattttttgggtgtccagaaaaatcaacaagcaaaatgccatgaccattccacaaaactttgctataacttttgcttttgaccagtccacctttgctctgactggaccccttccctccctggtagccattgctttgattgtgctttgtcttcgggatcgtacgggtaaggccatgtttcatctcctgttacaattctttgaagaaatgctccagaatcttggtcctacttgtttaaaatttccattcaaagctctgctcttctctgcagttgatctggggagaactacctatttactgacacttttcacacttatggtcatcctgctgctgtccccactacttctgtccctaacatacccagttccttggtctgtgcctaacctatgggcaagtaaagtttcttccctgagaatgaccaatggaaactgaaagagttcatttcccacacataaattcggtgaccatgatttatgaatcatgatttatggtctataaataaagaagattcaaacagatgtgaagggagagctagcgaggacagctagagagagagccctgatgcattctagttcctggttacagttctttcctgaagtctccctgcaaacttgccctcaggtgctttgagaaacccacctttttgattaggcaagtgacctacggtaaaacaaattctaagtaaacttaatgatttctcacagattgtcctgtttaatccttacaataacacagtgggggtggtattactatccccattttacagatgctttttgttacatgaaaattagtccgagattaattgttagggagacttaagttctagtctcaattctacaatgactgctacttctaaagcagattaacttccttcagcctcagcctttctcaaaaagcaacttagactggcagaaagattcacacaagtggttaagcaagatcctatttgtaatttatgaaatcaatggccatgacctggaagacttcgtatgggcagagctgtcaacagcatggtctgtgtctcctcatccctaagtgcatgaattagattttatagcatgtaagatgccttcaagctctaaaattcaacagactattttctggccccagctagcaacaggttcattctcaatcatgaaagaactgaaaatggctaataaatttggtgaaacatttggacaacacagtcatggaaccacttgaatctataataattctttttggctctaaaaacctttggaatttttcccttttattataactacatggatcattacttggcaaagaaatttcccctaatattgatctatgaacataaagaattatatctcagaataaaagaatataaaaataaagcctactaacttactgacaataaaagtaggggctgaattttcatgaaaac

SEQ ID NO: 470984 - DNA, 667 bp, Homo sapiens
gtgggatccaggccggaagcgtctgagacctttatggctcagtttctccaaggggcatgcttcttgtttcctgtaatagggcctgcatggtacaagtcagcttgcttctcattaaccatccctctgaaggcccctgggcttggacttcctccactccactggcaccacctgtccatcatcccctcctctcctctcccgcctgtctgtgattgtgcttgctggaagtgcagcagccttcttgtgggcaggaggatgacaccacatgcccagggtgcaggagcaggaagacagagggcgggtggggtgttggcagcagtgcaagccaccagcagtcctggagggctcacagctgacccttccgtgaaggagaaaaatgatttcctgtttagttcattcacttcttatcttgctggtcaaagccaaagagatcctcaattttggttttaccctacaagggcagcagaggaacctcctactgttctctgtgtgagggtcactcagcaggttctgagacctgctaaaattgatattactaatagcatggatgcaggagaccaactatacgggtgttaaattctgactctgttgctctccagttggttgtattttttcagggtctaccagagaaaacccgacattaggaattagacacctaagatgtttaaaa

SEQ ID NO: 470985 - DNA, 696 bp, Homo sapiens
tacagaaaatcagagggccgctgcttaatgatctcggccatcagccttggaggggaacattccagcttcttatagttatggtgaagaaggccaacaccagcatgtcactcatggtccagaccgatttcctgatctgggtggccaagggtgagaataacatttccactgagctgattgatgaaggacacggcaccgcagtgggccataaagcagcggcaaagggagcggccagctcagatacggcgcaggagatgaaagctcttccatgcctgctgacagaaaagggggaacctgacactgccctgggcctgtggggctcctccccgcctccgtcttctggaggcacagcccacgagaaccttccagaacacactggagcccggcaccgtggaactgttcagctaggctctggcttgtttggaatttcatctgacttgaaggggcccgtggactcagaggaatttgggtctcaacacagtcccggtgggatttaccccagaccgaggaatgcttgttttactcctggatctgctacacactaaattcgggactttcctcccttctctacactttagtttctttttatgtatgtggaacaggagtattagacactctgcgattttatcagaaaggattttacaatggttatactgtgatttctccttttccctgagtacatctcctcctggctgagag

SEQ ID NO: 470986 - DNA, 1360 bp, Homo sapiens
gaatgccttcaacagtctccagttgtgggtcagagaacagctgtgcaagaacggcaatgccagaggaatgaaggatgaagtgccttgtgatgtggggaggagagaacgtgctcaaaagcccctgggaacattgccctgtgaagggcagggcccagaaactttggaggaggcagtttcttcagtcacagcttttctcctggctagtttgcagagagagctgacggtccagtgggaggaaaagggtgccgagcaaacctgcgcagcactgcagtgcagcgcaactgatcagtcccacgtgacgcacaagcagagggctgtgagctttcagaggggccattccatgtggctgggggacctgaacagcccatctcagagaaggaagggtttcatatggagctggagagaaaacaacaggaagcagagacaggagtggacaggatgcacgtcgggtactcaaactcatcagatttgacagaagtgcaagaatgtgagagcaagggggaggtctgggaggaccatccacccctcctggaaggccctgactcaaacactacaacattagatcccagcttcccctttgacagagttttgcaggttcccaggagagaggagtggtcatgaaaagggggtggggcctctctctggatgggagaaggcactggaactagtaagctatcatctctcagattccgctttgggcttcgccttccccagtagctgtcacctgcctttccctttgttgttggggcactctgctacaacctgcttcatgctccccacttactgcctccattgtttccctcccactctgtgcaataattccctctcctcccttcttcttccaggggccttgttttaggcttgaccttggcattgctggcatcctaattcctgcaacgagcatttacttgttcatctaattcatacaatgagcacctactgagctcagtagtgagttcttctaattcatacaatgagctcagacatgaagctgcccctatggcctcagggatcaaggagggctgtgtagggccatggtgtctgccccctttctggtgcccaggcagtggcccctgactcttgccataagtcctgttcctagtcacatggccacaggctctacctctttctgccactcctctgaccctctgagggaccctggaatccatcagtggctttcaagccccctgaggcacacaggacttggtaagaccatctaaggaccatctgcagcatcttttctcaaaggcctgaatgccttcctggggctctgcctagaaacagggcccagattcctgctgttgctttttgaagcccaaaaaccacactgaatgttgctctccttcctgaatctctgcct

SEQ ID NO: 470987 - DNA, 842 bp, Homo sapiens
ccaggcagagtgagcagcaggtccagaggcacccaagcccaccataggtggtgacgataggcagatatgtctggcacataggaatgtggagggaggtgctaggagatgagcctggaagggcatgtgaatgacgttgtgaatggcaggccaggaaacccaccacctctgccatgtcacccaagttcaaccccaacaagatcaaagtcgtatacctgaggtgcacgagtggggaagtcagtactacatctgctctggttcctaagatcagccccctgggtctgtctccaaaaaaggccaatgaggacatcaccaagacaagtgactggaagggccagaggatcccagtgaaactgacggtcttggccccctacttgtcttccctggagtcttctgtcctggtaactgctccagagtcatcctcacagcgtcttcctccacaccctctgttgagcacccaaagctcaggatgtgccacaggaagcagggagagaagacgccaccctgccttcaaggagctcccctgggagctgggtctccccagatgcatttctggggatgtctgtgaagcccatagctgggcagcccagaccgccccacacaggaggcgctgggctcaccagctaagggtgggagctccacctggtcagatcttgctccaggtcacttttaagattgcagtgcaggcactgggcactggcctgcccgaagcctgccttatccagggactcatttcctggctttgcttctcctctacccagcttatgagaggagtgctaggagagggagggaaaacagaaatctaaacttgctcaggggtcctattttgtatcttccctctgagc

SEQ ID NO: 470988 - DNA, 677 bp, Homo sapiens
tattatttctgcttggtaaaatgcatgaatccatgtgtccctaatcttgttgcctgctggtaggggaaagatttttcatgatccagcacaactcaaacttacagacataggtgggaaatgaggcaactcttcaaacacattcctagtctcccttcctgtggaaacacagtgggtgcatccagtggacacacgtgggttcaagaccagacacctcaactctgcagacctggtttcctcacctatgacatccctcctcgcaggtttgctggaaagattgaaccagctggacacagccagtgcctggaactgaattgttcacagctggcagcatggctgaatgactcacccctcccggaaggatgcctgtgtcaacccagcagcttcattcaggtcaatgcttattccctgagcacccgagcccgggacctggacttgaatggaagtcaaagaacctatggagagaaggctgtatatgaaaaagactaggtcttttttttattttttattttgacttatttttttttctaagtcaggtgcctctggatatgaaaaagactaggtctttttaatctccatttctctccccacctccttgtacattcctttctcattccagataattgcctcctccctgcaggtttatttccaaagcaattcaagaaaagctgtttgatggg

SEQ ID NO: 470989 - DNA, 650 bp, Homo sapiens
ccctgcctgcctgcacagctgggcctcatgacccaaaagacccctgtgtgggcttctgtccttgctttctccgggcaacaagggagagaccacacactattgtcccagccccaagaagcgccaagggagaggacaaagggccaggggcacctactcagtctctacccagcaacagtccagcaccctgaccatctcctctcccggggcaaggccaggacagcactgagggcatcggggcgtgcccgcctgcgccctcctagaacaagctttggagaacgtgtgtcatggtgggtatttgctgatggtcctggcagaaatgtgaggagatgggaacagcccactttgcactcccccaccctaacccccttccggtcccgaagtctcatgcaaaaggaccagcaggggaccaagaaggacggcccggattccagaaggcattggcagtgggatagctggctcatcctgtcctcctgggagaagaggggcacaggcacccagaatgccatcgggagcctggcaggacttgcaggggcagaatgaatggggccaaggagatacctacacaccccgtaggctgggtcagcacaaagggggaaatgtgtgattcagccccagaggggcaattgagtggaggctttgctcggagataa

SEQ ID NO: 470990 - DNA, 717 bp, Homo sapiens
attggagaaagctgtgggagtcttctagaacaatcgtactaactgcacacaccatctgcatgaaccaataccaggttgtattgaccttgtacccgcttaaactgtacaacttgaccttcatggtggcagctccaggggaaaagaaaagatggcaaagggaaggagaggatcatgggaagagccattcttcttatgagaagttttggcaacttttgaaaatggctgtaagaagtgggattccaggcagaactctagacccacctagggcagcagaggcagactgtgaaacccaggcccacagcttttggctgaatccacatcaaacaatgagactgcttcaatcctcatatccttttgttgtgaattgcaagcaggaggcaagatgggcttgtctggtaaatgccacctgtggatcagaatatctgatgctgatcctgctggcccaaagaccaccctttgaatacctctgctctagaatatgcatcatccctgatgtggccttacacatagatattgctggcagtgattcaaatggctgccattgggatgctccaggaggtccccttggttataaaatatcattccgattaccaagaagcaacagaacatactggttaaaagcatgtgctgtacagccagactaagggaatccaagctgactttgctcaacactggctgtgtgactatgggcatataattgcttaaagtttatgcctc

SEQ ID NO: 470991 - DNA, 1023 bp, Homo sapiens
tcttttgggaaaaccaattggccatgtgggattcttttcttaaagttcggccccacatggttcatgtggaaaccacactcccgcagtccccaggctcccctcagcatgaggacagtggatccaaaggcaaaggagaagaaaaacgggtctccagggacagaaaaggtgtgctccggtgggagggacagcctcgttccaggcagcgcttcctccctccctcccgcgcatggtccacgctcaactcattcatcgacagtattcagggctccctgagccgacgcctggttctgtgccagctgctggctactcttctgcaccggggtttccctgggccctccattcccaagaagggggccctcccttgccgcctggggtttaatctccgccaggcctgtgcaccgctgggctgctggtgtgtggtccttctcactcatgtgcctcaacagctggaaatagtgaggcgggaagggggacgtcgagcataaaaccctggcacttctcaaaacaaaacgaacaactccagcttttaatcagtgtagggcaggggcgggagaattgtgtttggtttgacatagacaaagccctttttaggtctctgctttccgaggaatctgtgactgccctttctgaaacggctgcagaaccctgggctggagatgctgggctgttcagcagggcctggggaacagactggacccacttggcgcagggtagggatttggcttttattagccagacccctctgcagtggaaatgatatctattagtctcctcttctgctcttggaagccggaagaaccatagcttttgggaatgtggtccgtcctgccttgagctttgataggtgggctccttcaaagaggagactgcgaatttgagttttaaaaatgaatttctacattatggttaggggaacttgctatgtatgggaccccaactgtgaaagaataaatttgcaaagtgaagaatcctgtcctattcctgctcccagccactgccctgaccagatttttagataccagg

SEQ ID NO: 470992 - DNA, 862 bp, Homo sapiens
tgaagtatctttatgtctagcaggatgtgggtgggaccagataagagaataaaagcaggctgcctgagctggcggtggcaatgcttccctgtctccttctgtactgtggaagctttgctcttttactctgcaataaatcttgctgctgctaactgtttgggtccacgctacctctataagctcttcattcctgaagccagtgagaccacgaacccagcaggaggaacgaacaactccagacgcgctgccttaagagctgttaacactcaccgcaaggtctgcagcttcactcctgaagccagagagaccacgaacccagcaggaggaatgaacaactccagatgcgccgccttaagagctgtaacgctcaccgcgaaggtctgcagcctcactcctgagccagcgagaccacgaacccaccagaaggaagaaactccgaacacatccgaacctcggaaggaagaaactccaaacacatccaaacatcagaaggaacaaactctgcacacaccgcctttaagaactgtaacactcaccaccagggttcgcggcttcattcttgaagtcagtgagaccaagaagccaccaattccggacacaatatgaagtaagttttcctatgtcttttaaaaatatatattaatatatttaataagaatttattaccttttcactaccctatttggtactattcttattcattttactttttatttttaaaaacttttgcagtggtatgattgtatatggaaaggtcaatgaaaaaaattcactcttcctaatctgaaatggcatgtttattttcatttatttatttttactgacatgaccatataagggttagtgaaagaaaatgttcact

SEQ ID NO: 470993 - DNA, 834 bp, Homo sapiens
agcccagggaagaggggagcctgccctcccacaatgtgactgatgttacagaaaatgcgctccaggcagaagacaggctgcttggcatttagctgtgcggtgaggaatggcctgatctggctggtaggtgagtctaatgggctggagagcaacgagcagcggggacgcaccgggagctcctgggacttcaggctcccgtttttcagatctcttagacagagccttgccccagaaaccgtctgtactgagacttcacacaaggccccatctgtgtgtggatataaaccagagcagctgagaaacccgccctcccctctgagacctgggcaaggctctggagcacagaggaggaggctggagcgcatgcactttgatcctccaaaagggagctgcccccacctcagacacccctcccccaaattactgaagcctatccccccgcccccccgcttactctgtgcaagcagagtaagcttcgtgtccatggcaatgaccatggccttcaaagttcctcttcccatcctcctgtgagatgccagggccatgctagctcatgcttattcacaggataccaagagaggtgacgggtggggggctgcgaggcacctgggggccccagctctgaaattcagtgtcccttccacacattccattgctcgaaattcccatttcccatgttctttaagtagatgagaagcctgcttttttgccaactgccacaaggggctggactttcctccctttgaatgtgaccttgaaggtcttgatgcatattgagaagggcatgggagtgattagagaaatgaaagaaaatttgtatttggggttcctcat

SEQ ID NO: 470994 - DNA, 1034 bp, Homo sapiens
ggccacatttgccccttcccctcctggcagcccaagggcccttccaaaagcatatgccagaattggtttctgttgctcataatgaaaacaccctgcctgaaacaaagaaaatgtgatgtgaatgtgtatgtaaaggaaggagggaagctggggggagacctgggggccttggcatctgagatcaggatgttcggctggatggcttcctgcctcacgagccgctgcctgtctgtctcctctgctggatcttccttctcgccaagaagacccctggaagaccctactaccaaccccgcagttactcctgatggctttacctctaaagctgatcctgaggtgactgcccctcagcaccttacctttcccctgagcccaggcgccaccagctcccctgggcctgcagcggccgctgacccatgtcccacctgccctctcctcacagagctgggtggtctcactgaggtcaagaagctgccatctgtgaaccaggaagggccctcaccagacaccgaccatgctggggctttgatcttggacttcccaagctccagaaagcgcggctttccgggccctccgggatccactcctgcctgcttccccagcttcaccttcaccaagcagcatgatctaagtgtccacgaaggctcccttgccaagcgacacgtgcccccagcagcttctaccgtgtaagatgccattacccttcttcctcaccttttggaattcaactcatcattcaaagctctgcctcagtgcctcctcctccataaagccttccttgatttctttctcggaattgctctgcccgtcaccgccccatgggagtctgctcatatcccattttaatgtaaaataatagaaataatagaaataattagaaattattagaaataatagaaattagaaataattagaaataatagaaatataaataatagaaataataatgtaaaaaaaaagaaactctggaggcagactcaagttttatactgggtctggcacatgctggctttaagatgttggggcaattactt

SEQ ID NO: 470995 - DNA, 653 bp, Homo sapiens
ctcccaccctcacccccacctcacttctaagacactcttagctcgcatgccaaagtccgtctgctcacgtctgctctggtctttgggcgccgcccttgaccgagaggaataccgaacgttcccctcccaccagcacccagagttccagtttgtttctggactgtgcacaaagctcagaaacagggaaagaggctggaaggtcgcaaaggaggaagggaaaatgatatttaactgcctcctcaagagagtcaccatcaaagtcaagcaaggttccaaggtcgggacggactatcagctgggctcctggcggcctcaccagccatccgagagcccaagggtctggaccgtttcaggccggtctggcacgagtatctctccaagcgtgctgaaagtcgctccaacaattaagcttgaccctcatccgccaagaccacatatcactctctcctgcccggatccccaagcccacctgaaactcagcaggcccacatactggcagaagggagatctcagggctacaccagactggggagccatctgaagcccaccgtgaaccaaggacacaaactctggtagaaggcatttaacattctctcagacgaagcagaggagcccctgagcctgacgaagaccccctgctccctcgctgaacc

SEQ ID NO: 470996 - DNA, 483 bp, Homo sapiens
gagaaagggctggaggaggagcaggtagtagctctaagcccagtgaggagtagaaagatggctgtcgacgaaccaggaagcaggccctcaccaggcactgaatctgctggcacccttatcctggacttcccagcctccagaattcctggtggctggcagccatccctggcgttctttgtggctgcatcgcttcattctttcttcctcttcacatggcctttgatatggtttggctctgtgtccctgcccaaatccccagtgttggaagagggaccagtgggaggcgactggatcatggaagtgcatttcccacttggtgccattctcgtgacatcctgctccagccatgaggactcctgcttctgctttgccttctgccaggaacaaaagctccctgaggcctccccagaagcagatgctgccatgcttcctgtacagcctgcagaaccacgagccagttaaacctcttttctttataaatta

SEQ ID NO: 470997 - DNA, 821 bp, Homo sapiens
gagattctgcctctttagttgcaatggtagaagaagagagattagagaatctcacatgggctttccactacccctgcccagaagtctcagacatcattccttctcaagtccatgggctagaactgaccacaggacccaacctacctgcaaggaagctgagaaatggggacccagaggccacagaccctgctgaacgctgctcccactttccagcccgggggccactcaagccataccatgggagccacctccaagtccaggccccacatcccatgaggcccagagagagaaagccccctcctagcctgaatttcctgtccaagggtgggcctgtctgtgggtcaactaacagcgagaatagctgctcccaaggaggcatagccttgccctctgacccccgtaggacaggagccccagaatccatgggcccagcctcggtacttgggcagaagaagaaacacccacaaacacgtaaacaaaatagcccacaaacacgtaaaaagatgttctgctccaaaataattcaaagatgcaaatttggtgtctgtgagcttgagaagttctggaggatccaatgaggtacactttccattaggaagcaattgtggctattcaagaataaagtaagaatatatatttttagatgtatatgtactatgtctttcaaatggctactaaatcattaggacatacatatgttattttttttttacctaatataataaacagaactcctgggtgtttcttttggttgagggatgggtggaaaaattcctgagaccttaacagtgcctgaactgattatgtttggggcctgtggg

SEQ ID NO: 470998 - DNA, 1570 bp, Homo sapiens
agctctcttctcttgtctgccaccatatgagacgtgtctttcaccttccgccatgattgtgaggcctccccagccatgtggaacttggatgctcagttgcctgctcagtttatctatcggcatctctcaccacgatggtcacatggaggttcttggagggctgctgaccaaccacagcatagagtcgcttctgaaccagtacccaagaattccaggttccatgtttaagaacagccaaggtcagggactcagtccaaaattctgcaacagcttcctgagaggagagaccttcatggagcacagaaatgctgtagacacagaacattcagccctgcttggtgcaccagggaaagaacacttcttggacaaagcaatgtctaagctgcttacagaaggaacatggctgggtcttcccctggtctttgtctctgctgtggactatgatagtcgagtcttgcatttggcggaatccacaatggctgtcacccaggcaggcctgtctgggaccagtgatgagctagtgctgagggacactgcatgttttctcttttgtacacagaaggtggtcatacctcctctcactatgcccaggcctgggacaatgcaggaggaccctagtggcctgaaatctatgttggcttgtcacttaattgacaatagaagaaatttatgaactggcaaaaaaaaaaaatgctactgcttaaaataaccacaaaccattcgacatacctcacattgaaagctgagcattaccgctcacacaatgacagcatccgtaagagggtgccagatgtgtgtgtggggagcttgcgtgcgtggatctggttctcattctttgtgtagcatcggacccaataacttttttttttttcattttcactggacacttattttattccttcggttttctggccagctgttgttcatggctctttctgtcctatagaatgcagatatagtcattgaaaccctaagttacctagtcgaaaccccaagtgaaaccccaagttacctaggaagggaaggtacaaggacaaggaagggtagggagggagccgcgtctagagcaaggcccatgggggccagcaccctgggtgaccacagccatcctcggtagactttaaacaacaacctactgaatgaatgcatgaaaattgaggacaaaattcgtaatcaagattctacaccctctactaaatattttcatttttgaatgttatgttctagtgggttatattgaatttttattgttttccatttatcaaaagctttatttgccaccttgcatcctagaaatcttaacatagacctgggttatatgataaccatgactgttagtgatagaatattctgtgaggaggaagtgacatcatctaggcaaatatttctagatttggcagaatttagaatcttttcaattttcagtgatgataaattctaaaacgcacaacctagtgcatataacgttttaacttcagcagaactttttatgttgagaagtttacattttgtcatgagtagcattaagcttcgatacatattgctaagctcccttctaaaagagcatttt

SEQ ID NO: 470999 - DNA, 924 bp, Homo sapiens
tgggagccgtggcttggggtcaaagggccctggggaagggaacactttggcgactttgtgcaccctgagggctccacaaatccaactgttgacagcattgtctttcttcatgtgatcatcacagcacagatgtgaaatggaaggaattacccaattttcaggcatcatgttggaagatgtaaggatctgccagggactccctgggggcagaaacctggagaaacaacttatccaaagcatttctttagctgacttccctttttttccctccctgttgtatgaaaaattcatacttgccattaagaggcaatgggaagggggctttgggcagtcatcaattcaagaaacaggattagcatgctggatccatgaagcacagaaggaaggaaatgtaactcaaagaaagtcactgatgattatgtacagtggagacacatgtaatggccgtctcctgacctcacactggcagtccctagaatgctttcctgtgcgtaatgacatttcgctttcccagtatccctgtgtgatacatagtttttcaaaattgcctgtcaatttcatgaatacagaagactaacatcccaaaggaggcaatgacttgctcgaggccccacagtggaaccagggcttgaactcatgccaactgatatgaagtcttaggtctttttgctacgacacaggtgcctctgtatctgcagttggttttgatggcatgtgcgtgtgtgtatgtgtgcgtgcacacacacgtgttcatgttgatgagggaaggaagaacgacagaaggggctaccttttggatgatgctaaaaacgagccctgtctaactggtatctgtgcctttactgtgttggacattagaactattcaaaagaagttcaaatcacttgggagtcaacatctcaaaatacaactgcccctcaaagc

SEQ ID NO: 471000 - DNA, 1741 bp, Homo sapiens
cagctgtgcccaggttcctcgccgcctcttcttcctggaagatttcattattggcatttgaatgagggggatcctgagaaatctaaatatcctccttgaatttagtttaatattgccaaggtactatcacgggatagcgtggagattctcctggaatcctggaaatgactgtcaaggcacctactgcataccaggaagtctatatgtgacaattcaatttacttctcacaaccctggtgttgatgtagttggagagaaaaggcagcatgttcaaggtcaagagctagtgtgggttggtcagaacctaactcagattcaatgctcatgtgccatattgtcaacacgcctgctcatggactattactgtcacacgcacacatacactcatggaaaaaaaaatcaatgcaatttgaatttctcttccccagacgagtctttgataaattgttgtggagagctattgatctcttattgcgatgtgatttttaaacagcattaaagtaaacatagtcttattgtgttcgttttactggataacacttatctagacaaaaggaggcacgaagctgccggagctactcagctttacctctaggaaagatacagcgaatcaccgccaataaaacaaagcaaaacaaaaagctcgccatgctgaacggaatgggaaaattgctctcttgtcactaattttgattgaattgagtcggcaatctctgaaccggttcactgatacaacaataggaaacatttaactgtttcttgcacctttaaacataaatagtaggtttttaagcagtcagaattggctcatgtgataatgggagctgcccactcatctcttcgtgtttacacccagctcttcctgcaatgcatcgcctcttgtctctgccagtagcccagtcacttcacaccctctgagctccagcgactcctcctctgagaaacctcttgggtcctagtgtttgtagtttgtctcatgcagtcctcctaaaaccttgcgagttctcttctccccattttacaaatacggaaacttgggcttataaaaattgatttgtccaaggacacaaagctttccaggtcacaagatttcaagcacagggctctgtggtcctcaggctatgctgatttatcactgtctctccccacacatttcaccttatttgtgcactgttcattgacccagtcactttgtgaattctttgacaggggggataagacttattcatgtctgcatccccagcatctagcataatctttgacataggcagatactcaataaatacctgctgactgcttattgacctctaaccttccccaagtcttggcttcagttttttcatctgtaaaatgagggcaaggcagaatggggctatggcagaggctatgcctgatacatggatgactcaagatgagtcgctttcctcttccttcccttgtaatttcctggctctggcagtgaccatccagggccagggctggctttggggtgtatcctcaggtcagctgcgatatgaggagctgcaggtcaactgcaacatgaggaacatcgacaggcccaaggtcttccttttaaagagctaccatttagtctgagacatatttgtgcctgttctagaattttggtgtgaaaagttctctattttatgaaaggaagaaaagttctctattttactctattttatgtagtacttgggttttgtttttaagttttggccaaataaaagctgacaactctatg

SEQ ID NO: 471001 - DNA, 897 bp, Homo sapiens
gttgctgttgttttgcaggactcattttgtcagttacgctaacatgacacccaccccaactgagaagcacatcagacaacagctactgctaaagtgtgagtccccagttgtatgctgtgtgccaggacttatggatagttgtagaaaaggatgcttgggatcaaagaccagccatacagagccagaggtttcaaagcaggctgagagctcagcttcaaatgctgtcagtcagacccctgcagtcagggggcgccttacaaatgccagctgcccacgcattccctgcttaaaaccttcagtggctttccatcacctgctggctgtagcatggaccaccaggcatctgggttctccccacccatcacttcagggaccccttcccattggggcctttcccagtatgctctggatagccattcttaaagtgtgccctgaggacccctgagatcacagaacctctcagggggcacccaggtcctccattttcctgtttcttttatgtataagaacagatctttttcctatgtacatcaactgtactgcaaccaaagcaacatcttacaacaaatgtggggccagatacgaagatccaactgtcttctgataagtcaggcattgaagaaatgtgcagaaatgttaaatgaggtcattttttcactaaggtttttttgtcttgttttggaaagaaaattttgttaaaaaaaaaaaagaaagaaatacatatatctttcaatttacatttgcagttaatggatttattattatttttaatgaatttgtaaatatttttgtgatttctcagtttttatttctgacatagtaaatattgataactatcacccacataaaagctctttagggttctcattaatttataagcatgtaaaggggtcctag

SEQ ID NO: 471002 - DNA, 2278 bp, Homo sapiens
aaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaactcacttccttttgatgatggtggtggtggtggtgatgatgatggtgatggtagtggtggtggtggtgatggtgatggtgatggtgatggtgatggtggtggtggtggtggtggtgatggtgatggtggtgatggtgatggtggtggtggtgatggtgatggtggtgatggtggtgatggtgatggtggtgctggtggtggtgatagtggttgtgatgatgatgatggtgatggtgatggtggtgatattggtggtggtggtggtaatgatgctggtggtggtggtgatggtggtgatattggtggtggtggtggtaatgatgctggtggtggtggtgatggtgatgatgatgatgatgctggtggtggtggtgatgattatgatttggtggtggtgatggtggtgatgatggtggtggtggtgatgatggtggtggtagcggtgatgatgatggtggtggtggtagtggtgataatgctggtggtggtaatgatgatgatggtgatgatgatggtggtggtgatgatgatggtggtggtaggtggtgataatgctggtggtggtaatgatgatgatggtgatgatgatggtggtggtgatgatgatggtgttgtggtgatgatggtaattggtggtggtgatgatgatggtggtggtggtggtggtggtgatgatgttggtaatgatgatggtggtggcaatgatggtggtgatgatgatggtggtggtggtggtggtggtggtgatggtggtggtggtggtggtgatggtggtggtggtgatgatggtggtgatggtggtggtgatgatgctggtgatggtggtgatgatgatggagtgtaccaagggatgaactgaggaagcagaggacccttggaggaccctgagggcacagttgggagagatgagagaacagaacaagatggtgaccgttcacaacatgtaactgagttcagcttctcctgttgccattgaagatgttgggtgaccatgggcctctagcacagaaacattttctgtttattccacatctcaacataatgttgtgggaaagtgatagttctactcttcagagatgcccacaagagttggaaaaaactaaatgtcagacagaagtgggcagcccctccctgtggctctgcaccaagtttaaggttgaaaaccagggtgaacatttacctgg

SEQ ID NO: 471003 - DNA, 550 bp, Homo sapiens
gagggcctttgcctctgttctctcctgtgcccacaatactccatgcctggaggccttgcctgtgcaatggttaattttaggcatcaattcatctgggtcaccaggtgcccagacatttcctcagatattatcctggatgtacttgtctgcatctctatctgtggtggacatggaacactgggctgcaacattagcactagactggtgtacacagggacccccttcactcaacaagagcacccaactccccttggacatcccttcttctccccaccttcggtttacttaagacacaggattcagcgttctgtcacttgcaacagaaattgttcatcagagaagcctgacagcctcacatacccacagctccacaccaccttaccccgccatgaaactggaagtttccaacaggcaaactgtatgcagttgaccattgcacgttctagccattgaggacaatgccttcttgtaaataaaaacaaaacagaaaacaaaccaccaatagcaagcacctttgaaggtggcgacatgaccacaggtgtgagtgtga

SEQ ID NO: 471004 - DNA, 2121 bp, Homo sapiens
cccgcgagctattacagaaagcataatgacggtatgtcttctaacattccattagccaaagcaaatcacatgaccaagccccaaatcattgggttggagaagcgtcgtggtgggggccgggggaagaagagaggatatcaacagagcaataatgctaccacaaatgcatgtttttcaacatgtatttctctaaagttggtagagaacgatctcaaaacaggtttcaagctttctggtggtcaaagggaaggaggaaacatgttcagatccataaggagcattgttgagtccatagcttctgccccactggaaagctcttttattcaggtccaagctagaactccatcttcctgccaagtcagacatatcagcagtctctgcagagtggcagaggctctggggctttctcagagaccaggagcaaagagccctgtttccctgatggcagcatcttcaggattagtagaaaagtggaaagggggaccaagagattcagggctagagaaataccatgtgcacactgagcagcagaagtctgaacttaaagcaactgtggtcagaatgactgagaattacttaaaagtatggctctatacccctgtgcaaaataacgcacacagggtgcacttgagtgaggttgcatgcataaagagttgggttcattacctggcacaggggtggaagatctgtaggtgaggcagccttcttgcaaccaagaggcaaaatgcatgagaacggaaactcacacatgaagaatgacctagtagagggtagaaagacagctggattctttagggtagtaccaagtcactgtcctatgcctgggtggcctgttggcagacttcattttttaataattttcagctgattgtattcttgactgatatgaatgttcatttatatctgtatagtcaccgttaatctcagactgccaatatctattcatgtttcagttaccccaactaggttgtgaggggctgacaggcacaaaacttgccttattcatctttgtctttggcacagaatgatgttaaataaatgctgtttgtcaagagaattggattcctggacatcaaggttcatggtaatgtacccatcctctcccctcctctcccctcccctgccctcccctcccgtcctgtgccctcccctcccctcccctctcatgtatctctctgtctctcttcctattttcttagaaatttactctttgtctatttagatgaaatgttctgaaagagggaatataacaagtaagtaaataaattgtcttggtttgataaaacacaggaaaagagggagttttctgatgtgttggttgcatgacaagctttataaatggttttggatttcctgtaactacctctatggcaccctgatttggcctttattggagtaaggtattctctctattcttgtggcctcattgcagatctttctactcagtgggaaccagatataaaaaccaatgcatttaaaatgtgagatatagaaaggaaacagagaacagtttccgagctggcttccattgccttataaatatagcatagttacttgaattccataagaattaaactctgatcttttaaaatgcatgcaaattcttgcagaatatatatgaaaaagtcactataactgtagaggcacttcgactcccttgataaatgggacttccagaccacactttattgagtctctgatttttaataatttgaatcctgcaagatttaattctgcataattctggctgaaatcagcttttgattgagttgtaatggctctgttattgtaaatatctctgcatgctaatgttgtgctggaattcaataatatttagatgaaattttttgccttgagcattatggaagcaagatttagaaatcgggaagtttatgtcaaagcgacatctattttgggtaacctgcaaaatttttaaatgcaataaatggtcatctcaagacaagatttaaataattatgaatcctaaatgtatacgtgtggatcaattataatatgcgttgaattaaatatatgtatattattcatacattttatgaataaaatatataaaaatactttaaatatgcatctttatttaaccttgcaatacttcctgaaata

SEQ ID NO: 471005 - DNA, 496 bp, Homo sapiens
gggcactcggatgagagagagccaaagagcctctcttcttctgagcaggaccaggatgcggaacaagttgttcttgcctcatgtcctgctgcctgtcaaaaagaaatctgtcttggaggaaaagccaattaactcaaacatctttcatttggatgtggattcaggctccttccacctggtgaccctgctctcctctgcccagttggtgggtaggaggagaccctggagaaggtgcaccagcttcttaaccactacttacatgtcactggaagcaactggtcacatggacacacctagatgggaaggagcctgggcaacagagtccctgtctgggcagtggcttctcgatgacagctctccacattggaaaaaagagctcacattttggaaaacatgcctctgccacgacacctcatccaattctattctgctgtatcacagacagttgaggcaggaagattcagcatctggtccttcttcctagtaaagttaaagc

SEQ ID NO: 471006 - DNA, 610 bp, Homo sapiens
aagcatgactgttctatagtgaacaaacaactgtggcgctgctacaccactgggcccgaaggggtggcagagcaggcagtagccagagttcaaagaaagctaaaaccacaggaggggagagggcagtcctgcaggaggaagcccaacgctgcagtctgcgcccgtggagtcctcatgaggacaattttgactgcctttgtcctgatccctctctccactgtggctcaaaaccagctcaaggattcattagctatttggaaagtttatcgaaacaaaatcaaacaaaaatcaggttcaaaagtgagtacagagaacagccgtaattctatctctccagagttcttgtcttccctcctgtttccttcaaacaagccactgcattgctctcccattttcctttgtaaaaatggtatgtggaagagggttattgcagcagcgtttaaatatgaaaacagttgctgcagacaaggccctccagatatgcaacctggcgtttcttcaagagcagattctacatggagaggtgcagcagaagcaatgatgctcaggacatggcactggaccacttgccccacgtctgtgggatcctgagtaggaaccagcattttaa

SEQ ID NO: 471007 - DNA, 679 bp, Homo sapiens
aaaaggaaaacttggtagtttgttcccatccgtgcactgactaatgctcagcaggcaccgggtggtaatgacctagggaagggggtgtaggcacaggctaggatgtgggcatcctgggtcttcacagcctctgccaggatgaggggcctgggatgctgctttgtgtgcacagaggaaaggtgtaggaatgcccgtgctcgctggcatttaatttaccagttgcctctgtgctggggctttggcagattctgctggaatctgaaagacaggctgtcataccgagggcctgctgccgactctgaaattgagaaacttggcagatatgcaaacaacatacaggggatagatctccagcttccccgacagggctcccttgcactctcctgccttcattttgtcgaagtcgacctcacccgcaggtcaggaaggcacctgcttagtgatgagccctgtgctaggttctggaaaggagcaggggacacagagatgaatgagagctccccttttcctcaagaagtccacactctctcattaggagagatggatatgccattcatttatgttttaagcatatactgaataccaaatactgtggctccataggactgggcacagtccctatgttgaaaggcaagtgaaaaaaacatttgggtcagtagaatatgacaatcagttataa

SEQ ID NO: 471008 - DNA, 506 bp, Homo sapiens
gagagcatcgctatcttcttgtggaggaaatgaatatgcaaactcctttggtaattctgttgtccactgaagttcaagaacctcttgcacagtcgaatgccagctccttcctttgtcttcctgaatttcccacaaccctccccctcctcagttcctacacccaatggctgacttctacagtcatcaagccccatagtagctgtggcttcttctggctcactctcctcatctttggaacaggggcaatgcactgcccactgctgatgaggtttgaaagaactaaatgggttaacatcagcagagatctcagaacttggccttcacatagtaagaattgggcagatgtaagccatttcccccactgctattcttactccccagaaatgtcccacatccaggaggctgaaaaactgggtactatttctctccacctcttggaaatactgagataattacatttctcttggaaaatatcaggtgatctgcattcactggggaaatggtgc

SEQ ID NO: 471009 - DNA, 607 bp, Homo sapiens
ataactaactggccgagactagtttgcagttgtcatgatgttgttgttgctgttgacaacggtgatgataatgtttgatgacgatggtgatggcgatgacagcaatgatggtgataatgatgacaatgatgataatgatgatgatggcagtgatgatggtgatgatgaccatgatgatgaagaagatgatgatgaaagtgatgacaatgatgatgacgatgatgatgatagtgacatgaggatgttggcaataatgataacaatgatggtggtgatgatgacaatgatgaaggtaacgactgatgatgatgatggtgataacaatgatgatgatgaggatggtgatggcagagatgacagcacagacaaaggcacaggactggggcacagcagagtatgtttagcaaactacaagtgtttctggatcttaaatgcaggacgtgggaagcagctccaaggtgtgggtcttagctagatctaagccaatcagtcttgtccatggattttgcatcttaactagagtgaagtctttttaaagaaaatggctgggactggttgatcctggcagaagtgcttggagacagtctgtgagttcctgctgcccaga

SEQ ID NO: 471010 - DNA, 899 bp, Homo sapiens
gtcttgagcacacaaccaacaattatgggggaaaaaaatcttgattatctgagtgtcagaagaaagaaagcagaggccaacaggagcaagactggctgctccaactccagaaatcttggcaacataagcagcatttcaggggatgggcaggcggctttcttctgctggctggctgacagcgcaggtgctgctggagcagcaggcactacagagccagtgttctccaatgtggatgccagctccatggggaaggaacttcggggacatcgcagtttcaaaattgggcactacgccaaaggcccagaacctgcagaggaagattttagcaaaccttcctgccattatggaggcaccgtgtcctgttgttgggcttgtatctccttgagctcatcctgtgatgaagagtggctacattgcttgacacatggtgggctttatgcagtcagtatccagtatgcagtctccagatgtaggcccaggttctggatcatggtgccagcatctggtgttggtgttggccttcttactgcatcttcccatagtggaaggcagaagggcaagggaggggcgaacactgtgccctcatatcacagaagagcagaagtgagtggatctactcctacaagcccttttaataatggcaataatcctttcatgagggcagaaccttcatgacataaacaccttccaaaagaccccacctcttaccactgttgcactgaggacttctaaagtctaactgtattctttagttcctgtccctttctccatctttaaagccaacaatggcaggtcaagtcctcactttgcatctctgtgacctctcttctgtcattgcctctctctctttctcttaccatagctgggaaagttctccacttttaaggacttgtgtgatt

SEQ ID NO: 471011 - DNA, 670 bp, Homo sapiens
caccatcacacatcagtcagcatggctataattaaaaagacaaaaaacaacagatgctgggcactggaaagggatgtgaaggcaaattgcatgttgcagggatttgatatacagattattttatcaccagccaaggtgcttcactgtgtggtggcaacaggatccatgatggtttgtgtgttccagcagcagcggcagcatggtgaggtgcacactcatcagctgaggctgggcactggcaggcacagttgtgccagcctccataaatatgtttgcattggtggcagtggcagtgtggcacttgtggtagggggtgaggctgctatcttctgtgcatgcattcatgctggcagaggaggcatcccagctgggcatcccgggctttacagcaaacaggcaccaccaggttggcaccccacgagaggccagcagatggggttgctcaggtcgtaccagccccatctcatgggcaagattgccctgttcttttcaggcccctcttctgcaggtttgctacagttggctggaggtccactccaggccctgtttgcctgggtatcaccagcggaggctgcagaacagcaaagattgctgcttgcttcttcctctggaagctttgtcccagaggggcacaggcctgatgccagcaggggctcttctgtatgaggtg

SEQ ID NO: 471012 - DNA, 1340 bp, Homo sapiens
ctgagctatttgctgcccagacttctggcccatagaaacaataaggtgataaaaagcgatgcggataaaaaccaaccccaaaaacccaaagctgctgactcagcagcagcaagaagaagctcttgacacatatttagcgaatgaatatggtggtagtttagaaatttatgctttagaagaatcactctatggaaaattgacactggagaaacctcagagcttcagagtcatctttggccttgctttccttctctttgttcaactggccaccaaaattggtcaactgacctctgaaatgactcatcattttctacctctgatttctcccgagctcatctcaaggggcatctcctttgtgggtcttttactctcttctactgccactacaagtattcttgccatactaactctctctaccttaattcttatccccactcctcacccctccttaccactctcagattcttgactgaaaacccaacctaaactggcttatgctgtttaaaagagagagtttattggtacatatgagtcatatgtgaaacagcctcaactgtgcctgaattcatggctaaaactacacaaccaggagctgggttcttgatactcatttattggatctgcttcttcaatgttggctctattttgggacttcatatagttaataggtgcctgtcagcaactcagagatttaaatccaggacaaaaaaagttagagtctttgtcccagtattcccagaaaatgccctgacagccaccaggcccagactgaattaggttaccagcctgccttacactgatcattgtggccaggaaaggtaatactctgactgaaagaggttcacccccagaactgacgattggccctgcccagatcatattaattgagaatgggagggggtacatccttaagcaaacattaaggcagttgccagaagagggaagggaggttggagaggcgaagggcaaatagacactatagatactgtatgcatctccctccttagactgggcatattattcagacactgtggtatgtttgcattcccagggctccataagatgactacaaaacccagtatcacctcaagtgtaattattcagtagaaggaaaatttattcttttactctcaggcccagaaaaagcaaggattaatactggttatcatctttaaactgtcatcatataatgtcaggtaaaaaagtgaatcatctccaaatatttgacattaaacgtgcagattgaatttgaagatgctctggagtttttctaaaacagtgctatgtacatttttagaatctgataaaaagctgtcaactctctccagaaaatgtacatc

SEQ ID NO: 471013 - DNA, 504 bp, Homo sapiens
catcaaagaccaaaggtagataaatccacgaagatgaggaaaaaccagtgcataaaggctgaaaattccaaaaaccagaatgcctcttctcctccaaaggatcacaactcctcaccagcaagggaacaaaactggatggagaatgagtttgacaaattgatagaagtaggcttcagaaggtgggtaataacaaactcctccgagctaaaggagcatgtgctaacccaatgcaaggaagctaagaaccttgaaaacagaattttatatccagccaaactaagctccatgagtgaaggagaaataaaatcttttacagacaagcaaatgctgacagattttgtcaccaccaggcctgccttacaagaggtcctgaaggaagcactaaattggaaaggaaaaactggtaccagccactgcaaaaacataccaaattgtaaagaccatcgacactatgaagaaattgcatcaactaatgggcaaaataaccagctagcatcataatga

SEQ ID NO: 471014 - DNA, 953 bp, Homo sapiens
gcggcaaaccaccatggcacacttatacctatgtaacaaacctgcatgttctacacatcatcactcctctgaagtggatgagatgagcctgcacactcgacatactttctccagtcaggaggccgcgtgttacactgaaggctgtcttcagagaattcccttttccagttgttctctgttgcgggatatggatcctgctcagattacctatagtagtttgtcaaactcaagtgaaagtgtgcccagtaacctgaaacgtaattctcaggtcaagagatttgaacttatttatagactatcggcgctcccttacaaccccttttctcatctagaggttcaatttccagacctggcacacaaacaagataaggcggtgtttggggcctccagccacttggatacaagcgcattcacatgactgtcaccagcagattaccaccaattattactaacttccaggttgtaaattgctcagcaaactaaaaaataaagctgtaacagttcaagaaaactgttcatcttttcccgttctagctttctctgcttcttgtgggggtatactcttattctatgctttctaggtggtatatttgttctcagtgacatattcctgcattaatggagaaatatatatatatatttatttatttgattatgtgatttttattacttcttgtctgttccatactatttcttcgaggccttagagaagaatgtagccttgatggtggagaatgggttaaagtttggtgagaaataagatttaaatgtcaggaggatgggcaggaggaggggtctgaacctaaagggtgatctcctggttggtgagacctggtgaaaaatggtggcttggaaaaaattcaggcatgtatgacaatctttgtgtttcctcttttatcttgttgtagggtgattagtaatcttagccactagtagtgatgaaaaaaaccttc

SEQ ID NO: 471015 - DNA, 1008 bp, Homo sapiens
cctgacgtcttctgagtcgttactgaaatggtcctgctctggtgtgctgtggaacgctgacgcctcatcatgcagcacgtaacaacatttcagttaacaatggactctatattatggtggtcccatcagataataagaaagctgaaaaagttttatccctatgacatcattgccgaggtattccagaagaaggtattgttatcacaggctaacagctccatgcatattcttgtccctgaagacctttcagagggacaagacatggagatggaagacagtgatattaatgaccgtgactcctctgtggccgaaggctcgagagcccatggcaaaccactggtgaaggaccttgctgaggaggcgatgtttgagcagagacctgaacaaagtagagccagcgagtccagtccgtggctgctgactctttacagcactctacttggagtctgtaagccgcccggactttcagccggactgacaagtggagtatctgtgtcagtgtacgttactcatccgtcgttgggtcagggtctgcgggatggacccccgcaatgtacagtgaaacagctgcctcgttcacccctgcaagagaagagaggtttatttggtggagaaattgaactagaggctccatactgaaggacacccaaagcatagcaggagagcaagagaggctggcactaaaatagagctagtaagtgaaagtttaaatcttcttcatacataatactataaaattgttaatgtcttaagtcgataagaaatgggagtataactttataaccaggtgggttagtgtcagaaaaaaaaaacagccaaaaattttagaagagagggattcaggaaaaggggaggtgaggaagagaattgtttttcattatagttagactttaaaagtgtacgtgtattactttgataaaaaaaattcacagaaaataaaacatggtaataaaggctacctgcctaaataaatggaccaatgtttataatactgtggctagcttctta

SEQ ID NO: 471016 - DNA, 841 bp, Homo sapiens
cggacccagaattcagatgatggatgttggagggcttttctgacaaagccaaatgtggtcgtgatgcaagatatttcctggaccccttcacaggacttgcaacaggggtgcctcatttactcaacccaccccgtgcaaacccttgcgggagggagcacacaggtgagcgagtgcgggatccggccagctgcttttgggcaccaacaggagcaaactccctgtgggcctcgtggcagcatccaggtgggggcatggctggctccaggaattcaaagagctgtaagaactctttatctttctatccgtatttcaatttggactcactctcagatagatgtggtccaatacagcagcaagtttcccaggcaactgtcaacttacatgttccttggagactgacatgcaagaaaaataaaagtatgtgttttgccaaatggcttcagtgcaagacccagcccagattcttattaacccagtttggatcgtatactgatttatggactaattacttgtctatgaatggagaactctgactggtcagatatgtatgtgcacactattgccaatgggccttggaaatgtgttcagtcacaccagaaccagtcaatgatcataataatggtaaatacatctctgaagaataggatactgagcagaccagaaataaatacacctgatcttcctgagcctgaatcttcacattaactattttaagaaaatttaggttacaggattttataaatttatattaaaacatatatttaactaaaacctcagaagtttcttctgcatttagtcataccaggtaagtctcccgctatccagtgctagattctatatt

SEQ ID NO: 471017 - DNA, 689 bp, Homo sapiens
cattagttaaggcaggaacaggccattttcacttattttgtggtggaatgtcatcacttaaggcaggaatgggctatctggatgtgcaaggtgaggtgctcatggctgcctgcatcaatcggttgtggttggatggaaaggagggttctatcatcattgaacagcattcaggaaatgaatactgaaagtttgggtagagatacaaaattgattggaaatatgtggccaatttacatgatctttgcgcagcatgccattcatccctatagaggccatatgaatccattacgaaccgaattgggcttactggcagttatacccttttgcctactgttatcccttgtacctctagcaagtaaaggaaacgatagtgagaaggaagtcaaaagttgttttatcaatgtaatttactctcgtgcagacaaaaatcaggaaatggtcagacagctagattaaggggattatgatatatttatatttctatcacttaaattcctagttattcttgaataaatataatgagaaatattttggcatactattattagcctatgttaaccaatggaaacatattataatgacactttttcaagacaaaactgactgtgaagattaaagtctcatttattgtacattcatttcactagtttgtgtaaaacttggaaaatacatcaaagtaaaaacagatt

SEQ ID NO: 471018 - DNA, 874 bp, Homo sapiens
acaaaaaccacatgattatctcaatagatgcagaaaaggccttcaataaaattcaacaccccttcctgataaaaactcttaataaactagaaggtatgcgctgcaggctgcgacttatcaggtgctttatagctccctacctgctatgtgagacaggaacaccagatgaggctgaggactggatatttccctctcctcctatgaaagattccgctctggagccaaaaaaacagtttttcttggcgtgtgtatgtgaaatcctggtggaattccttgaagtaaaatccatgtctcaaaatgaccatgtaagtgttcagtttgtggatccagacgcttctgctccagagcagtggccaaatgacagaaaatataacatgaatatatttttgaatgaatcaaatgaagaagagctagatttaattgggttatggagtttaaggagatgggtaagtaaatagcacatattttggcttttatttcacagcctaaaagggtataaagatatagttagtcctttattcatgtattaacatatataaatatatactgtgttgattctggttgaaacggctggttttaacctgaaaaatgaatgaaaattgattttaatcttggctcaccaaacttagtgaagatatttaggtaggtttttaagatcgtgtttcagcatgacttgcaaaaaagtcttttaaataaaagtcctactcaaataaacttttttcttggtattttcccctaattattccagtttttccagaagcttctcgttgctctaaaatctttataattttcagtgtacacgtttgttcatggcaacgttactcttcatatttatttatttatttatttatttatttatttatttatttatttc

SEQ ID NO: 471019 - DNA, 3123 bp, Homo sapiens
aaccaggctttatatgcacgctccacaacagcagtggaacagaatgtacacaatggcacatatgcaggccaaacacgctgacaacaggtttctcaccattcctcatgtggggccaagacccttatttctaaagagttgtgatgataaagcatctgctgtttgtggtgatcacaaagcagcagataaattcattgatgatgaaaatctgacattagaacaagcttataatgccgatgaaacatcactatttgggcattattgccttggccagacactgactgcagctgatgagacagcctttacaggaattaagcatgtcaaggacagaataactgtgctagtaagtaataaatgtgctaatgcaacaggcaaacataagtgtaaacttgcaacgatagaagtggatgctgaagaagtttttaaaattaataacaagtgtccatttgctcattcattgactgatggtgaaattgccaaaatgcttctgaatcaaggtgataatgataacagagatgatgaagacaatggtgttatcactgcagaaaaagcgcctagagataacgatatattttgtatatttgtccccacccaaatctcatgttgaatttgcagccctgagacacaagccaatcagagactgagacttcatcagaagattctagaaagcccctcttccctcacaccttatcaccaaaccaccaagaaccacaccaatagctgaacagagaatgataggactgcaagatgcagacactctctgaagaggagcactcagggagggccaagataaggagggcagacggaaagaaagacattagatgaatttcaaacctctggtatctgtggctggaataaatattaaatacagcctaaatcctcatcaaaataatataaatcctcacactaaagatctatatatctcagtttcctattacctcatataacatactcaactttcaactaaaaattacaaggtatgccacaggcaagaaaaagcacagcctgaagagacaaggcaatcaccaaagccaactctcatagaacactaattttgaaattatcagatagaaaatttaaaacaaatatgattaatatattaagggctctgtattcataagggatctccagagaaacagaacaaatagggtatgtatgtatgtatgtatgtatgtatgtatgtatgtatgtatgtggagagacagagaaattttaagaaatcagctcatgcaactgtggaggtgcaagaccaaaatatgcagtaatagacagcaggctggagatctagagaagagtcaagaacaaactccaaaggccacctggtgtcaagattccttcttgttcaggggaagtcagtctttgttctgtgaaggcctttagctgattggatgaggcctatcgacattatgaaggataacctgctttactcaaagtctactaacttaaatgttaatctcatcctaaaaacgctttcacagaacatccagaaaaaggtttgaccaaatatctgagccacatggaccaggctagctgatataaaattaaccatcgcatgtctgccccttgtcaatgtgccacccatactcatctccttacatcatacttaatctacaaataaaaaaagagcaaattcatactttcacctaacatgatataactatcctgcctacaacaaaaagtgctctaagtctttccccggaaaatgatgcaaagtccttaacaacatttaatcttttcctttatagcctataatttaaatgcaatgtaaagttataaagcctataacttaaatgcaatgtagatatatgtacaatattcaaatacatgatgtacagtcaatacattttatgttacataataagaggataaaggtgggtagaaaacaaagatattgctgcacacatatgcaacaacatgcttttaattaaattttaaaaattcatgtaagttacagctctagtttctgtaactggtcatgtgattgttagcctttatttataactatctccttccacccattccatatttccctttgtcctcagtattcatcacggtttattaactggtggggtgacccaaactaggcaaattcttaaagggtttggaccaccagtagtcctgtctgaactgcattgtagtatttcattaaatttaatcacagggtgctatggtttgaatgtctcctccaaaactcatgttgaaatgtaatatcattgtaacagttttaggagggctgaatgataaaatgtgtaaagcaccttgaacagtgccttgcatatgttcatattcagtggatattaactcttgtttcattgtccttatatgctgaagaaaattgagatctactctcattattctcaatgacatgaagggaggctacataaaaattagagaggttaaagtgtgaagaaattacttcacctattttcagcttgattttcatagctatacaagggacagagatagatgatgccttccagttctaagattctattattccataaataagtttacctacaagtaaaataaacaagtcatattagacatatttctaatatggatattatctattatccaggatatgatacactcactcaaaacaaaacaaaacccaacacaaaacttaaggcaaaacagacacacatgttatttccagaatcatgtggataactatttcaatcatcatttttatcttttacaggtataataaataccatagtattatagcaagttgtaacacttgggaaaatacagagtttattgatgtatttcgcagatataagaacaccttacttttataatttgcatgttaagcaagacctgaggcgtgcctaaatctttcatcaacaattaaggtgaagtaggttaatattttcccagtactattttagattccttctctccgagctatgtactaacagccattcatcaatatgcttttctttttctttttatatataatagataaaaattcaacaccaatttgtctgtaagatgactgttattgcccttaagctatgcctctggtttgcttttttaaagttattttaaaatatattcttggcaacattttcatttccctgggatatagcttaggtatgcctttattaaacattaatgagtcat

SEQ ID NO: 471020 - DNA, 1972 bp, Homo sapiens
ccaccatagaaaggaccacaaccttatcatctccagtgtgtggctgcttagcaaggacagtggaaaggccagtatgagagaagcagaccaagtttacccaccctacaatgcaagctactgggctttactgaccctggtagggggggaaggatggttaagccattctaagtcacaggatgagatagaaggtcagcaccagatacaggacataaagaccttgctgatgaaacaggttgcagggaagaagtggctgaaacccaccaaaagtaagatggccatgagagtgaccgctggttgtcctcactgctatactcctatcagtgccatgacagtttacaaatgccatggcaacatcaggaagctgcttcctgctggtcaaattttgggaatccaaaaacttttcgctttttaccaccttcatgtcttaattgtaaattcacagtgtttagtgaatgtaattgttttcaaatttctatcgttccacagcaaatgtcattagtacaaaatagaataaatgggacacagcataaacaaaaccctctgattctatgacaccatgatttggccaatcatgaaaaaatatttatattcttttaaagtaaagcagagctagagaaagaaaagcaaaagtttctttgaaagaggagccagcctgaagttgttataaattaaaacttcaccatattttagaaataaagctattgtagcatgagaaaattgactattcttgaacttccctcaaaatcttgaaacagagtatggggacaaccaagcttatttactattttaaaaacatgttggtagaacagaagtgaataccctttaaaataaataaataaataaataaataaataaatacattctaggctgtcagaagtatagcattgacaatatatagcatataatatagttaacacagatgttaaaactagccaacaaggaatttgaagccaattataaatgaagttgatgatttaattaaaaaaagatgaatatgatgagttaggagataggaatctcagcagagaaatgaaataatgtaaaaaagaaccgactagaaattatagaataaaattattatctataaaataaagaattagtgaatatgcttaacagtagattaggcactacagaagaaatgataaatatataaaaattatcttaattgaagcacatagagaaagagtctgtgtgcagacagttattctaaattgttctaaacatgtttagattttataattactttcttcttttccatgtttttcacatatatacacatgtaagaccaattctttaaaaaatagattatatcaaagaaactaatagatttttaatggaagagaagaagaaaactaaagaagataaaaattgaggaagaagaatatttgaagaaataaggtcccaatatcaatttttatcaagaatatcaactcatatgtccatggagctcagcaaatttaaagcatgataaaccccccaaaattataactaggtacatagtagtcaaatgttgaaaactgaagtaaaaaggcaaaccttaaagtcagccaaaaagatatatgatacatttaaaagagataaaactttaaaaatcttgcttatcacaatgatgcaattaaggcaaatatgaaaagctattcttagaatgttcaaagggaaaaataaactgtcaaaggaaaattctacatccagcaaaaagatacatcattggtaaagatataatagtttcactctgtttaggacatggaaagacccaagtgaatgtcattattccagtagcagtaagaaaatagctaaacaacatacagaactgtgttgtttgttttaaggtaatcagagatatgaagtcatatagcaataagtattttgaattccaaagggtgacaaatttctcttggaaaacatggaacacgggaactgtttcacctttggcaaagtactggaagaaaaaatgaggataataaaatcatgt

SEQ ID NO: 471021 - DNA, 614 bp, Homo sapiens
acatcacacactagggcctgttgtgggggagctcttagatgaggagcttaattttgagaaaagaaatctggactgtaagaaacatgggatcaagcacacaacagaatagaaggaattccaagaataaagataaaggagcattcccatatggaagatttcaacatgagaagcaagcaacgtggctaaaatggattgacagaatggagagtttcaagaggctgacatacaatgattttgccctctgtgcttgccaccagaggtttggctacaactcagcttcatgtcttccctctgctcaagaagtcttcaactcctgtgtgtttccactgaccctcttgctccacaaactgagcagcttgggaacacttgacagggtatcttgtggaagaaaattccaagcagcaaagcattcaagaggtgacttaggtgctgctaaaggcattcagtttcataaaggaagcagagtataaaagttcagaaaatttgcagtctgatgatgcagtagaaaataaaaacccatttttttgaggggaaattcaagccagctgcagaaatttgcataagcaatgaggagccaaatgttaatccccaagataatggggaaaattgtctcc

SEQ ID NO: 471022 - DNA, 708 bp, Homo sapiens
tcatcagttaaggttatttttacttcttttgtggatcttcagttacttcaggccatctggatgtatacgtgcaagtcacaggggatgtgatggcttggcttgggatcagagacctgacagttatcatccttgtggcatagagctatgctattattgcagcttctcttgtagttcactgtggccatgcagtttattctcaccaatggaaagtcccgtcagaccttgagcaatgccccttctgaaacaggaattcactggattactgtgacttgtcccgacttccttgcaagcacctgggggaagggacggctcagtgggcacagctacagcagacttaaacattcctgcctgccagctctgaagagagcagcagatttcccagcacagtgctcaagctctgctaagggacagactgcctcctcaagtgggtccctgacccccgtgcctcctgactgggagacatctcccagcaggggtcgacaaacaccttatacaggagagctctggctggcatctggcaggtgcccctctgggataaagcttccagaggaaggaacaggcagcaatcattgctgttctgcagcctccgctggtgagatactcaggcaaacagggtctgaagtggacctccaacaaactccagccgacctgcaccagaggggactgactgttagaaggaaaactaacaaataggaatagcatcaacat

SEQ ID NO: 471023 - DNA, 562 bp, Homo sapiens
ggagctgcagactggagctgcaaaagtttgctgcaggggcaggcccttgtggaaaatctctgctagggcaatgcggaagggatatgtggggttaaaacccccatccagagtccctactggggcactgcctagtggaactgtgagaagacggtcactgtactccagaacccagaatggtagatcaacagacagcttgcaccgttcacctggaaaagctgcagacactcaatgccagcccgtgaaagcagacaggagggaggctgcaccctgcaaagccacaggggcggagctgcccaagaccatggaaacccatcccttgcatcagcatgacctggaggtgaacctggagtcaaaggagatcatttttggagccttaagatttgatttctccaggattttgcacttgcatgggttctgtaacccctttgttttggccaattgctcccatttggaaaggctgtacttacccaatacctgtacccgcattgtacctaggaagtaactatctgacttttgattgtacaggctcataagtggaagggacttggcttgtctcagatgc

SEQ ID NO: 471024 - DNA, 575 bp, Homo sapiens
aatatccagcagaggagaggatgatattactcccaatatcgcaagggctgtataccctccttgtaatattgttcctaatatccagggcggaagacgacaatattactcccaatagcgcagggggtgtacacctccctgtgatgttgttcctcgtatttaggggaagagaggataacattgcttccaatatcccagggggtgtacacccccctgtgatattgttcttaatatccagtaaaacaaaggatgatattactcccaatatcacagggaatgtacactcaccctgtgatattgtttccaatatccagagggcagaggatgatatcacttcctatatcgcagggggtgtagaatccacttgtgatattgttaataatatccaggttctggaagctttgtcctgtcgctcttcacaataagccttgctgccgctcactctttgggtccatgccatctttaagagctgtaacactcaccacgaagtcaagctaatggtctatcaatcttatttattctttcagatgaccaacttttgctttctttgatttttttgtatggatttttgcatctca

SEQ ID NO: 471025 - DNA, 1378 bp, Homo sapiens
tgcagaagatgggtgatttctgcatttccaactgaggtaccgagttcatctctctggggagagtcggacagtaggcgcaggacagtgggtgcagcgcactgagtgtgagctgaagcagagcaaggcatagcctcaaccaggaagcgcaaggggtcagggaattccctttcctatcaaagaaaggcgtgacagacggcacctggaaaattgggtcactcccaccctaatactgcgctttttcaacggtcctagcaaacagcacacaggagattatatacgtgcctgtctcggagggtcctacgcccacagagccttgctcattgttagcacagcagtctgagatcaaactgcaaggcagcaaggaggctgggggaggggcacctgccattgccgaggaggattgagtaggtaaacaaagcagctgggaagctccaacagggtggagcccactgcagctcaaggagacctgcctgcctctgtagactccacctctgggggcagggcatagccaaacaaaaggcagcagaaaactctgcagacttaactgtccctgtgtgacagctttgaagagagtagtggttctcccagcacgcagcttgagatctgagaacggacagactgcctcctcaagtgggtccctgacccccgagtagcctaactgagaggtaccccccagtaggggcagactgacctctcacaaggccaggcacccctctgagacaaaacttccagaggaacgatcaggcagcaacattcactgttcaccaatgttttattcttaagcttattatcaataatatgccttatatttatttagcattttatactttacataacacttccacattccatgaatcatttaatcaccacctcaattctgtaaggtgtgtacacccctctgcgatattgttcataatattcaaggggagagaaaatgatattactctcgatatctcaggggatgtaaacaaccctgccatattgtttgtaatatccagggagggagagggtgatattactccccatatcacagaggaaaatgtgagaatgatactacccccaatatcgcagggagtgtacacgccgccccccccccatgatattgtttctaacatccgcaggggagaggaagatatcagtccctatattgcaggggatatccattccccttttgatattgttaaaatatccaaaggaaatgatgatattactgtcaatatcggagggggtgtaaaccacctctgtgatattgttcctaatatccagtggaaaggatgatactcatcccaatatcaaagggggaatacacttcttctgtgatgttgtttctaatatccaggagggtaaaggataatattactcccaatatcgcaggggg

SEQ ID NO: 471026 - DNA, 549 bp, Homo sapiens
ctctctgagaaacacccaagaatgatcaataaatacaaaaaaaaaaaaaaaaaatctatattgtgggcacaatctaatcattttctagtgaatttaaagcagacagaaaaatgtgaaaaagagagatgggcctcacctcccagcctacatctttctccagtgctagctgctttctgccctcaaacatcggattctaagttcttcagttttgggactcggactgggtctccttgctcctcagcttgcagacagcctattgcggtccttgtgatcatgcctactgtagccattccctggctactgcttatgttcgctcacctccctggagctctacctacaatcagcaggtggcaaagccaaccaggcctgtgtgcttcctttcagggtggtgaggtccctcaggcccagggtacatgtgcacaacgtgcaggaatgttccacgtgctgaccagaagtatgtaaattgtgcagctgttggatgaaatgtttataaatgtctgttaggtctatttggtctatagtgaagatcaggtcagatttttttatgtg

SEQ ID NO: 471027 - DNA, 580 bp, Homo sapiens
ctgcagcaaaccaccatggcacatgaatacctgtgcagaggagtctctctccatggccatcctcaccccaagcccatggcgagtgctgcttagctactgccaatattcagtcaaggcccaagagctcctcagtcagtttgtggttaatgctgccagtcctgagtctgtcccttcaggacagtgggcttcccaaggaccagagtcacagccattcctgggttcaggctctaagaatttggaattacggtattgcagccagccatgtaggcttcatggagtgaccttggagctccaaggatccctggggtcagccaatgatgatactcttgaagaatttctgggaaggcatgctggccctgtctacaattcccttttcctggcactctgtgtaaataatcagggatgcacctgtctcattacagaaaagcgtatagagaaatgatcagtgtatgggttttggattttaagagcaaaatctattttgcagattggtcctgctaaggacagaccacagaaagctcaaggtaacatattaataaatttgctgcaagaaataacacatggcagtaatttgcctgaa

SEQ ID NO: 471028 - DNA, 1117 bp, Homo sapiens
cagcagctggagatcatgggcttggaagaagacagaaagatatgggaaagtttgaaacttcctagagacttgttgaatggttttgaccaaaatgctaatagtgatatggacaatgaagtccagggtgaggtggtctcagatggacataaggaacttattgggaactggagcaaaggtcactcttgctatgctttagtaaagagactggtggcattttgcctctgccctagagttctgtggaactttgaacttgagagaggtgatttagggtatttggcagaagaaatttctaagcagcaaagcattcaagaggtgacttgttttttcctggaagtgtatagtcatatgtgttcacaaagagatgatttgaaatggaaacttatgtttaaaagggaagaagaacatgaaagtttgaaaaacttgttgcctgaccatgtggttgaaaagaaaaacccattttctggagagaaattcaagccagctgcagaaatttgcacaagtaacaaggagctgaatgttaatagccaagaaaatgtagaatatacctccagagcatttcagggatcttcatggcagctcctccgatcacaggcctggaggcctagcaggaaagaatggtttttttggtggatcccagagccttaccactttgtgcagccttgggacattgctccttgcatctcagccactccagctctagccatggctaaaaggagccaaggtacagctcaggctgttgctccagagggtgccagtcccaagtattggtggtttccatgtggtgttgggtctgtgggtatgcagaagagaagagttgaagattgggaacctccacctagatttcagaggatgtatggacatgcctagatgtccaggcagaagtctgcggcagggatggggccttcatggtgacccttgacttgggcaatgcaaaggaaaatatggggttggaaggttggaacccacccaaagagtccccacactggggcactgcctaatggatctgtgagaaaaggaccactgtcattcagacccccgaattggtagatccactgacatcttacaccatgcacctggaaaagccacagttttagggtacatgtgcacattgtgcagg

SEQ ID NO: 471029 - DNA, 817 bp, Homo sapiens
ctcctcacatcccagatggggcggcggggcagaggcgctccgatggaccttcctccttcttccggaaagaatcgggtcacacactgacttgaagaatggtgtatgcagggatttttctgagtggtggaggtggctctcagcaggatggatggggagctggaaagggaatgaagtggaaagattatcttcctctggagtttggccgtctcctgcagccaatctccctggctgtccccagcggaactcctcttgacattcagatgctccttctcttctcctccttctctaccacaccgctctgctgctcttctgctcctctgcttgaccactcatggaacctgggagccgcagtttccaggcttgaaggtagggcctttgccagtgaaccaccctcttctacccagtatttccctgcttcctgtccataccaacattgcctctctaaacatgataatttggcagccaagccaggtatagacaatctcctgatggtctacagatgtcacattaaagtgttaattgagagcaggcaccagggagaggcaacttcccagataaaaacacttgaaattgataataaaatctcaggtattgggtgggacactggagaaacagggatgaatgagacagacaaggtccctgttgtcacagagctggtagcctagtgacaacaacaacccaagaaattaatggaaataactatgataggggaagtacgggatgctatgggggcttattgaggggcacccaacccggacttgagggtcaggggcttctcaggaagtaatgtttacggtagccttcatcaaggctcttt

SEQ ID NO: 471030 - DNA, 1682 bp, Homo sapiens
gccaccaccgctattaatatgggctttttgccttctgccatggttgtgaggcctcccctgtcatgtggaacttctgacaatgcaatagaaaagaaaaacccacttcctgaggagaaattcaagctggctgcagaaatttgcataagtaatgaggagccaaatgttaatggcaaagacaatggggaaaatgtctccagggaatgtcagaggtcttcacaccagcccctcccatcacagcctggaggtctaggagaacatgatggttttgtaggcagggcccagggcccccctgctgtgtccagcctagggacttggtgctctgtcctccagttactccagccatggctaaaaggggtcaaggcacagcttggaccatggcttcaggaggcgcaagccccaagacttggcagcttccatgtggtgttggacctgcaggttcacggaagttaagaattgagtactttcaatatgagattgaaaagaaatggttacaggggacatcctcacaatgcttctaatcttagtgggaaggcttcaagtttctcactattaagtatggtattacctgtagttttttgggtttttttgcgggtatttttttaagcaggtattctttatcaaggtgagaaaggatggctacagtgggctgaagttgggtcattccattctcccaaatggaaagttagaactgactagaattgggcatttccctttctcgaggtcagttaggctctgataatgcaccagcagaatactttgagtagaattggtattatttcttctttaaaggtttggtaaaattcaacagtaaagccatcgactcctgaatgtttatttgctgaaataaattttattagagctttcatatcattactttttattagtcagttcaggttttggatttcttcatggttcaattttggtaggttgatgctacctttattcttgctttttgggaattttactattaaacgtcttgaggtagtcttatatgggttaaatctgtttggtgttctataaccttcttgtacttgaacagtgataccttcctctagctttgggaagttctctgtattattaatttgaataaactttctgccatgatctctctctatcttctctttaagaccaataattcttagatttgcttttggggggctgttttctagatcctgcaggcatacttcactttttaaattcttttttgttttacctcctctgactgtgtattttcaaataggctgtcttcaggcttactacttctttcttctgcttgattagttctgctgtcaagaaactgatgcatgcttcagtatgccaattgcatttttcagctccagaatttgcttgatgctttttaatgatctcaatctctttgtttaatttctttgataggattgtgaattcctttaggtaatcttgaatttcattgagctccctcaaagcagctatttttaattttctgtctgaaattcacctatctctgtctctcagggatttgtcactgatgttttatttattttgtctggtgatgctatgttttctaggatggtcttaatgcttgggaatatttcctagagtctcagcattaaagatttaggtatttattttagtcttcaaagtcttggtttgtttgtactcatccttcttgggaaggctttccaagtgttctaactgacttc

SEQ ID NO: 471031 - DNA, 1391 bp, Homo sapiens
ctttatcaatgggggataggagcccacggattaattctcttgtttttccactgggtggatagttttaaggtccttacttaaaaccatggcctccacttcctatggaataagatctaaactccctcagcgagacacacaaggcctttctccagtcctgaccctggcccctggtctccagtgtgatgctttgctcagtcctaacaagcacagggaatcccttcaagggaggactcgctgcccacctgtaacagcacggccacagggggatagagcaccaagtgggcctgtgggatcgccaattccagaacttgacccttggatggcatttctggatctgcgatggggaagacaggagcccattgtcctgaaaggccttaagggaatattggtggtagtttggcagcactccctgtgggcctgtgggagcagtagctataaggtttttgattctgtctctgactccttgatggcacctctgaacctacgcggggctgtcctggttggctttgccacttgccaattgcagacccccagggccttgagtaaacttaagcagtagccagggagtagttacagcaggctctgggaataatggtgtttagatctaaatcctgtgcctttgatatgtaaatattcacctaagaagtcatgtcttgggaaataaaacatttctgcttgctagaaataagaggagagactaattcagttgttacatatattatttggggagacatttgtaaccatctacacttctttgttatgtcttttaatctgaatttttttgtgacagtatatattttatttttaaaacaatgaagcaacatttataatcaatatataatttaaaaggaaaaaaacctaaaaacttttatgtgatagcacactagcaaagatttcttaaataggcaattgctttattgcactcttgtagaatggctgtactatattccacaacaatgtagttgcatccttccaaaataccctgcacagagttcaactggttaacttaaaagcaacttataaaatgcacagtatattggtgtctctgagaggggtattatttgtaagaatatgagaggatcagttgtagccaatttgtgatatttagtataactctttagtactattcaataaatagtacccattaattttctaggcatgttgtagttttaaggtagtggttaagaaacagtctgggttaaatatagtttgcaaacatactgattttgtgactgagggttaattactttacagattttttttttatctctgaattggatataacagtattcctacctattaattgtctcctgtgatgtttaaatgagaataacattttgcatatgaatgacatatataatacacaataaatataagttattttaaaatgc

SEQ ID NO: 471032 - DNA, 977 bp, Homo sapiens
agtgaccacagtgggttcactgcaacactcaacacgagggtctgtggcttcattcctgaagtcagcgagaccatgaatgcactgggagaaacaaacaactccagacacaccacctttaagagctgtaacactcactgtgaagacacagaaaaaaataaaaagcaagatattaaaacacactaccagagcaaatcacttttacacaaaggaagacaggaaggaagaaaagatgagaggaccaaccaaacaaccagaaaacgaataacaaattggcagtacgggcagagacacaagaggctggacgttgagaggaacatattggttgaagagcacgttgacaggcaccagcagatgccagcacgctggcaggccatcaaccggtggaatgacctggagtttggccagggcagttggagaagagtccagttgctgagtggcccaacgccaggggaaaactttcccattccatctcccttctggcttccccatctgctgagagctacttcaataaaaaaacttgcacttattctccaagcccagattgttctcatgaaggacaccattgtaggaatgaacacagaggaattcacagggaaagatgtagcccagacctactggatatagctagattgaatccagtgacctctggacttttagttgttaagcaaatcacgttctatttattttatatggtcaaatggtataaattaccatacaaaaaacttaaatatttttagatatttttacctaaccagagaataattataaagaatataaaaactattaaatgtagccctataatattaaagtcataaactgtcattgctttggaagatataaagtaaaaactgaaaagtatgatgattttatgtacatgattcttctgttcttacacttctgtgacgattggaaaattaaaaactgcaaagcagtttatgctgtttaaaagcagatgatatatgagtcacttaagtcac

SEQ ID NO: 471033 - DNA, 853 bp, Homo sapiens
cagcctagtgactgacgttaaagtacatccaggtgctattgctggcagagggctaaaggtgactagggaatgaaaaatttgttgacatattcacaaggaacatatataatagaaattgctcaatatgggattgcatttagaaatacattatttaatgaggaaggtttaaccttcaagaaaacacctgaaactgatcagcagcgtctcagtaaaatcttaggagtggggagaagtaatgcaagatcctggaagaggcgagaaatgaaattgctgcagacccaaacagatacaccaccggtaactcgggaaaacctcttcacaaaggtagaagagaaagaaaacaattttatcacagaatatgcattaaaccagaatgtggtatgcattccatgcaatccactaagagactgcaaagacaatctttatgataggaggagtgttttaaatgagcctactctttgcctaagaaaattaattagctatgagctaaagcatcatcagataaatgatcctggaaagggatactgaaagtcaacagaatttaatcccctttttgggactggctcaactgataagtacagttctgcaaagcagagagttagagacaagttctcagtcaacaaaaaaggacaaaaaaaaaaatccccatgacacaatgaagcctaaaactacctcaaaaatcttggcagaaaaaagcaaaagagcctggaatctgatctaatactgagtctgagggatggacacttctaaaaatcagggctttcttcacacaaaagatgagaaggaagggttgtggtataaatcactaatagtattaaacttgggatgcccactgacttttccagacttcaag

SEQ ID NO: 471034 - DNA, 1841 bp, Homo sapiens
gcagtaacatttgatatcgacagtgttctggacttggccattctaataggcttgtagtgccatgctccctctgctacaggtgctcctgcaccaaactctttgggctccacattggctagcatgcttcccctaccacttctctaagcagctctccctgcaaactcgagcacccatggtggtcaagtggtctccccctgctgggattccagaggcttttggcaaaagcaggttactccttaacagtacacttcaacttattgaccaagattattacagacaccaaactgccctagactttctccttgtggacaagacagagtctgcacaatcactagaaaatttagctgtacctggattaatgctttggaccaagagtttgggcactcacagtatttggggtgtctcctgggtcctgcaggagcaatctgcttccttcaggggtctatggatcttttcagaatggttccccaatctctccattctctacctgatgatcctagtggatgagaaaattaagaatggaaaatcttaccctccactggctggagcaaatgagctaatgatactgcctacctaactgagccttctatgggacagacacctttatctcaagcttctcgatgttaacaccacaacagcaagccctagctttagggacaaagcctgcagctttcaagctcttctgtttatggctgagtaggtttaagtgttcagcttttgtttgggtagttattattggcttcagctaatcaagttagtttaatcgtttcatatttgtgcatctattgtttcagaatctggggaggagatagatattaagaaaaaactgttaaaaacttagatatatggcaacaggatggtgtatatcttctgcatgtacagtagcattgtataattggcttacccaggagatttttatcctcctagtgataaacctctgttttacctgttatttaccatttattaagacccaggtctccatgacattagatgttaacttgcagggttttgtgttcaatagaaaaaaaaaattgcaacatttatagtttacattagcttgttctgtatcaaacctatcaatctcattgcaacattcttcatcagcatcaataaatagtgtttcataaatgtgtgctgaacctgttttaccatctcaacagttctcatagtaatgagttaaagaattgtgtataaacacaacaaatgtattttaaagtggtgcagcatccccttcataactgcttcctgggatcttcccattcaaaagcaaaaagttattgagattccagggccagagggatagaaaagaaaacattttttaaattttggactgagaactattctgtgctccctggcacttgagttaaaagagtatatggatctgtcactaatgggtggattgggatcacagactcattaattgccttgaaatcttgtaccaaatggtattagccagaaggctttaaatgggggtattacattacagggagaattgcaaggttttagaagaccatgggcaagcaatttcttaagcacagatgctaggacctttcttgcttccagtttaactgcatatttttaactggggtctttaagctgtattttgactggcactgctgttttagcccttccaggtctcccaggatacaatgctagcaggttgacctgcttgttgacatggtccgtaatattgcctgtatcacggaacattagaaatcttgccaggtggtgcttaaattgcagcagtgcccctacttatcctgtgcagagatcttggtacaaaggggatggctccattccacatcaatgcagatttccaggcctttggagtacctgctacc

SEQ ID NO: 471035 - DNA, 775 bp, Homo sapiens
gtcattactttccagggagtaaatggtgctgtggcaattaaccgtatcccagatctgggacacgtctgtggtgctgtccgtggacaacggccgcacctcagccctgctgcgcttggcaatctcgtcggactgcgccttgacctttgcaatgatgctgtccaagcacagcagggctgaggctgagagcatgtaccagatcaagtatgaggagctgcagacactggctgggaagcacggggatgacctgcagctcacaaagactgagatctccaagatgaatcggaacatcagccagctccaggctgagactgagggcctcaaatgccagagggcttccctggaggcctccatcacagttgccgagcagcgcagggagctagctgttaaagatgccaaggccaagctgtccgagctggagctgatgaacatcaagctggccctggacatcgagatcgccacctacaggaagctgctggagggcgaggagagcctgctggagtctggattgcagaacaggagtatccatgggaagaccactagcggctatgcagatgccctgatctcagcctatggggacctcacaactcccggcctcagctacgcccgggctccagctttggctctggctgggctccagctccttcagctgcaccagctccaccagggccttggttgtgaagatggagacccgcgatgggaagctagtgtccgagtcctctgacgtcctgctccaagtgaacaaccatagcagaccctctcagcatacccctcctgc

SEQ ID NO: 471036 - DNA, 1334 bp, Homo sapiens
tgcagcaaaccaccatggcacacgtttacctgtgagtgaagctgcagaccttcgcggtgggtgttacagctcttaaggcggcgagtctggagttgttcgttcctgctgtccggagttgttcattcctcctggtgggtttgtggtctcgctggcctcaggagtgaagctgcagaccttctcatggatcctgcacaggggccgcaggtggagctgctcgccagtcctgcaccatgcacctgcactcctcagcccttgggcgatcgatgggacagggcgccgtggagcagggggtggtgctccttggggaggcttgggacgtgcaggagcccatggtggtggggaggctcgggcatggtgggctgcaggtccggagccctgtcccatggggaggcagctgaggcccagcgagaattcaagcacagtgctggcaggctggcactgctgggagacccagcgcaccctctgcagctgctggcccaggtgctaagcccctcactgcccagggccggtggcggcggccggccactccaagtgtggggcccgcggagcccacgcccacccaggactcacgctggcccatgagagcagtgcacagccccggttcccgcctgcgcctctccctccacacctccccacaagcagagggagccagctctggcctcggccagcccagagaggggctccctcagagcagtggcgggctgaagggctcctcaagtgcagctagagtgggtgccaggctgaggaggcgctgagagtgagcgagggctgccagcacactgtcacctctcactttgacctacatttccccattttctccccctctcccaccctagatgccctcatatcacaatggtccgttacattggtgacattatggtgattggacctagtaagcaagaagtagcaaccacactggacttattggctgctgtgcaagctgcgctgccacttgggccacataacccagcagatccagtcatgattgaggtgtcagtggtaaatagggatgctgtctggagcctttggcaggtccccataggtgaatcacagtggagacccctaggattttggagcaatgccctaccatcttctgcagataactattctcctttggaaagacagctcttggcctgctactgggccattgtagaaactgaacatttgactatgggtcaccaagttaccaagcaatctaaaccgccttttatgaactgggtgctttctgacccacctaccaataaaattgggcatgcacagaaacattccatcattaaatggaagtggtatatatgtgatcaggcttgaggaggtgctgaaggtacaagttacat

SEQ ID NO: 471037 - DNA, 627 bp, Homo sapiens
ataaaaagcaagtcaaactagagcatatgtatgtacatctgaatgctgacctgtggaagctgaccatgaacatcatcccattcccctacctgcacttcttcatgcctggctttgccccactgaccagccagggcagtcagcagtaccaggccctgaccgtggctgaactcactcagcagatgtttgacaccaagaatatcacagctgcttgtgacacctcacctcattatggctgctacctaacagttcctgccattttcagaggccacatgtccacatgggaagtggatgagcaaatgctcgatgttcaaaacaaaaacagctgctactttgcttattggctccccaaccatgtgaaaacagctgtctgtgacatcccaccccaggggctaaaaatgtctgacacctttatcagcaacaacacggccagccaggagctgttcaggccacatctcggagcagttcacagccatgttcaggtgcaaggtcttcctgcactgctatatgaactgcttcaattgactataggttccattatctacaatactgaaatttggccttaaatagtagtgtctgcatgtataattctgctgttttaagctactgctgttcttaaacaccagctac

SEQ ID NO: 471038 - DNA, 3227 bp, Homo sapiens
gtctatagtaacccagacagctcctccccagccatgtggaactgtgagtccgttaatcctctttccttcataaattacccagtcttgggtatgtccttatggaagcataaggatggacaaataccaataccattatgtgtctggctgccacaccttgctgtgggtctgcttcagaccctagtcaccttggttttttctgtgcctggagatatatgcagtcaagtctgtgaaactgcaaagaattccttcctatggaggctccttcctctggaggctctgtcccagggagtactgatgtgttgccagcctgaacacatctgtaagaggtggttagagccccttttgggaagtctcactgagtcaggaggaatgggatcatggacccaattaaagaagcagtctggccgctttttggtacagcaggtggctgaaacaccttcagggaggtcctgccaagtgatgatgaatgaatcatggtcccatttaaagatgcagtctagctacaatctggcaacgcagctgtgctttgtcgtggggggtctttccttgtctggaccattagtattcccaaaggtgcaggctggaccaactaagtctaccaaactgcaaactgtggctacccactgacttttgctttataaaaaaggtttaagtctgaaataaaacatacaattagaagttcatatacacatagtattattatttcactgcatggactttccacaaaattgcacactaaatggcatcttttcttggttcaataaatataaacatatgggggttggttaattactaaaagtggtaattaattaactgtatatatggctttctttgtagatttccatgtaactcacaactggaattttaagcctgcacatttattaaacttaacagatttctaaatactgctgattttctcctcactgttcttttgcaaagaataagctgtatacaacatgaacataaatctgatttatttttataggagctctgactagaattctagagttgttttagttaactttatgccaggatttccaataaaaattcctctctaatgtatttgctatttggtcattacattcatttggataaaaatgatttaaattaaatgtgcttcttaataaagagaagtttcagtgattttacttactaacattgaagattttcataaacttaaatcagagtatttctaagctaccattagaggaaaaatattgcatttaacaagcaggtatctaccataatgggctccgactgctttgaataaaaatgaaataaaaatgccctaaatattcagtaaaatgaaatcacagtataatgtatatgctgtcaaaccttttgaactaatagaacaccagaaaaagtgagaaagattaaagtaaattttaaaatatgcttttcagtctagggcataggcagggagcagtggctttcagaaacccaaacgcttgtttttgtggctcttattcagacatatcgcaggttttactaaataaaaaatggcaccttttttgaatcccatttactcttgtctcccctagtagggaagattttactggttaagtgaacatcctgaatattcctaccatgacagaactcatgccagcttgtgctcagaccctaggggatgctgcccagagccaagctcgcattcatgaaaagctttgctatgtggtaagcttattttttcttgtctgttctatgtgaaaatgatccaaaaatctagacttgtattgtctgcttacacatggctagccatgatatcactaatgtttgctgaaactcgttgatagggtcactccatcaaaattaacatggatggtttgggcagctttcggtttgatccatatccatcatgatgtcaagtaaaactgaaacatttatatttgccactctctcacatgaaatgttaagctacagatattttaatggaaactgggttgtttaattaatcttaatcattttagtaaattaattcttgattgtaacattctaatagcttgaccccttattattcaaatattcccctctgtcaaacttcagcttattgtcttcttctccactactcaaaagaataaattccaaccctccatttgagcattcagcacagcctgtcttgcatcacttgttgttttcctacctcttattatctaatgatgtaatattgaactttgaaaccagttatgtctttctctacagctaaatagttgtgtaacacagagtaagcagtgaaaggcttaaaatcttttctactaatatacataaacaattaaaaggatacctttgaaacatttttttgtaatggctgaagggaaaattttaatggatgaaagtgagggaaagtaataaagacagaatttgttttacttaccttgacatttgccttcctatctgttctctcagctcatctcaattcaagctcttcattgtagctcttgttctaaaatacaaattgtattatgcctcttctttgtttaaaacttttcaatagtttgcctttagtgcagaataaatttgaatttttgagtagctgtcttcttacctcatcaaatgctatatcattaaagcaaaccacagtctaaattttgtcatacatacaatgcgtattagaaaaatattccttagaaagcagggataaacagtctgtaaacttgtccactaaacttgtttttcatgcactattgtcactttgtgtggaaagttcagccaagatagataaggcagcattccataagctgggtcctatagtcttatagttggggtcaggaaacaatttctccaaacaaatagcaagaaacaatgctgatgattaagctctgattttggtagtaaaaagtcatatctgatatttatcatactaataggtaaaccttcatatattgacggaatatggctagctgaagggaggacagcgatgcctctcaagtgtgtacttcctgaaataatgccaattgactgtccctatgttaaagattttctataagggccacttatttccttagatttgaatctcaagttactaagatatgcataatgccatactttatatggtgaggtatgtaaaattatagacatctaaaaatgcttttgaattattttctgttttgttaaattttattcataaaactataacatgctttacattatgcattcaaaactaagaagagtattactttaaaaacaaaagtcctactctttcacaattaccccagtttcttgctgtt

SEQ ID NO: 471039 - DNA, 607 bp, Homo sapiens
ggttacattgggaaccaaagaaccacgtggataagcaaacgggatgctgttgcaactttcacgccctgtgatacggctgtggcttgcttctttggtgcctgctgctcaaacctctagcgggagcatgcagacaggcaggacagaggactttctgtatcctggattcttgccttggtgtactggaagaattggatcacacatgggcttggagaatgagcgcaaggttttattgagtggacatagctctcagcagatggatggggagccagaaggaagagcaagtgggaaagtggttttctcctggagtcaggcctctcagcagctgggctctctcctccaacctcaccagccaaactccaagtcgttctgccagtcaatggcctgccagcgtctgccagtgcctgtcggtgtgctcctctggttaccagttcaggaaacaggcaaagtgattgtcttgttcaaactcataaccgaagcaactggcataagacctgatacagaagatgttgatgaggatgtggagaaaggggagcgctggtacactgtttgcaggaatgtaaattagtacggctactgtggaaacagtatagagttttctgaaaaagct

SEQ ID NO: 471040 - DNA, 1014 bp, Homo sapiens
aagaaacgtgaacgctcatatattgttgactaatgtcctttgatggagaaggactacactttagttgctgtactcaatgatgacgccgaagctggcacatgtatacctggacaagatttaaaagatggaattctagaacttgagcctgtgcttaatgcttcagaggccagcagcactaagaagccagcactctctgccctcttcgcaggcaatttgatagcagaatctcttcagatccttcaatgcttgcaggttctccaattccttgccctgcagtccacagctgtgagcactcagctgccagctgcttcctcagcacctgaccccatgaccaggaagttaagcagcatccctctggctcctgcgtcacatctggtttctccagtgttctgctcctgtggtgtacgacaaccagcagcacacgatagcaaacagctttccttggcactttgcaaggaagatttttaaggcctctgccaacacaggtggaagataacaaatatttctctgccgtttagtgaggcatgactttgccttttccagcaagatctgaatgtcagcttggagtaagcaggggttttccttgtgcattctgtctcaatcttatggttagtgactgttctttctatatttagagctatctttacttcttactagccaatttctccttatgctaattctctagtgttattaataattcttcatgtcaaacttttttgttcaaattacagtgtggtttgtcttgcctgattggacagtaattgatgtaaatatgattgcaagaattgcaaaattcaaggtccacaatttcatgtattaagcttatactataagtttaaatttgattatatctcctaatattctagctttattataattgtgtctcattatcaccatatcttattctgattatttaacatgaaccttatactattaaatatctcaagtcagttatgtaacacatggatcaagtaaaaaaaatgaggaacataacattatttttctattttaatc

SEQ ID NO: 471041 - DNA, 727 bp, Homo sapiens
atctgatactacaaccactaccgggctccaaattatggcagctacaggaaaattgagtatcattctggggacacaaggttccctgccgctgaatcgagtgcagtgttgtgaggcttctgcccaaagggaaaggcaagatgttagcaagaagagctctgtgtggaacttgctgagaaaactgattttacttagagcttcataccttaagggtgttgttgagaacagaggggatctttattggaaagcaataaagaaaaggctggtagctctgataaaagcaaaacagcagagcaaccagaaaaagtcaggggaaaagttatccaaaaacactttccctgggttcagagtcaaatttgggtgtcaagaaaactgtgtgcatatgctaagcagggcccactttagaggcaatcagaacaagaatctgggtagacttgaaagcattctccagcacatgtacagattcatcagtgcaaaaaggaaaccaagacctcactagtcaagtaagattaacaaaaccttcgactgaacactgactgaagaaatgtgtagtgatgtcactttgctcattctaaatactggtcatgtgttttctctcttttctataatgtctacctatagatttattactttcatttaatatttacattaatatatttataatgttatataaatgtattttatttatattaatattatatttggatattttcaaattatgtacttcagg

SEQ ID NO: 471042 - DNA, 647 bp, Homo sapiens
atctgggaaaggagacctgaggagttcagtcttcaaagtggagagctgacatgactccagacatccaagggggagattttgagtgggccactggatactggagatcaaacaagggatactggaagcaaagagctacgtcagaaatagctccacggagcccaaagccctgggcaagactaaattgcaaggaagcagaaaggaggaaatcttcagagaagccaagctccaaagggaaagaagggtatgcagaatccagacaatgtggcccagacaaggccgttagaaacaatgggaatagaaagctgaataaaaatcctgaagtcaaagatgtactcaggacaatgactgagagcccactaatgttctggggtagttatcaccagaagaaccttagtcttggacaagtacctatcccaactcctatcaagatggtgttgaatcttgagcctcttctgcaggctccagactcaagtagaaaaggctgctggcaccagataataattactcaagtggagagaagactcctctcttaggtccctcagaaggtaggcctgaggacaatggaaagagggaatcgtagtgagcatatcctaggacccccaaagcatgacttaggaagttactctattacctaggcaagaaacaga

SEQ ID NO: 471043 - DNA, 542 bp, Homo sapiens
cctgtcattgattcatggatgctaaaagaagacatgacactctgtggtcagaaacataggactttgttactcagagcacagcaagaagcatgtgcatcagcatatttgcctccaagtctcacaggggcaatatggggggcccagatggatgttccacaggcagctggaagactcttcactaaagatgtggacatcgaagttcaggcagggcagagagatttgccagactggactgtcctgccatctagtggtgggataagaggattagctagcgtcccctccagctgtggctgccctggagagaacagcaatttttttggaggcaacattattcatgatagccaaaaggtggaaaaaatccaaacgctcatgaacggatgaataggtaagtaaaacatgctgtattcatacaacggaatattattcagcaataaaaaggaatgaagtgctgatacatgtcacaacatggatgaagctaaaaaatgtgctaagagaattaagctggtcacaaaaagccacgtattatatgattccatttatat

SEQ ID NO: 471044 - DNA, 553 bp, Homo sapiens
agcaaccactaatctttttccttctccataaactttcaacacaatgttgaaaagcagtgaagagaaaaaccaattttctgaggagaaattcaagccagctgcagaaatttgcataagtaacaagaagccatatgtcagtcagcaagaaaatgggaaaaatgtctccagggcaagtcagagacctttgtggcagccccacccattacaggcccagaggtctaggagggaaaaatggttttatgggccaggcccagggccccctgctgtgtgcagcctaggaacttggtgccgtgtgtcccagctgctgaagtcatggctaaaagaggccaaggataatgtaaaaacaatagcaactttgaaagtcaagatgggtcatccagcaatgaactattacccaactcagtcgccaagatttggatcattaagtgctcagctacataaggaagaaatgaattactaatttgtgttgttaaggctaatgttcttgtttagtgtttagactgacctataagttcctgcgctgtcctgaatgaagccttgcaggatggaaata

SEQ ID NO: 471045 - DNA, 1446 bp, Homo sapiens
atctgtgtgtctgtgcatctatgtatatgcctgtgacacagtcctccctgtcttccagctacaaagaacacatttcaaacaccttgtgcagttcccttgaacctccctctctagatgcagggttagaaggtgacagcccccaccccccgcgacccaccccaaatgggaaaggaacttatacctgtctcacaaacatctggaagctggggaaaacatcagagcaagtgaagaatgttcaaatatacagggaccatccagagacatgtggcctgcacgttgatgagcaatgtgaactgaattactgttgtatctggaggaattccataaaagagagtaatcagtctatttggatcccaactgccttttcctgtccccaaagggcgggaactagtgtgggtggaaaaacccaatgcatcccaaggcagtcctgccttctaaagcgcccgccaggacaggctcctggtgggttgtaaggagaacggcaggaagaagtgctcccaggaagctgcctagccaccgccaccaccacagggttccatccaactgacttatggcatcaggagctttgaattgtctcatctccaagactctgaaggtccttacaacactagcaatccccttcatgccttaggggatctctacatgatgtcctgctcagatgatggaaagccagcccccttcctcttgcaaactggcttcttgcacagtcacctggccttagactagaaccatggctctcaaatttcagggaaagtatgatcaagcagttcatcaggaagcacaaatgccacatggacagggcaattctttttcaagaagacccacagacttctcctgcctaggctctgaagaagccacaaaaatctgtccttccactaggctttcaggagagatgagccgtctccatttccatcagtcactcagctcttccccaacaccacagacaactggccgccttggaggctcttccaagtttcctgtagcagactctttagttgttataatgttccagaaactgaagtgggaatggaagctatcaagttttctgtactccaaaaattgtctccagcacattccctgagaaagtgttgcatccttgccctgaacaccttccaacagaatgactaaggaatactcaatgctagaccattccagcctgttcacccaccaagaggtggaacttgtctgaagctacaggaccacaattgaccataccctcccctccttctttgctttatctttttggaacatattctgtttattattaacatttttaaactatgagacttaaagataatctgttctaagcccctaatcttgtacatgactaaaaaaaatcacaaggacaaatagaatgcatgcacaccatcactctcctatcctctacccacagcagagatcactaatcaattaaagcaatcttttctactgcacacaggtgtggcc

SEQ ID NO: 471046 - DNA, 1021 bp, Homo sapiens
acgcagataaagcctccaggtagcaggcttcagagacaaaagattgtaaatatttcttatcagagttaaaaagcctcgctgccaccttgcagtttgatctcagactgctatgctagcaatcagcgagactccatgggcgtaggaccctccgagccaggtgcgggatataatctcctggtgtgccgttttttaagcccatcggaaaagctcagtattccggtgggagggcggacatacctcaaaggcagctgcgagaactccatctgtgaggcctacctagaacgtggtgagggtaacagagcatcagtaatgggcaagatgaaaaagacagctgctggttggaatgggtccagagtgagaagagcaactgcagtacataaaccaaagacacctgtatctttgggttctgagcaggggccaaagttttggtatcaggatgatgctggccttataaaatggggaaatattaataggtctcactgtatctatatccaaagcgataaccagcaaaataataaagaggggtggggtgagggaactggtgggggtgtggcaggtgattaataccctgttaacaggatgacagaattgtcttgtgcaatattaaccacccataacactatttggtctgataaagaccagccctgtgaatatttaactttcacaatatttgctttactgatagtgggccattttcatatatgaaatatagcctattgcttattattaattagacctgagtcgaccttcaggatttaatattctttcaacaatgatttgtgtaatttattacatggtaacatacattcaaaatgtgagaacattaggacttaaaatataggcttggacagaatcttgatataacatctaactaattcatttgactatatattgcaaatctttcacattctaagtactgaagggcatccatgaactataagatgccttctatcctcttatgtactggagctctactttcaggggaaaatgaaatgaattcataagaacacaaggcagagag

SEQ ID NO: 471047 - DNA, 1226 bp, Homo sapiens
gcaaatttctgcagcaggcttgaatttctcgaactgctactctgcactgctactgttgctgtacgctgatgctgctcctccttctcctcctcctcctttttgggactgctgctactgctctggcctgctctgcctatagagcagccactttgctgtacactgctactctgggcaattctgcctatgggagagccccgctctgtctatggacagccattttgctgtacactgttgttttccaccaacttgactccctctcctcaattaagactccacaagtatcacggtgtttctattcaagtaacccttacgtttcttcggacatggatgaaactggaaatcatcattctcagcaaactatcgcaagaacaaaaaaccaaacaccgcatattctcactcataggtgggaattgagcaatgagaacacatggacacaggaaggggaacatcacactctggggactgttgtggggtggggggaggggggagggatagctttaggagatatacctaatgctaaatgacgagttaatgggtgcggcacaccagcatggcacatgtatacatacgtaactaacctgcacattgtgcacatgtaccctaaaatttaaagtataataataataaaataaaaaaaagaaaaaaaagaattatataatgacaaaaagaaaaaatgcaatagcaagtattagagagactccaagtactgattaattaaaaagttagttactattctttccacattataagtcttttttgtttttggagatcaagtggttctttgattcctttttgaaggcaagtgctttcattttgcttctgactttctctaaagcagtgctgtatttgttaaagctctaatcctctcaggcacttgtgattagacccccgaagaactgtttcatggcctctgctatgttttcttatcactgtaccttttaagctttcaactatatttcaagttctggcctgcgtgtggccttcagcataaatttcgcaggcaaagtggtttgttctaatgctttcctcatctctctcaattgtttgcatgcttctttttattatctttccatagctctttgacctttttattcattagctcaaaccacatgaaatatcatttggctaagggttaagtcagaaaaataggaaaggtggttggcttttggcatatatatttacatttttgaattttctatttttgcattttcagttttattttcctt

SEQ ID NO: 471048 - DNA, 505 bp, Homo sapiens
tgctgtgccatgatctcgaccaggtcagtgccaagagttcaggatgacagttttccacctctagccagccctcagcttttcccaggaaaggtagagaaaggtggaactggttccaggcaaaccaatgctcccagaccagagggctgggggttgttagagagccctttcccagaaaccctcaaacccgtcttaagtctggcagccacacttgttgcttttaaatggctgacaggcgccctgtgttttcctccaatttctagtgagaagatagaaagaatagcaagagaaaggggtccaatgttactcaccactttggagaaatcccagatgggctcccagaaaggagacgagaagtcttcttccatcaaaggtttttctcgatcaagagcactttgaaaatactgtcttgctctcacttggcctgcatggtttctgctgagaaatcgactgatagtcttatttaggttcctttgtatgtgtcttttttttaagcatgattgagcct

SEQ ID NO: 471049 - DNA, 958 bp, Homo sapiens
acagaagcaataggaaactaattcactgggtccttgcatcaactcacctttgttaatcttggctctgattttgtgctccagttggctttattattgttttaaaattcactagagtcaacgcctatcctctgttagtgtctataccaagtatggaccactatctgaccttgatatgccattgggatggaacccatgggaaaactgcatgtttccgcccctaagatctctgtttcccttcactgaattccgcatcttgtgcttagaaacttgtgtcccacattttcctgctaccagcaaaggaaacaaccataatcttcccagttgcgatgaattggagaaacccacactttcttggttttcttcctatgacactagctactccttttgtctcaccttttctggttctgcctcatttctgactcttaacattactcagtaccttggtgatcttatccagtctcatggctttaaatatgctgctgacacccaaattcgtatctccagctcctgcctctctcctctgaacaccaaatgcctataccgatgctcttcaatttatgatagggttatgtcccaataagcccatcataatttaaaatattctaagtggaaaaagcattgaaactatcttaagttgttacatctagcccatggaacatcatagcttagcctagcctaccttaaacatgctcagaacacttacatttgcccacagttgggaaaaaaaaatctactgaattcagtgtctatcttataataaagcactgaatatctcaaataatttcttgagtactgtactgaaagcgaaaaacaaaatgattatatgagtacttgaagtatggtccctactgaatgtgtagcactttcacactgttgttgagttgaaaaattctaagttgaaccataagtaagtcagggaccatctgtgtacaattcctactgacatctaaatttgtct

SEQ ID NO: 471050 - DNA, 1152 bp, Homo sapiens
ttaatcaacagaaacgtattttctcacagctctggaggctaaaaggggccaggagggttggtttctgcaggaaatgtcggttaaccaagtaattaatggctacctgtggtatacaagccactgggtaggatctataggaaatgccgagtataagataaggtctccatccataggaaacagccacctgttacaggacatccagcagagcagcagctgtgctccatttgtcttagccctttcccagggggctgcctgtgttcttgtttataagaggagggttgggcagggaccagatctcaggcaaacactgaacttcactctgctgacaattcgaaatcttattgtgggtgacttatggcccaggatcttattatattcagaagatgtcacaggcaagagtgtcagtcctgctacaggcagattatctgccaggtaccaatccctacagaaggccaatcccatgaccctgaggcccatcggaagcaagattcatttgaaaagacagaaaggcgtccttgtcttcgaccctgtgctctttaaaaaggcaaaagagttttatgaggaaatgcaaatgactgattcatgtgtatttttggaggggtatctttggcattttaaagagagtcctggtattaagaaggccagacacaatgtgaaaaatagtcagcaaatgaccatgctgcagtagaatgtggtgacattttcagagagtacatttcttagaacaatttctctctgtgcacttctatggagctgctggtactgctgaaatcaagctcctctgggatacagtaggactatttttacatgtgcaaattgtacaggctctctgaaataaaactactgagctagaaactccattatcctgcaacttccaaaactgaaaaacacctttacttactactcacatttcaccagccattgtgaggatgaataaatacgtttatattgctttaattttcagagtagtccatacatacatttatagctctaagaagaaaagcatttccaaatggttggttgtccaggattgtgaagttattctacccactcagaggcagcaggatcagtgtggagaatatttttagtacattccttttcaaaatatacctcattggtttgactcattgttttggaaatcattcagaatat

SEQ ID NO: 471051 - DNA, 829 bp, Homo sapiens
cccgggagggggaggttgcagtcatgctgatctaagagatgggcccccacagccttgagcagctccattcctgtggctttgcatggtacagccccatcctggctgctttcacaggctggtgttgggtgtctaaggcttttccaagcccactgtgcaagctggcagtggatgtaccattctggggtctggaggaaggctctggacatgtgatgggagaggctgctgtgaagaagcctatgaagccacatcagcttcatcaggaaacattttcacaattgatgaatgatacatgctttgggaacagtgggtctttttcgcttatctatattgcctcatacttccaaaatgttttctatatctgtatgttttttattgtcaaagctctagtaaaaatactagaaatgtcagaatcaagatccagctatgttaatgagctctgtatgagtttcacactgaagatcagctaattggctgtcacttttagatcacctggaagatcctaaactttaatgatgagcattttctggcccctgactgtgactgacacgtgctccttaagcccaaaatcttctctagcctctttccttattagggctttcatacctacatcatttaaggcaaataatttcatgtagggtcatggtcaatatgagtgaggatacatgggggaaaactgcctgactagcaacccaggtcttaccaattcctaagtttttcccatgtgtctgttgcttaacactttactttctatgtgaaaaaaaaaaagctattttactttctatgtgtttttatataacttgccccatcactgcattactgttcaatgtcc

SEQ ID NO: 471052 - DNA, 937 bp, Homo sapiens
actttctcaaagatcagttggcttttatgtgagtcgctatgtgttatgtgcgagaccgcaagcctcctgctgagaaagcaagccgactcatgggttttcagtgtctcagggagcttgcagaagtgatccagttccttcaaagggtctgcggattctcttggcttttctggtatgttcctgcagcagttcttggagaaaaagttcacgataaatgtgaagaggctagggggaagggtgaacggcacgaagaagagttgcagggcattaaggggaggggtgggcagtacagaggggttttgggggagtgtcagcagtaccaagaagctttttggggtagtttgtccctaaaagtcgtcaagggggttgacctgctggggttccagagtccagtggtaacaggaggttgctccttgccagttcaactcacctgttaccctggagctgttgtggtctagaaatgagaaactgtgaggcacaaaactgtaaaactctttccggtttctcctaatctgttctgaactcaccataccttgctcaaggtaatatggttaatgcagaagggaagggaaggaagaaagggaaggaggaagggaaggaagaaagggaaggaggaagggaaggaagaaagggaaggaggaagggaaggaagaaagggaaggaggaagggaaggaagaaagggaaggaggaagggaaggaagaaagggaaggaggaagggaaggaactactttaattggctcctaaaagtagcatgtttcttttgagaggattttgttattacctacccttctgaagcctacttctgtcaattcatctatctcatttttccatccagttttgctcccttgctggtgaggagttgtgatcctttggatcacaaaggcattctggtttttggaattttcagcctttttgtgctagttcttcctcatcttcac

SEQ ID NO: 471053 - DNA, 658 bp, Homo sapiens
acgtattccccctcagcccggaatgcacagattcctagtggaaagaatgactccagtggtatttcagaaatctttggaccaagccagggtcttgagggcaaggtttctggagaggggcccagggcacccatggggcttcagcttttgctgccctgtccctcctcaagtatctgctcctcacattccagaacaacacttctccactgccccagctatggctcaagaaggcccaagtgctgctctgaccaccactggggatggaacagctgtgaatgtaggcagaattcacatggtgataaccctggagaggtgcagagtacatgagttgtgggactgtggaggtctcaacctaggtttcaaaggatgtattgaacagtctttggactcagatgaaaacatgccacagggaaatagctgccaaagagaatctccactagaactatgcttgctggagccctgggggtggcggcagcccactccagaacagtagcactgccagtgtgcaatgccagcctgggagagctgcagtattcatttgagaaattacaaaatacatcattaatttatcaaaatatgtggttaaataccatatattctcacttataagtggaagctaaatgatgaaaacacatggacacatagaaagggacaacaaata

SEQ ID NO: 471054 - DNA, 646 bp, Homo sapiens
tatttgctatttccagtagaggtaatgcagcagagtttagattcagacattttctttttaaaatataatcaaatatattttcatctagtgaagaaggaaaaacagatatgttccatatcttttaggggacaagactccactgatgttgactttaagcacaaatgcaaacagcagaggaatggcagggtgaaatgtataggagcacagactctggaacactgtacagattcaaagcccagctttgccatttcccagaaaatcatcacaggtgatgaaatttttcaattggaaaggatcttggagatgatccagttagattctctagtttttcagaggaggaagttggagcacagagaaagtgacttgctgaaggacacgctacaaagtgagatcgctaaattctacgcaatccaagtccccttggcttctgggacactactggtacaggtgcatctcttccagagggatcatggagtctggtctcaggccctcagattaagaactgattcgaaagacttcagtacactgaagtaccatgcacactgatatttcaactggttatcagctctcaaaacattaacctaaaatgaaaaatgtaaacttgccaaatttggtttttgttttcatcttatgccagtaaactcat

SEQ ID NO: 471055 - DNA, 659 bp, Homo sapiens
gcaggcttgctagcaatatcagcccaagatgctggttttggagagcaatggtggctggaggcaaactattggaagcatgatgttactagtaatggacccgctaccaacagcagaacctacaacttttggaacattgcttgcaacttctgtgctacccaacttcagtgctgccatcccttggtctatagcattcatgccaggagccttactgagggtctcattggcaaaagctgactgtccatcaaccatggctccacctaaggagctaggtgcaatttcactcttttttatggctggggatgatggagggcagttcccggggcccctggcaatccttcagggcgtctgggtccaggtctctgcagttgggacagaagcgcttagccaggccacagatgcacaagagaggcaggatgaccaggaagatgatgacgaagatcctcaaggggccagggaagaactcgttctcctggcagcagctagggaatactttaaacttttccccattcagtattatgttggctgtgggtatgtcatagatggcttctattacattaagctacctctgcttgctttgggcgtccacttgcaagaaatctctttttccatccctttactctaagtttatgtgagtccttatgtgttaggtaaatcgggga

SEQ ID NO: 471056 - DNA, 723 bp, Homo sapiens
gtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttattt

SEQ ID NO: 471057 - DNA, 2277 bp, Homo sapiens
ttgttttctagatttctttctccccactgatgatgatatttgctgacccttggcattatattgggcccaccaaaataattctggatgctttttccgtcttaagatcctttatcacacctggacattctggggagcagaacatagacatctttggacagtatgaaggctatgaagtagagtcatctttaaaggatgccagctttgagaaggaggcaacagaagcacaaagtttggaggcaacctgtgaaaagctgaacaggtccaattctgaacttgaggatgaaatactctgtctagaaaaagagttaaaagaagagaaatccaaacattctgaacaagatgaattggccaaaatgaccttcaagatatttcaaatgaatgaagaacgactgaagatagcaataaaagatgctttgaatgaaaattctcaacttcaggaaagccagaaacagcttttgcaagaagctgaagtatggaaagaacaagtgagtgaacttaataaacagaaagtaacatttgaagactccaaagtacatgcagaacaagttctaaatgataaagaaagtcacatcaagactctgactgaacgcttgttaaagatgaaagattgggctgctatgcttggagaagacataacggatgatgataacttggaattagaaatgaacagtgaatcggaaaatggtgcttacttagagcatattaaaaatcttcagactgaacaagcatctttgcagtcagaaaacacacattttgaaaatgagaatcagaagcttcaacagaaacttaaagtaatgactgaattatatcaagaaaatgaaatgaaactccacagattaactgaaacagagcttaaatttgaacttttagaaaaagatccttatgcactcgatgttccaaatacagcatttggcagaggctcacgaggcccagggaatcctctggaccatcagattaccaatgaaagaggagaatcaagctgtgataggttaaccgatcctcatagggctccctctgacactgggtctctgtcacctccatgggaccaggaccgtaggatgatgtttcctccgccaggtggtaatgctcgcttgccctcctcacctcctgctgtgcaaacagttcctaacagcccgcggaaagatgggtcaatgccttcagaaatggaatccagtagaaatgataccaaagatgatcttggtaatttaaatgtgcctgattcatctctccctgctgaaaatgaagccactggccctggctttgttcctccacctcttgctccaatcagaggtccattgtttccagtggatgcaagaggcccattcttgagaagaggacctcctttccccccacctcctccaggagccatgtttggagcttctcgagattattttccaccaggggatttcccaggtccaccacctgctccatttgcaagtatgcttttttaaactttttttttaaagctcaatatgtggtttattaatcggagatttaattttactatctgttaatgtagtaacacagtggaggaaagttttttctagcattctgtgaatctgaaaattctcattacttttccgaattgggaaggcagccagccataagtggactgcaatgaggtttcagcttgattcatcttaataatatagaattatttctgtattttggcagtcaagaaaataatggactttttgcaggtcttacgataaaactaaaattatctgtaccttatttggtagcaactggttattctgacagttagtgaaaataataacttatattctagcattaaaattactggctaagatattttttaaagtctttttcataagtagttctgatgcagtcctacttatttaaaacttaaaatgtatttattacgtttgaccgaatttttggatttattgaattcttttaaagcttcacataagaaaaagggaataatatgttgcttttatattcatactttactgttttgaactatagggttctgcagaataaatatgtggttaccaaatactaggctttgcctatgaatgtctcatatagtctttccttcccttgtttctcttctctttttaaagttaaaggtgaattaaaatgaattttgtttggggaaattttaaggtggcctttgatattactggaaatgttttagtataatatcaaattagaattgggaatcactaatacgaattttaagtttgttgaaaattatattacatgcagatgttttttgaggactttgataatgaaagaaaaaagtgatttaca

SEQ ID NO: 471058 - DNA, 746 bp, Homo sapiens
agctccgtttctgtgttgtacatgctcttgctgatggcctccctgctcaattcccttcagtgccgaccctcagctgcaggtcttttggagtttgctggaagtccactccagaccctttttgcctgggtatcagcagcggaggctgcagaacagcaaatattgcagaacaacaaatgttgctgcctgatccttcctctgaaagctttacctgagaggggcacttggctgtatgaggtgtcagatggcctctactgggaggtgtctcccaggagggatgacacaagcacccctgtggccaccaccactgggactgtgctggatcagacccaaagccagcacagcactgggcctggcccaaggccggtaccaccacatatttttggatggattatcaagtgggagagtcaagcactccacagctggatggtttatggtcaaggaattttgattgaaaggctagcaactaggattctaaatcacagtggtccatagttctttttttaatatagaaatatagtatataataaaggtgacattttaaataattggtgaaaatatggatggtatagcaacatctaacattgatgtcatagtaacaataagacaaagctaaataacgtgaaatgtaaatgccacaaattgagtcaaaagaatatcatgacaatttgggaaaagttacttgcaaactatattacttgagaagtttctttttaaatatatagaatatcacacaagagcctctgtgg

SEQ ID NO: 471059 - DNA, 1484 bp, Homo sapiens
gacactgggcacagccatctgcagcatctctttcttcttgaagcatccttcttttgagctccaacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcttaactagaagtcagtagagaaaatgagttaaatggaataagggttggagtgtggaatggagacagagggaggtgaattagctaagtgtatgccacgaagtgccgtgtacttgctaggcgtaacctgggtaagtgtgtgaggatgcatcttttgtaagatctctgtaagttttgattcctgcctgcct

SEQ ID NO: 471060 - DNA, 607 bp, Homo sapiens
cctcctgtggcctttcctccgtgcatatgcctccccgttatctccttgagtgtctaaggagaagagagacagcaacaagcaatggaaaaatagatgttgatgggtatctcatagaaggttctgtgccctaccttttgatcaaagccccaaggacagaacgttggtggacagatcatagcagatgctttactgcaccttggcaaatgtctctctatgggtctaatgagctgcgtgaggctaagctagccaatggagattgttcacctaattctatctctgattttgtgatcagcaagcaggagtcagattatgttgtagcaaccaacatggacttttctacagccacctacctaagcacttgccttcgacagtgcctagcaccacagattcctgagccctctttgtctctgccagtaaaagaagcttctctgcagacaccaaagagcagtgcctctgccttcctgggtcaggtgctgctactactacgaaaaaagctgttatgaccatttccgattaagtcttgttggctatatgttttcatttctcttcggtaaatgcttagcagtgcaattgctaggtcatagaacaggtgtatatttaagcctca

SEQ ID NO: 471061 - DNA, 678 bp, Homo sapiens
agttaagactttggatagattttcttttttgccaattcagactcgaggtatgtttgagaactgggagaagttcagcacagctaggggcagagagctagggaaaggaatgaggcaagagatgtgcataggaccaaatcatctagagctttatagtcatattaattcctttgcattttattttaagggtgatgggaagggggaagacaacatatgtattaattttttagggctgccaaaatgccatggactggttggcttaaacaacagaaatttattttcccacagttctggaggctggaagtccaatatcaagatgttgcaggcttggtttctttggaggtctctctccttagcttgcagatggcctccctcttactgcctctttatatggtcttttctctgtgtgttcttctcacagtttgaattatttaagaacaaattcctagaactggtattattaaatcaccaggtatgaagtctatatagtaagtctaaattgtttttcacaaatattataccaatttgtaaggccattgactttgaccatacatttgcctacctagtattcattctcaccttcattaatcaaagacttttttttttttaagtgggaatgtgacttgttataaaagcctcatttcctcagactcccttgcatctaggtacgtccatatgacc

SEQ ID NO: 471062 - DNA, 695 bp, Homo sapiens
ccgtccgagttagagctgcaatctagtcattatggatctgatcaactctactgattacctgatcaatgcctctactttagtaagaaacagcactcagtttctagctcctgcatcaaaaatgattattgccctttctttgtacatttcatctataattggtaccatcaccaatggcctctatctatgggtgctaagattcaagatgaaacagactgtcaatactctcttattttttcatctcattctctcttattttatttcaacaatgattctgccatttatggccacctcccaacttcaagacaatcactggaactttggaactgccttgtgcaaggtcttcaatggcactttgtctctggggatgttcacctctgttttcttcctttcggccatcggtcttgatcgttaccttctcactcttcacccagtgtggtcccagcagcactgaaccccgcgctgggcttccagcattgtcctgggagtctggatttcagccgctgccctcagcatcccctatttgattttcagagagacacatcatgacctaaatgataccaaatgttgctgctgctgctgttgagcccaaaatatcagcaatttggctttactaaaactgctactgccgctgataccatttctgcattaggtcttgaaccactctgtgcctgaaagctctgacaacaggacagaaa

SEQ ID NO: 471063 - DNA, 3981 bp, Homo sapiens
cgtcttaagcttctgaagagacatctgggagcttccagaaactaaaggaaggactggaaatgctagggggggtcataatgagaggtgacaacgtgctggtggccctcgctcgctctcagcgcctcctcagcctctgcgtctgctctggccacgcttgaggagccctttagccctccgctgcactgtcggagcccctctctgggctggccgaggctggagccgactccctctgcttgcagggaggtgtggagggagaggtgtgggcgggaatccgggctgcgcacagctctggcggaccaatgcgagttccgggtgggcgtaggctcggcaggccccacactcagagcctccggccggcactgccagccctgggcagtgaggggcttagcacccgggccagtagctgcagacagggtgccgggtaccccagcactaatggcccacccgcgctgcactcgaattctcactgggtctcagctgcctccccgcagggcagggctcagacctgcagcccaccatgcctaagccccccctgccacccgcaccccgtagtgggctcccgtggggcccgagcctcccagaggggcgccgtcccttgctccgccgcacccggttccattgaccgcccaagggctgaggagtgcaggcgtgcactggagggttgtatatgcaccaatcggcactctgtgtctagctcggggctcgtggatgcaccaatcagcactctctaaaggattgtaaatacaccaatcagcactctgtttctagcttaaggtttgtaaacacaccaatcagcactctgtgtctagctcaaggtttgtaaacacaccaatcagcaccctgtgtctagctcaaggtttgtaaacgcaccaatcagcaccctgtgtctagctcaaggtttgtaaactcaccagtcggtgctctgtgtcaagttaatctggtgaggacttggagaacttttatgtctagctagaggattgtaaatgcaccaatcagcactctgtgtctagctcagggattgtaaatgcaccaatcagcaccctgtcaaaacggaacaatcagctctctgtaaaacggactaatcatctgtctgtaaaatggaccaatcagctctgtgtaaaatggaccaatcagcaggatatactttggaggccagaagacaatgcacttatgttttttaagtactaaaagaaaaaaaattgtcaaatcaaaattgcattataaaacctagtattataaaaataatgtgtaactgttttttctaaatggtttaaaagactgatacatttaaaaataaacaagtattagtctaaaagctgttacgataatcatgttttgcaactccatgctttattctctgtgtaatttaagacactgatgtgttagaaagttattagcttatgtttttggacagtgtataaaaatataagtttatgacattgacaatcaaaagggttggggatagagctgttagagaagtagtgtatgttattaaagttaatctgctataaattcaaattagagtgttataactttagggtgttatgtaatcccatggtaaccacaagaaaataactgaagaatgtatacaaaatgatatgagaaatttaaacatttcactacaaaatatcaactcaatacaaaagacagtaatgcaggaaatggacaaaaaagctataaggcatgtagaaaacaaatagcaaaataaaggaataagtctttccttatcaatgattattccaaatgtaagtggattaaattctccagtcaaaagacagagataggcagaatggaccaaaaaaaaaaaaaaaaaaaaaacatgatccaactatatactgtctctaaaagactcactttagattcaaagacacaaataggttaacagtgaaaggatggaaagggttgttctatgcaaatagtaacaaaaggagaatggtagtatctaaactaatattagaatgactaaaattaaacggactgattatatcaaatgttagcaaggatatagaggagctggaattctcatacattgtgtgggaatgtaaaatgatatgaacacttttgaaaatagttcactagtttcttaaaatgttaaatacacgtttaccttataatcctgtcattccagcaaagacttgcatacatatgttcatagcaactttgtaaataaccaaaaatggaaaatgcctaacaactgataaatgtataaacaatacaatacatattacaataaattaactattgatacacaatatttcaagaatgaatcttaaaataattatgcttagtgaaagtcagaaaaaatacatactgtatagtttcacttacgtaagattctagaaaatacaaactaatttataatgatagaaagtagatatgtggttgcccggggattgggtggggaatggggagaagttacaaaggagcacaaggaaatttgggggagtaatgtatatattcagtgtcttgattatacatggtgatggtttcataggtgcttacgtatgtcaaaacttatcaaattgtactattaaatatatatgacttattttaagtcaattatacatcaataacattgctagaaaaaatagaggagaagatttttagctcaaaataatctttatgccaaaatggtgtaatttggggtggcaaattttgctatccttcacaactcaacaagaaaaagacaaatgattcaatttaaaaatagacaaggggtttacatggacatttatccaaagaagatacacagattgtcagtcagcacatgaaaggatgctcaatgtcattaggcagtaggaaaatgcaaatcagaaccacaagagatcccataagacatataaccaatagatgtatatttttaaatccagaaaatagcaagtgttgatgaagatgtggagaaatgaggaccctcatgtatcaactactgggaatgtaaaaatggttcagacttgttgggaaacagtgtggtagtttcttcaagtgttaaacataggagttaccacatgacccaaccatccaaggaatctacccaagagaaatgagagtgtgtcttcacacagagacttgtgcacaaatgttcatagtagcattagtcataataatctcaaagtgaaaacaacccaaatgttcatcgactgataaatggataaacaaaatttagtatatctataaagtggaatactatttaacaatgaaaagtcatgaagtgctgatacatgcttcaacatggatgaatctctaaaacagtatattcagtgaaagaagacacaaaagatcacatattgtctgattctgcatatatgaaatgtctagaataggctaatctatggagaccaaaagagattgatggttgcctcacattgttagagagagatgggaattgactgcaaatgggcacaaaatttttttgtggggtgatcaaaatgttctaaaattatactgtggcaatttttgcacaaatacttaattgtaataactattattgccttctatatccaacatgggtgagttttatggtatgttaattacatctcaatgaaacttcttttgaaaaattgtttgcatcttttgtccatttgggtaagagtttccaggaaaagtaaatcatattgatgaagatggaggaataataaagtcttgttaatagagacagtagaatagtgaagtcatatttacatagacagtaacttattttgttatatatggtttcaattttcaaaataaatatgtatatatttatttttaatcataaacacatcagatcatgataactgcaatgcaagtattaaaatatgtaactgggaacaactacttaagagcgtcttccaacactaacttattcatttttttctttgtggttttctttctttcctgaacttcctaacttgttctttagttgacggtgtcatctccattatcctggggaaaactaaaattgttattgcaaaaataaatacaaattttaccattttaaaactt

SEQ ID NO: 471064 - DNA, 522 bp, Homo sapiens
aactaagacctacatctcctcaaacattctgagatggatagcagggattcaccatgccctacttcttagatgactgcttatttttcgccgagtctcatcacttctctgcattcaaagtcttttcaggtcatacaagaagtgtgatggatgccagcatctgcttcctgtggggcttcaagctgcttccactcatagtggaaggggtctgtcagctgcaggtctgttggagtttgctggaggtcccctacagaccctctttgcctggtatcaccagcggaggctcagttggaaatgcagaaatcacccatcttctgcgtcaatcacactgggagctgcagactggaactgttcttattcggccatcttataacatagccggaactgaaagaagtttaattgactcacagttctacatgattgggaggcctgataatcatggcagaaggccaaatgaggagcaaagtcacatcttacatggcagccagtaagagagagtgtgcaggggagctcccctttataaaa

SEQ ID NO: 471065 - DNA, 1477 bp, Homo sapiens
ttttgttttgttttggtgtctcccttttggaaagggagtactcacccaatgcctaaaaccccattcatgttaaatatgtcataccactctctcctggcctgtaaggattccaatgaagtctgctaccagacatattggagctccactgcagaggagcctctccctgtggccaccaccagcaacaacccacagagggttctgccaggcactgctgatgttcacttaatgcccaaagactcttctgtcatggcccagcctagtgccctgatgagaaaggctgatgatgtggggagtagcaatgggatgcccttgtgtggctgggatagaggaggagagcactgcgacttgaggaagctggtgaaacggcccatgcatttgaatcagagccagatctgctctccaacaggaacctcaacctatgcatttccagccccttctcagttctatttctggctggtggtgtttctcatgggtcatgagaggctaacaccaacacagcctcatctctgtgaggaactggaatgatgtaggtacagggaagaaaagaggtattcaaactacatcattttctgactgttttcttggttggcttcaaataccagctttacttgagcattggaaccttatgctagtaaaatattaccttctcagtccctctttttagatagactttgaccttcattcttcctttctttttattttctcatacattttcttatgagagcatataataactctcacgtgagtcctaacaaaatagataaagtaataaagtgttttaatatagagtaattatttagattgcacaaaaggaaaactttagctttgttgtctaaaagattagaacttgcaatctcaacataatttacaattatagctcatatgagctgattttatttcaatctttatgtcatctgcactattaattatcattgagttcttcataaaaacagcaatttgtgaatccaagatggcatcataatcatgcatatctcctcctggaaatttactcaagtgattgggcaaaaataaacttttcagtgatgttactgcttcatctgtatttaaaagattatttttatatgtctttgtccatgattgtgcttgcaaagaggagagtagcgcttaagtaatttatttagtatagacatactaactgaataattgggccttctggaatctactctggggcctaaaatatgtgactgaactgtctatactggctctattgcctagattactggatagggcttcctgaaaatattaattagaaatatgatacaatctatttatttgccaaatgccttgcccatttggactgctaagacaaactaccctagactggttgttttataaacaatagaaatttatttcccacagttctggagagtgggaagtccaagatcaaggtgtcaacagagtcagtgtctggtaagagtcagctttctggttcatagatgatcaccttttcactgtt

SEQ ID NO: 471066 - DNA, 651 bp, Homo sapiens
agaccaagatactaattaggtgatatagtgtatagattatggctatctgggattggttttctactcatttcatactttacatagaagatgagaattcatgtctttttagaagtttgctgcagtttactagaggtccacttcagaccctctttgcctgggtatcaccagtggaggctgcagaacagccaagattgctgcctgcttcttcctctggaagcttcgtcccagagggacaccaggctgatgccagctggagctctcctcagagcttgagcactatgctgggagaatactccttgtcaggatcagctgctctcttcagagccagcaggcaggaaagtttaagtctgctgaagctgtccccacagccgccccttcccccaggtgctctgtcccagggagatgggagttttatctataagcccctgactggcatttctttcagagatgccctgctgagtgacgaggaatccagagaggcagtccggccacagccactttgccacgctgtgttgagttctgcccagtccaaacttccaggcccccttagcactatcaggggaaaaccacctactcaagcctcagtaatggtggacgcccctcctcctaccaagctctatcattccaggttgacttcagactgctgagctg

SEQ ID NO: 471067 - DNA, 663 bp, Homo sapiens
tcaattaataaatgataagagttaatcaaggctcccttgacactgtgccagaagagtatggcagctcctctaggcagtgccccagtgggaactctgtgtggggccctcagccccacatttccccttgatactgcccaactagaggttctccatgagggaaccacccctgcagcaggcttctgcctggacaatggccatcttcttgtctttgcacatggtcctccttctgtgcacatctttctgtatgccctaaaatcctcttataaggacaccagtcagactggattagagcccacaactaatggcttcattttaacttcattaccccttcaaaggccctatctccaaatgtcatcacattctgagtctgttgatgaacataagcagataaaaatgtcctccaatagtgaagacaaccaaaatagttcaattttggttgaaattcagaaaaaacaaatatctgtaatgtcctcctccaatttgaagttagaagagcaataatatttcaccgtcttaaaagtaatgttaattctctagggcatctttagaattccttctcctgtttccttatcaattatttccaacaccctacataaatctttcatactattgataaatcatagtctaacaagaagttattcatactttttttaaaattcctgt

SEQ ID NO: 471068 - DNA, 1582 bp, Homo sapiens
cgacgagtcaagagacagcagtcagctaaatcctatcagggatgcgacaaaattgatactacatgaaaatggacgaatacagtaaattggtaccagtaaagtggggtggtgctgaaaatgtggaagcaactatggaactgggtacaggcagaggctggaatggtttggagggctcagaagaagacaggaaaatgtgggaaagtttggaacttcctagagacttgtcgaatggctttgatcaaaatgctgatagtgatatggacaataaagtccaggctgacgtggtctcggatggagatgaggaacttgttgggaactggaataaaggttttaaaagggaaacagagcataaaagttcagaaaatttgctgactgatgatgcaatagaaaataaaaacctattttctgagaagaaattcaagccagctgtagaaatttgcataagtaacggggagccaaatgttaattgccaagacaatggggaaaatgtcaccacagcgtgtcagagaccttctcagcagccccttgcatctcaggcccagggcagagccctcatggagaagctctgccagggcaaggtggaagggaaatgtgggattgaagccccacataaagtccttactggggcactgcctagtggagctgtgagaagagcaccactgtcctccagaccccagaatggtagatcttctgacggcttgcactgtgtgcctggaaaagccaaggacactcaactccagcctgtgaaagcagctggagggaggctgtaccctgcaaagccacagggccttccaaatagctagaactacaggcgatgccaatgtttggccagttcttttgtcaaactctcctcaagttatctagtttctatgtgctgaatatattgtgccgggaaagttgctgatacattattttcaagtttactttctctttatttctattggccaaatatatttttagcttttatttattttaaaccattctatgtcattttgtgtatatttctataaaacagcatttatagattttcctttttgtttattcaaattgaatgtttggtcttttaaatataaatggttctcagtccatttatatttatatgagctctgaaacatcttattcttaacatcttattttttgccttcttcttatttccctttctttaatgttgacttctatgaaattatcatgacattgctccttaaattttttaaagacatacccataaaatacataaagtatgattccatttgtataaatttgagaataggcaaagctcaactattctgcaggtatgcctactaaggtagtgtgactaaggaccataaaaacaaagatggtgggcaacaagctgcaagtcagggatatctgaatcttgctttgtttcctaatcagatataaccttcacctttaaagacatacatgttactattgagcagcgtgggagttagacataaattaggaaattacctgggtcctggttagacatctccagttattttaaaacatgatggattagcagagaggagagaattaaaatacttttttgttttctctgacaaactttatgtccatttctttt

SEQ ID NO: 471069 - DNA, 790 bp, Homo sapiens
cagcattccttcccccagggtgtggggcaggaccctctctggaatgaggatgatgtgacccacaattagaaagacaggggaagattagaggccgccttggggcagtctgagggacttcttccggggatggaagaggcttcaaggggtgtggtacggatgacttctcagctaggacggtcttcatgtttcttgggtccactcacagcccgatggccaagggaggacatggctgcccgccacggcagtatcttcagaggctccctgactcctgcgctctgggatctgcaccccaccatggggaaaccctttctgacctggtttgcccctcagtccctcgggctcatacctagtgcctgcggcaggacagccatggccgccaactccaccagcgacctccacactcccgggacgcagctgagcgtggctgacatcatcgtcatcactgtgtattttgctctgaacgtggccgtgggcatatgggctggcccagctgggagcggctggcaagagagcagtgagcacatccagaaaagatcagaaccagacagggaggatgctggagatgcatcccacagggagaagcagacagagcaagccaggcaggtgcagccctgcaaagatgtttagatggtgggcctgggagagtctggcgggggccggggggaggcctttaaggaagagatgttcctggaggaggggactttgagctgagcctttgcattcattaaagtatctgttaacaagtgactgaaaactgctttcaaatgagctctaagaatataggaaatgt

SEQ ID NO: 471070 - DNA, 730 bp, Homo sapiens
gtcatacagaagagtgtcccacgtcatatctgctgatatgttatggccaaagttgaacaagaggggctgtcaaatgatactgagaaaaatagtcatgaagatagaaggcaagtcagaggaatatcagagacccagaaagcaaggaaacagtttcaagaaggagagagtgaggggccaacggggccaaatggtactccaacattagcattttggttttccttgtcacgcttgttgctgcatcattataagatagctatggcacctatagatatcacaaatgctccaggctggaagaagaaagagagcccaccctctgcatctatacctcttttgatcaggactatttgtcagagacccctttcaacagattttgcttacatcccctatgaacatccaaagctacaaaggaagccaaaaaataagtatgcagttttgcagactcttagactagatcatgacaagaaagaagggaccaggaatggatgctgagtgagccaactgcagtttttacatagtatttttatgtacaaaattaaaagcatattttgtagagtgcatggattgaatgtagtgataaccaaactatgcaagaattgtgctttgcaggccctgtaaaaagcattttgtgacatctgaccattaaaagaagttaggagatgtacttgcaaactattcaggctctgatccctacattgcaggagtctgacactataaattgtacattttcata

SEQ ID NO: 471071 - DNA, 543 bp, Homo sapiens
agactatcactgtcatggatagtgattcctctgatggatctgggcaaagtaaagtgaaaagcttctggaaagtattcaccattctagatgccattaagaacatttgtgacttacgggaggaggtcaaaatatcaacattaacaggagtttggaagaagttgattccaacccttttggataactttgaggggttcaagactatagtggaggaggtcactgcagatgtggtaaatacaagagaactagaattaaaagtaaagcctgcagatgtgactgcattgccgcaatctcatgatcaaactttaaaggatgaaattgctgcagccactccaaccttcagcaaccacctccttgatcagtcagcagccatcaacattgaggcaagaccctccaccagcaaaatgattatgacttactgaaggttcagataatcattctcactttttggcaacaaagtatattttattaagactcgcagaaatgcatttggaaatatggccctcgagagtgggtggcccgtgggaaagggctgagcagagctgt

SEQ ID NO: 471072 - DNA, 555 bp, Homo sapiens
acacgcaggatgggctgcttctcaaagccaggtccctgtcccagccttaaggaccatgtctgcaatgtgacagaggaaaaatctccatttggaggaggcttgaacccgatgatctacctttctaataacagggagctggcatctatggccaacaccaactggcctgccccagcaatggacctggatacatcatactccactccaacctctggactcaaaagcctgcgagtcctttgtcccctggctagtcctcagtctgtaaagccaagcacccagaggcctttgccactagctttccgtgtagcttggaccttctgtgacctcactctcctgttgacctacagcaaaatagctgacgtcatgccaagcctcgcagacctaccagacctgatgacctgtgatctaccaatgccacaacatgactggaatgctcagacagttaccaaacaggaagataagccatgggtaattatttcaatagaaacttagagttgaagtgattgttcctgtaagagtctattaattagaattagattttgctgctaaactaaaaaa

SEQ ID NO: 471073 - DNA, 724 bp, Homo sapiens
ctttcgtgtcttccgttgtcccccagagtacagccagcttatgggtgaggaagaacatgggagcttcacctctggtctctggtcgtctggcaaggaggaagataagctcagcaggcaggccggtgctcaagcagcagaggctccagaggttggagctgtagttaaaagaaggcaaagaacatgcaaagcaggcatctctgcagcaatagctttcaaggaacgcaggtcaaatggcaggtccttttcccggaggcccctcccaccggccccgggcgtgtcattctgtcagccaccctcttctctttaccgggaaattcgatgcttctgtaccccaaagaggaacatgtcagacccacagatgacacgggccactggctactcttctggccgtcttctgtgctccatcttctcccgcaatattgactggctttgtttcccaattcatgtgggtgaaaatggccacctccgactgctattgaattttctcttccagtcccatttccaaaattcctagggaaaagttcagtctggcttgagggatgcccatcctcagaacaaaaactaggactaggaagagagacaaaaaccatgcggatggcagaggagaaaagcatttcctattaaacccagtggaaaaccgtttcagaagagaataaaagggaggcatcaccggcttcccctcctttctttcatttgtcactgtcaccaacaactttactgtcag

SEQ ID NO: 471074 - DNA, 489 bp, Homo sapiens
gacatcattcttgtgcttcgacctgggcgcagagcagtccctggactcgggtcaggagagctatgtggcttcagcacattgtgtactgtaaccaggtgagtttctccaaatccacggatgcttttgcctttgaagaggacagcagcagcgatgggctttctccggatcagactcgaagtgaagacccccaaaactcagcgggatccccgccagacgctaaagcctcagataccccttcgacaggttctctggggacaaaccagagaatgcagagatgtccctggctgccacagcattttgatgcctcttctcactctattcagcgcaggcctctgtgtggggtgacaaaagctccagaaaacactgaaagagaacctccagaactacaccctttaacttatccattaagcatctgctctgccaagcagataccttttatctccatttttatggacaaactagctaagactcagtgagattggatgactc

SEQ ID NO: 471075 - DNA, 666 bp, Homo sapiens
ctcccgttctctctccttggcttacggatggccatgttcatgtccacatggcattctccctgtatctccgcatcattttctctctatggtggtggaaatggagagacaaaggtaggtttgaaacatgttaatagaatggaaaatacgggacttgatcattggatgtggatggtaaaggagagagaggttctggatttggaggaggaagagctcaattttgagtgtatgttagtgccattcacagaagtaaagaccaggatgaggaagagttacttgataggaaaaataatgaatttgatttttgatcagttggtgtctgagggacactcaagccaaaagtcttcactagagaggtctggagctcagagtgccttcaatggagatatagatatgaaaggggtcagcattcagatgttaactgaaatcatgagaatagctatgacctatacagtatgtggagtgagaataaaagaggatcctgaggaatgccaacatttaagaacagttggaacagaggacagtcgcacagctagggtggagggaggggaagaccgggaagaactgctggaatatccagacagaaggccagagtgatggccacaaaagtggaggaagctggctgggcatggtggctcatgcctgtggcaaaaattaagttttaggcaa

SEQ ID NO: 471076 - DNA, 548 bp, Homo sapiens
tggcacactcctacctttcctgtctccatgctgcccgctctggatagaatacccttcctcatcttgccatcctggaaatctctcaattttttcaaaatcctaatccaagaccttgttcatctttctgtacaccaaggtcttagtacagcatctagaaccctagaagagtgtctagaaactcgtgtgtgtgtgtgtgtgagtgtactgaatgaatcaatgaatgaatgtctgtgtggagaaagccagagggtatttcagacagggtcccaaagtatgtgtcccttggtcagatcaccagatcttggggatcgcaggaactgccccagctttgtagaagcattgcaatttcatttcatccttttggaggctgaccaccattcagagaagctcagcctaactactgaatgtggacagtctacatggatggagaggcaatgggaaatgaaccaaagcacccccagcagggccagtacccaggacccacacctcaagtccagagacacttttctgtttcagactctctgaactatccttttggagtttgtaac

SEQ ID NO: 471077 - DNA, 656 bp, Homo sapiens
aggttcattggctgggacgcctgtgacaaaagacagattaacaagagaaaggttatcaaaaaatgaccaggaagggtatggtaacctagggttgtttaataggtcttgtgatgccgattttagcctggccttcttcattgaaatttctgcataaaccactccttaatctgcatgcaattaaaggtaggtataaatatgactgcaaaactgccctgagctgctaccctgactgtggggtagccctgctctgcaggagcagtcacggagctgtaacactgccagagttatgtgtgacagaacttctcaagccacgaattgtggcagtaaccaggctgtgggactggtggatcggggaacatgaattcttctctgtgaccctgcgtcttcagagagaagaaagttcctttcctctgggcatagaaagagcccccgtggaacgagaatcctgggacctgattcaggggagaagggcagaagaagattcggtttccccatctgtaaacggagataatgatgagctcacttcatacttttacttcattgttgccagggctaagggagtgaagctggcaatagataaatggtgcctgataccatacaccttgcggggccatacaaaaggacacagcactctgtcctcctagattgttaacttt

SEQ ID NO: 471078 - DNA, 633 bp, Homo sapiens
ggagtcatagacaacattaactcctcctactacgtttggccacatgcagggagtattgtcagccagggaagtccaggcaggtccttggtgtccacagtttgtattgaggcccaagcccatattgcctgcatggctgactgttatggttaatactgagtgtcaacttgattggattaaaggatgcgaagtattgttcctgggcgtgtctgtctgccagtacggccacaataaaagcaggcaggaaaatgtggaaagactagactggtttagtcttctggcttatatctttctgccatgttggatgcttgctgccctcgaacatcagactcccagttcttcagctttgggactcggactggctttgttgctcctcagctttcagacggcttattgtgggacctcaccttgtgatcatggctacagatcatcttcagtagcaaagaagaaaggccagaacttactttagacagtgttgcttcttcagtataccaaagggtataaaaactgccagaatatggaaaggtcagctaaaatctgggttcttgtctcacgaccaggaaaaattaggcacatggacacattaaaaggtgaggagaagggaatttattaaaagaaagctttcagtgaaaaaaa

SEQ ID NO: 471079 - DNA, 707 bp, Homo sapiens
agtccagttattatgatcaggggcaggggcactgagacagctcatgaagcaaagtttctccagaattgctgtattgctgtttccaaggtcaccagaagctgggaatctggctctgcctctgaatcacttaaaatccagcttcctggtccctactccagaactaccagatcaaaggattatcggagcagggcctgaaaatacctattttccaaaaaaactctcccatgggttcttagataaccagtccagaaattggcattttggaaaagcaaagaaagtgttcccattagaccgaagtttcaccttgttcatttcactgaaggaaatgcagtgtgttaagtctccagccctgttccttgccgaccttaaaccctcggtacaggagaattgccttcccattctctgtgaatccagtggacactcagaaaacatgaacagtctgcagctgcttcaagaacaagatccgggaatataaatatgcaatatacttcatatagttgcacatttttatatttctgaattttggattatttcaatggactgccttaggcttagtattttaaatgggaaatctccaaacatgtttattgagtacagattatagaagtgacacatgattaacctcctttatttaaaatgtatatgtgaagaatgataagagaaaggtacaaatctcccgattttatatcaaaataatatttttgcca

SEQ ID NO: 471080 - DNA, 748 bp, Homo sapiens
caagtctctgcttagatacctatgaataacaagaaactgattactttcctagaagacagagcaagatcctgtgaagaagaagaagaggaagaagaagaaggagaaggagaaggagaaggagaaggggaagaaggagaaggagaaggagaaggggaagaaggagaaggagaaggggaagaagaaggggaagaggaagaggaggaggaggaggcacctgggagacagagcaagatcctgtctcaaaaaacagaagaagaggaagaaggagaaggagaaggaggaggaggagaaggaagaggagaaagaggaggaggaggagaagaagaagaagaagaagaagaagaagaagaaggaggaggaggaggaggaggaggaggaggagaagaagaagaagaagaagaagaaggaagaggagaaagaggaggaggaggagaagaagaagaagaagaagaagaaggaggaggaggaggaggaggaggagaaggagaagaaaaagatcttacagattatctagccacctcattgtatttttatgttcttaaactttaacgaagcttaatttttttcttcatctttatgcttccagtgttatagttaagaatgaattgtctaaaccaagttcataagattttgttctagaatttttatagttcagctctttacacttaggtatatgattcattttgagtaaatgtatatttatggtgtaaggtgagctactcagaagtcagagcattcaccaataaac

SEQ ID NO: 471081 - DNA, 516 bp, Homo sapiens
cagcacagcacgctttggtagtttgatctactgctttgtggtttatcacatctaacatgttcctaaaagtgagcgatttccaggcacaattttcagcatcagctctagcactgcgacatagtgaatatgtggatgactttgttaaagaagatatttttcaggttacactaacaggcaagggttatcacctggagcgtgctctccaaaatgacttagcaggattcttgctgaaactggggaatggacaaggatggagcctgaaaccgaaagtcaaagcccagttaagaagaggacttagaggagcgttactaaagtttggattcttgctgaaactgggggatggacaaggatggactgtgaaacccaaagtcaaagtccagttaagaagaggacttagaggatttttactaaagtttggtcagggagacagtctccatcaaaatccaccattcactgtgcttggcaagcacaatcctccattagcttctgctggaaggtatgctttatgagggaaat

SEQ ID NO: 471082 - DNA, 843 bp, Homo sapiens
gacaaccagtgaagagctttttagattctgatgccgccccccagcaagttggatagtgcctgcccacactgagggtggatctttccaacctagtccactcagactcacatgctaatctcctctgaaaacatccttacagaaagaacccaaaataatgccttccctagagggtttggtttaaaagatgcaagtaaatcgagtcaggctcagaggttcaactctaggactttgctgcaactactgaaaaagaagtgctcttctccctgggctgctggactggcagggtgtaaacctgagctgctggttatcatgttttcctctctgattgaatcaacacaggaatgcggaggcaaagatgatggaaaatattgcattatctgcaaaatcacagaaggcttggtgcacagttgggtaactgaaaacgaagtagacagtggctaccaagaagagaagttttattttctgtgtcccatgcggtttttattccagggtgatgcaaccctttcccctaccctctcacccacagtgtgccctcgtgtggcccggaagtggaaaaaccctcagacattctggtcctcacgggccaagctggccagagctccaatcccttatcacagtgaccaaactacatagagaaaaagaggcatgaaaacaaggactcttacaagacttgccaaatgttaggctgaacaagtgaaatagccatttttatgggttacaaaacagttagacatcaggccttaatcccatttacaaggcaggcaccctcatgacctaaccacctcttaaaggcctcaccttttaacactatcacattggcaatacctgaattttagaggggac

SEQ ID NO: 471083 - DNA, 1203 bp, Homo sapiens
ttcctccacagataaatagttccagtatgactgtgatgtgtctagaagagctgccggagtatgtaaaaactcttgcagctcagtgcctgcctgaacagctgctgactggagcagctgccatgggtcttcccagttttgtgctagggatccaaggccctggtagtgtaggcacacgagggaatcttctgatccacagattgcaaaaatctgtggggagtgtagaaccctgggcagggacatggatgaagctggaaaccatcattctcagcaaactaagaggaacagaaaaccaaacactgcatgttctcattcgtaagtgggagttgaacaatgagaatacatggacacagggaggggagcatcacatgctggggcctgtccaggggatcccattgtatggatataccattgattatttacctgttggaggacatcgtagccacttctaaggttttagtggttatgaataaaactgctataaaaatcctatacttttctaggtgaacatacattttcaaaacagttgggcaaatacctaggatcagtaaattatgataatactatatttagctttgtaaaaaactgccaagccattttccaaagtggctgtaccattttgcattctcaccagaaatgaatgagtttccaaatgaagtttcctccaaatgctcaccagcaatggttattgtcatgttttaaaaaaaattagacattttaattaaagtattatatcactgttgttttaatttgtattctcctaatggcaaataatgttgatcatcttttgctacttctgcttgctcttggtgtccatttgcatgaaatatctttttccacccctttatcttaagtttatgtgagtctttatgtgttagaagctgtgattattttttatttatgctctctatttcactgaagatttttacctttatatcttctatcttttttttatttcattaaattggactttacctttctctggtggcttctttattagcttaataatcaaccttctgaattcttttcctggcaattcagagacttctccttgatttggatccattgctggtgagctagtgtgatcttctgggggtggtaaagcaacttatttcatcatattaccagaattatttttctggtttcttctcatttgggtagactatatcagagggaagatctgggactcaaggcctgatgttcata

SEQ ID NO: 471084 - DNA, 603 bp, Homo sapiens
cccacaaccccaggcatgtatacaggatccacactcctgcccacaaacaccagtttcgatctgcatttccttcatgattggtgaggttgagcatcgtttttggtgcggcccatccggatttcacatgaaggatgttctaagaaggaactggaagactggtgtggcccactcagcaggaagaccagcttggtggcaacagagattggtgagagtggcaggaggaggtcatgatgtaaataccagcagaggcgtgggaaagtggtcagagaaagcctcaggtggagtcacagatgttgatgtccagagtcaggagattgcaatggctggtgctgactggatgtgctggaaccagcagtgctcatcctaccaagcacaacgtcgctgtgcaccacagttcctcagacctgagactaagggtgagcaggagaagcctgcagaaaataagagatttagacacgactggctccccacatattgggtgggctagaagtcttccctccagactgaggatggataaatcagatgagataaatcagaagatatggggtgggtgttggtgcttttatattaaaagaattagcaacactactcagatgattttaa

SEQ ID NO: 471085 - DNA, 2112 bp, Homo sapiens
gcagtattttccgcctgaaatttctccgattctaggctcgggatgggaggctccgcagctgctccagcctgcggccagctccgcctccccaacagccaccctctggggccgagctcctctataccctctgcggcaccgcaaagcaggcatttcctggggcagcctgaaccggtggcccagagccccagttcctgccaccggaatccggaccttcctcccgctcccctcgccagcgaggcggcccctcggggggcggtcggcgccgcagcggctccgatgcccgcccggaagggagcgctctggccccggcctcgcagctgcgggacagccgggagcggagcagagggcagccgcggccagttgtctccccagcggactgggaagggaactttatctcggcctggactcccgctgtacctttgttgggggttagtggtgaggctgcggtcgtccgagctcctgggtgtcgcgggcgccgcgatcccctcttcccgtagaagggcccagggcgctgctcgaggcgcgggaacccctggccagaggcgggcactggcgcagccccgcggctgctgctggccaagccgactgcagggatgagaaattccttgtaagagtggctggaaggctccgcggagagggaagaaactcttcccagagcgagctcccactgctccttgggaatggtgcactttccagttccagttggaccctctgggattgtcacaggaagcgctgccatgtatgaggagccctctgcaaactacagaaggatggatgctcttagcttataaataagattttgacgccctggttggtttgatgacttgtgtcatgaggagtaggggtgtgcgctgattccaaattcttccacgcggcatcctgctccggagcctcccttgtctcctagagaaagggacagggaatcgaaggatggggagtctgagggagaggcccctattccgcacgctgtctcctggctggctcctgaagggctggctgcttcccccacctggaagtccaggcccctgttcggaagtcctctccgcacagcctgacagtcccttggttctcttatgattgctctcctcccgcttcaggcctaggatggcaaggacagctcccacttaccagagccaaggcactacgccgttcctgggtgtcctcttctcctccagctcctttgtaagtcccatgctcctctatttacctagtggagggtgtcatgccaggaccctggcatatgatacaccagagctgcattgcttttccgaatctgctcaagctgtacaacatttctgagcctcagtaccaccagccatctgtggtcctccatttgtcctcttctcctacaaatacctccagcccctctcttccttcatgatgcttctagcattggaaatcctccaggacaattctgccttcaagtttcctagcctgagccactgagttgatggaggaaaatgtgatagagatgactcgtcctcctttaattttcccacttctataagcatataaacgtgccctgcaactctcctaagtgtccccagaagacccgctttcccagtctctgagacaaacatttcttagccttctctcctgcaagagataacatttctcaaagtttctttgagcatgtagatgctgacaggggatgatctatcccttccaccaccaaacctccacaccagttggcactccacccttgttatagtggaggaagctgcaggctagttccagcacagtgaaccccagtagtgtttcgcttctcagcctttgccatctcctcatccctgagccatctccctgtggcagacactgatgggccaccagcactgcatcagtgaaggacttgctgccccagctgctggcgtgctgtcagcacagcctcctgcagtccgcctctccacgattgcggaaagcatctaggctgaagggtgcaggtgctgtatgcattggtttatatgcttcctgtacatttcctcaggaacccaacctgcacccgtccttctctaaagtatggttaccatcagcatccagacatactcctttttttttttttttttttttttttgcttctcttcatagcaaaatatatgaacagtttttaccttt

SEQ ID NO: 471086 - DNA, 535 bp, Homo sapiens
caccagcagagccttttagcatgaactttgagtattggactggtatctttgcgacttcacaaaactgtgccgactcatcatttcaatgcttaataaaatataaaggcagatcccatgtgtatgtattgcaggcagagtgtttgggtgggcctaagtgttatgctaacctcccagatggccgaaatctagaaaacctggaagagtccatgtcctctctcccccattcactgacccctaacacagatcatgtcaaccaggcttttgaccagcagaacaaccaacccgtggctggtggacagctgctgggctgtgccaaggctcttaatctgggcccacagttgctctggattaaagaagaaaaccaaaagtgggaatataaggtggacccaggaattgtcctaagaaatgtaccccaaatgactatggacctgatccacagctttctcacagcttttaaaaaaagaaaaccttaattacacaaatcacaaaaacaagctgtttgctgaaagggaaccatgactgttcttggtattaa

SEQ ID NO: 471087 - DNA, 967 bp, Homo sapiens
ctgtacctccctggatgaccttgctccccagggaagagccttgggtgaggaccacctcctccggagccctgggctcctcctcccaggtggagccagcttttggcccttggagtggagtacaggatcctgggccttggttactgagtttagggatagcttggcctctctggggcagggccaacaactcagttccagaaaatccattaagcagcccaagcatgtgcttagagcacggcaaagagaaagggaacacacacagcggcaagccagtgaggagtaagccatacccttccttgagtatggaaggaaatcctgatgctgcttgcaggatcccctcttggtcccaatctcttaagaacacagatacgacacaccgagtctattggcactcagccttccacaccagggaaccaagtcatctgggcaaacttccacacttcaaaactcagcccaaccaagtccagccgatgacaaccatttctccaacattaggaggtgttgccggcgatgctctggcacctcctgaaaaactcaggggcccagagtctgaggagtatgaagaaacagggcagccccagggaagacgaggggggcccatgaaacaaagcaagtcggcatgaccaagttgaaacgtcgcttcattttccaagcttgcagcaaatatccgttactatcgccaaaggaggagaagctaaatgcaagtttgggaggttataaggaaggtaattttcttatctgattcttctctcaagaagataattctggtaatatggagcttgaatgcaaaggaacagatgctggcaccaggctttctgtacactctgtagaactgtgagccaatttttattggctcttttatttataaattatctagcctcaggtattcctttatagcaatgcacaatcagactaatacagaaagttagtactgaggggtggggtgttgctgtaaagatacctgaagatg

SEQ ID NO: 471088 - DNA, 798 bp, Homo sapiens
tggctttctgttccctgagtgcccgggtctcccacttctgctaatgtggtttcccctgagtagaatggctgttagcctggcttcctcccacttctctttggggactcagccaaaatgtcacttcccccttctccaggcccagtttggttggccagaccccctgctgcatcatagaacctatcacattgggttatacctcaattgtccacgttgcctgctagtctacaagctctgcaatggtgaatcatgtggttataacattcatgtggagtgttggatgttctattgtgagaaggcgatgcatggaaccaaggcagccatctttttatcatggggtgaaaatctgaggatgaaaagtgaatatgcgaaggatgcagagtggaaggaaaggaagaactacatccttgaggacacgtgggagccagtgggccaatcccaggattccttgtcagacctagaggaaggcacatatccaaaatccctgccttgagtccttaactctgaaaaagtcttagtgatgagttctaccccttcctgccggtgaagggtaacaatccctccatttttggtgactctctactctgcctaaccttaagtttttctaagaactgaccgttaccttgtgatggaggaggaggaggaggaggcagtagtgatttgccaacatctttgaacctttcctgggtgacctgccatcaaggaatatttcctggactgcttgtggaaagcacatttcagggtgctagtaccatcttgtggagatggttaaataaattacgaatagaacagagaacatcc

SEQ ID NO: 471089 - DNA, 2663 bp, Homo sapiens
gcggcatagaagagaatatgttttgaatgtttgcgctttgggatttctggatttcattaaggaaatatggggagtcagaagtgctggttcctgaaagggcctgagaaagcaagaaggtggaagatgtcaatggaattgggaaataaaattgtgggctacatgccctttatgagtgggctaggaactctgctccacgtcatcacctacactgggccccagctgatggagcaactgccacagggaactttggcggtggccctggaggctgaagaagagggcacttggcctacagacttatttcttcttggacacacctacggtgcggccacagcggccagtggtcttggtgtgctggcctcggacacgaaggccccagaagtgactcagccctctatgggcccgaatattcttcagtcgctccaggtcttcacggagctcgttgtccagaccgttggccaggacctggttatattttccatcctttacatccttctgtctgttcaaaaaccagtcggggatcttgtactggcgtggattctgcataatggtgaccacacgttccacctcatcctcaatgagctctcccgccctcttggtgaggtcaatgtctgctttcctcaataccacatgagcatatcttcggcccacacccttaatggcagtgatggcaaaggctattttccaccgcccatcgatgttggtgttgagtactcgcaaaatatgctggaacttttcagggatcactagagacatggcagcagcacaagcggcggcgtgtaggcctcctgtggaagaatcttttcaataattttttaatctcatctaatgtttacatatgcaatcattctcatttcctgttcttctaattttctgtttttaaccctataattttgaaagtaagatttgctgaatttttttcatctcatataaaagtcttttatttcaatatgagtgtttaagtcattgttacgtagtgctataaatgccgtaattttcttgttattttatttcgtgctttcagttttttatgtttctctttctatgttacttctttcctatgtactttttttcctagtgtaattgcttttcaaagaaaaattttgcaaattaattatttgaagagatgttaatggatgctctggcaaaaaaaatcacaacactttctatgactacacaagacagggaaatatttgggcattgttttggggatccacaatgattattaaaatggttgtgtttctaagagtatcagcagctaggcaatctctttgactatgtttaatcagagttcacaatcttatttgaacacagaacacatttttcattatacctccagcaatattctacaaaatcgtagttgtgggatactggtttgggaaatgctcttctagtgattaggaattcatagaacctactttattgtataattgttcaccttgaactgttctaataatactcattgaacctatttttccaaccccacttttgagctgatctcctgttttttgtgtcccttcgactaaactcttcaactaggcatatgtacatatatatgtactgagttgttttttaagaggtattttctactgtgagttatttaaagacagtttgaaatacactctactgacagtaattatctaagatgaacttgatgagtcatatgctttcttcatatttaacttcattaggtatggcaaaatttcctccatagttggcagtatcaacttacactctcatcatctgaatttgagagcctggatcttctctaaaattcggatggatcatctttttccatgctaaagggcgtaaaacactacaccatttccattttcatttccctgattgctagtgaaggtgagtaacttctcaccactctgctggtcattgagtctcctattcattgatttgtttatagtttttgccaacttttgcaattttttgttcatttctgattgacttataggagtttaaaaatatattccagatactccatgagttatatccactgctaatctttttcaagtctgttgtattaagatatacaaggttttatgatggcttgcagttcagaaactttaaaatttaatgtgaacaaatttgtcaatcttttctttataagcacaacttataagttgtgctttttgagtcatgtttaagaaattcttccccattccaagttcataaaaacatacttctatacattattctaaaagttttaaagttttgcttttcagatttatctttattctacctggagaggatgttttgtgtgttgtgtgaggcagggatatgcttttttcaaaatgaataaccaattttctcaatgccatttattgaataatttattatttatgcaattataaagtgacttttctcatacaccatgttcccaggtaaaggtaggtctgtttgtcatacaaagcctggtgccttacatatttgaccatacttattgttagactttttctaactccttgaaatagtttagagaaaataattttgcagagaactgtggccttgtactaatatttgagggtttaaattagcaagaaacaggaaatgtaggttacatgtattaaataaacagtaaaagataatagtgccttttatacagaaggtattttgttatgaattagtaataaagatgtaaatatgatggttaa

SEQ ID NO: 471090 - DNA, 522 bp, Homo sapiens
ggcctggagctgccaaccctgctgcagcagccagagtacctggctgtgcgcaatggctggaccctgtgctcactcgctcacaaccccttgctgctctctgcctggcttgcccttggcaggtttggatatcttggcaaccattgatgggaagcgtgccaaggcccaggcacccgggctagaagcttactctgcaactcctggcagacacctttactcctacgcgagagatctgaaatctaccacgtggctgcactggacccgctctcaacctattccccttttgggcaaagagaggggagaatgggcccactgtgttttagaggctgctccccaggcctctatttgcgtgctgcctacatgcctccagtcatttctatccccccaaacaaccacaaccctgctcaagctggcacataaacttgcatcgtgtttccaagaaacagctgagaaggcttggaaagggctccctcctctctcatgagggttagggatagagaccatttccattttacagacaagaac

SEQ ID NO: 471091 - DNA, 597 bp, Homo sapiens
gcggagacctctcccctgaggttatagaccatttctgcatttctcactgagctgtctactgattactcatgggcgttctaagttcttatttatttgtgggctcgtttgctcagcattatctctacaaccagattctaagctttgcaaaggaagagatcataccttattctgtatcccagatacttagaaagtttatggaagttccaaacttttcccacatcttcttgtcttctgagccctccaagtctctaggaagttccaaactttcccacattttcctgtcttcttctgagctctccaaactgttccaacctctgcctgttaccaaagttgtttccacattttttgggtatccttatagcagcaccccactctaccagtaccaatttactgtattagtccattctcatgctgctatgaagaaatatctgaaactggattcaattacctccaaccaggtccctcccacaacatgtggcgattataggaactacaattcaagatgagatttgggtggggacacggccaaaccatatcagcagggtgacacaggcttaaactgagacaatccagcatggaacacttgcaggaagtact

SEQ ID NO: 471092 - DNA, 769 bp, Homo sapiens
tccttaagggtcttgcctcctcagaggaaaaattcagctaaggggcagaatccccgaagtccattgtatcattcttatgcctttgcgtcctcatagcttagctctcacctatcaactttttgatgcacctaacaccggagctcccaaatttataaaacaattactaatagacctaagaaatgagatagacagcaacaccataatagtggaggacttcaatactccactgacagcattagacaggtcatctagacagaaagtcaacaaagaagcaatggatttaaactatgttcaggaacaaatggacttaacagatacatacagaacatttcatccaacaactgcagaatacacattctattcaacaatgcatggaactttctccaagatagaccatatgataggccataaaatgagcctcaataaatttaagaaaattgaaattatattaagcactctctcagagcacagtggaataaaactggaaatgaatgccaaaaggaaccttcaaaaccacacaaatacatggaaattaaataacctgctcctgaatcagcattgagtcaaaaaatgaaataaagatggaaattttaaaattcttcaaactgaatgaaaataatgacacaacctatcagaacctctgggatacagctaaggcagtgctaagaggaaaattcatagccctaaacacctacatcaaaaagtcagcagcaaagtacccttgaagagggtctagcaggcaactggagagatccaagtgccttattca

SEQ ID NO: 471093 - DNA, 893 bp, Homo sapiens
cattacagctgccatcacggttcatgggtgatccaccgactgcttcaaaacagctgtggtcaagaggctgtatcaaaatgtcaaccatggcccttgtcattccttctctccagatgatccagttgcatgctgatgtagagaaccagcactgcagtgcagagcagagcttcccaaactgtagcaccaccccatccagtcctgacccttacaggaagttaacccatcgagtggcctttggaggactagactggttaaatgatgatgaccgtgatgatgatgatgatgattccttgagcactatctcctcctctatgtctttggcgttaggaagagtggataaaaaagacacatctccacctggagaggaagcgagaagcaagaagaatcagctgctcacctctgattttctctgttccaggtctaatgggaccatcattcgggaaggatttccttcccactcccctcctgctacagtgatggctcctcttgaagctggacggtaaaatcagctgaatggaagctaaactccagtgggcttggccagtctctaggttaatcctagtcttagccttacagccccactgtattataaagcagtcataagaacaaaagcttggtattttactcattctttcaacaaatatgtataaaaccttgctgcaagcctggttatggctaagacactcttcagccatctaatctgtttctatttttatattagtaacctttgataggttttcagacagtcccagatgactgagtgttgggaccctttgtcctgggtcagggggattgcagcctaatgtttcagtgctgtgtctcctccctcacccagtaggtagttttagagctactagattctgacagcttgtgtcaagtcccgtttattgctc

SEQ ID NO: 471094 - DNA, 631 bp, Homo sapiens
atattatgctgtctttaggcacctatgctgggggaggtacccccctaggctctggagaggaggtatgagtgaaggggtactgctcagggagccctgggtgtctctgtccatgcaccctaagccgttgggcttagactatcagctgatgggaaaggtggctaaagaggatattgcaaagaacccacagcaactgcagcctgactgttgctctgggctgctgtctgctgacaacagaagtgaatggcagaacctgggcaccaccacccaactgggcggagaaggaagccgtatagcagtgaaattgagtctgaaagggagtgatacatgtgtgtgcttaggaaacactgacttgacagtttactgtgagaacgtggaattcccagcctcagccccaacccctgggcagcctgcaggcattctagaacagtctgtctacctctctcaaagaataactatgaagcagctcctcagggtccagggaatttgtccaccatcgtttatataataactgccagtgcagagatcctgaaaaaaagtctctgttctttctatgatgtacgaacttccttaagaaaataaacctgtacttcaaaatttatattccaaggcttgaaaacaaaagcacattgcc

SEQ ID NO: 471095 - DNA, 817 bp, Homo sapiens
atggaccttcaagatgcttacacaacagccaggaagaaaggaccaaaacctaccctgcagagcacttacaatatgccactccctgctgtataatgggggggatgggaagaagatgtccccaagccccctggtcccccgtagaagggatgaggggaagatccacaaaatcacacagaaatacagagactctgcacaaggcatcccccattctaaatctcctgtgtttcacaaggcatcttggtgtcattctgtgtatcagactgtgctggcttttctccatttacccaatggatccatttaccccgtggatccattctctttctttctgctccctggaagactgattccgatggattgcatcacttgggctcccctcacctctgactttccactggatttgaccgatgggagccataagcaagagacaggagagtggacctccccaagaagtgaggaagatccgaaggatgggacaggaggagaggagatgggaaatcattccaggcagtggggccacaaaaacaaagcatgtggcaggaagaaacgtggggcatcccaggacctggcaggagatcggagcagcacaaggagaatgccagaaaaaaaattaagtaaggcagacactgagtcaaaactgacatgggaaaagagcatcctggcttcagtgcagaaaatggattcaagcaggaaaaaagtggagacagtggaaccttagaaagcttatttgggctaatatatttttatctcttactatgcattagagactgttctaaattctttttagcatcgtgatggctcatttcatatgctagcttga

SEQ ID NO: 471096 - DNA, 737 bp, Homo sapiens
ttggagacaattattctaagtgaagtactctggaatggaaaaccaaacatcgtatgttctcactcacaagtaggagctaagctatggggatgcaaaggcataagaatgatacaatggactttgggtacttgagggcaagagtgggaggcggagctattttaaatcctgcactagaagactgcctgaaagagttccacagagtaaatgttgtgcagagaggacaaccagaaatccaggggctgagggtgtcccccagagggacagccaaaagagacgtccagggtttgaagttagcaaggccccacagcagcagcatctctgcagagccacagatgccctctttggagcaagagccagcttttgtccttctcaggacgagagcaaagccatcttgtgacaatatcagtcaagcgagaaatcacagtacttctctcttcctctcttcctgtgttccagccctggaaggaacgaatgctaaagttagcaggatgctggtagagatcaaccagaaagaaagaaaaagttgactacaaccttcctcccaggcagcaggtggtcgagtcgactgaagccattcttagaaaagagggtggggggaggcgggaaagacaatgctaagtcaggaattggttcatacaattatggaggctggcaagtccaaatgtgcagggtggtccatcaaactggacacctaggggagagctaatgctatggttcaagtctaaacgatgtctgcc

SEQ ID NO: 471097 - DNA, 690 bp, Homo sapiens
gaaacggtttgaggatgaagagactggacagatggatggaggaccatgaggtgacccaaccaggggcaagaaggaagagaatcggctgcttctctgtggcttcactcctgaagtcagcaagaccacgaacccactggaaggaagaaactccagacacatctgaacatctgaaggaacaaactccggacacaccatctttaagagctgtaacactcaccacgagggtccgcggcttcattcttgaagtcattgagacaaagaacccaccagaaggaataaattctggacacaagagtgcaggaagaactgccatttataaaaccatcaggtctccatccgggaaatttcagaaagagaatgattcttatttgaaatcgaaaggaattcagccacattgggacaagggacagaaagcaacaaattcagctgtttcccagcaagttgccagcaccaactcttcagccatgtatgtgaaaccatgttggaagtggatcctcttgcccctactcagacctcctcagctgatgccacatggaatgcaggtgaactgtgtgtacattttcaagggattctgtagcaaagaaacacaaattaggtgactaaaacaacagaaactttttcttttacagttctggaggcgagaagtctgaaatcaaggtattagcaaggccgtattcccgttaaggcttt

SEQ ID NO: 471098 - DNA, 698 bp, Homo sapiens
tctggtttacacaagtgtgctagtgaaaactcaatgagcacactatgatttgtgtacatttctattttgtcaaagagaaagccaaacagactcgcaagaagttggcttctgccaaagggttcctcaggagtgcagacagacaagcagcaaggctcctggatctgagaactgcccttttccaccaatgtcaaacacgtttcacagctgacctgccaagaatgtggatcctgcttcaagatacacagtctgagacagcacgcagcagccgaaagagggaatctccgttccctctgatacaatgtgatgagaagggcgcttcacgtctatggctgcgttcccaaaaatccataacccggatcgaattaggagaaaaatacaacagacaaactcagactgggggacacgaaggtctgcagcttcattcccgaagtcagcaagatcagaacccatcagaaggaagaaactccggatacgtgggaacatcagaaggaacaaactccggacacaccatctttaagaactgtagcactcactgccaggcctttccacaactgccaaaagaaccttccacaatcattacattctcatttcgggacctcgagtgactccctactgctagtctcatcaagtctggattctgctagcatccaaaaccttcattccatcagcctctcttcaccactccagagtcatctctc

SEQ ID NO: 471099 - DNA, 1011 bp, Homo sapiens
gaatttcctatctgctgtaacaaatgaccacaatcataatgcctaaaacaacaaacatttattatcttacagtgctggaaatcagaggcctgaaatgggttcactgggccaaaatcaaggtgtcatcttccacatgggccaacaacatcatttggggcttggccatcagaacaccaccctccacacagctgtggaaattcttccagtccaaagtgcattccttggcaagtcttccgggagggacgctccaagatgtgcttattccaagcagcgcttaccctggaactccaaacaaaatgctaggcagccacaaaatgcaggcagatgcttcctccaaaggggaaggaagcagaaaggaaatggataccaaatgtgccaccagtgaatgtccacagctaccagccaaccccaatctgtttccaaaccaccactgcactcctgagtcccaaacaggctacacacatttctggccaaattattagtctatgtacacatagattgtactttaaataatataactttttttaaaatgaagaattgattttatgagagacttctgtgatcgcctgaaaatatggttgcaaaattctactttgaatggctctatgtacctgtagatatagtcgtacataatctccaaagaacttttcccaaaccttaagccactgcttcattagggcaaatgagaagcatggtcttctggctaaacggctttttgcaacatccaaaatgcgtctttgactttgaatcattaaaaagttggtcttgatttagagaattgcttttcagggaggaagaaacttttggctgcattccttcatgaaagggatggatcaagatgtatctggacaatgtgttcagataaaaaaaaatttagactggctcgtgtgtttgggggaaaaaaatgaaaccctgaatttcagaaagttgaattgagggctgtaagttttccagattcatatagtttttaaattttctgtaaataacttgtagatttatttgtctcctagg

SEQ ID NO: 471100 - DNA, 841 bp, Homo sapiens
agcaatagtcgtgttgtggttcctttgagagaactaagtggagctggtctgtctcagctgcagaaagttgcctcccctggaaccatagtcttccttccccagggggcccacatccagtgactaatcaaattcaagatgagccccaggacttgtgtggacaggactgagaaagatgataactctctcccctgggaagaggcaagaatggcactgtgccagctgtcttaccctatgaatgagtttccatctgtagccaaaagtgtcctaactgaaacaatcaacctcacggttaataaagtgcaagagtttaagctagaagaagtagttccccccaaccccccgcatgaccccacatgtcccttgctcctgttcatagcagctgatgtcatcaaggtgcctctaaacataggatttaggccaagcacctctagatctccaaaagcagttgggagaagatgcagatatagctctctggtggagaacaactgttctaggaggtttcagcaattagctctctgtggcattgactttgttactagctccagcgacagccagctccaagtaaaggaaggaatggttcaatatttttcctccaacagagaagggcttcgacttaagtggagctccggatgattttggcaactaagtccagtgtgattcaagctagcaaattaaacaacaagacaaatcaaaagaggctggagtaaagaatccagaagagcaaggttacactttactaccaagagagcaagtatacttattttttttcttttgatcttacagataataattcaaggcattcttttttaaaaaattgaaacactaggtataaagccaaagg

SEQ ID NO: 471101 - DNA, 664 bp, Homo sapiens
ccgtttcctgaataggaatcaccaccagagttttccgaggcctcttgctcttcgctttctcggcaaggctttctgagtgactggcactgcagccacactgtctctacaggaataggaggagtttgagcatttgtgggcagcaggtgttgtctgccactatggttggctgtactctttattctaagatggcttccagaagcttcgacaataattatacaactcacagttccagcaagaaagagacaccatctttgtcatcagcaaataaatggggaatgaatggcaatgaaagccctgaattgagcaggaaatggggcaggaaagagatgcactgctacagcccttccttcttcttgggaaaattgagcggcgcagggagcacagaagggctggctaaaagagtctgtaatggagaatgggcaagtacaacaggtctggatttccaccaggaaacctggctacttcaatctgacctgtcagaactgcccacttccttcattttatattttcattcttggaaatttgtctactgggaccccaccccttcttctcaaactcagccccatagaccttagagaccacaggattcatgcattaaaaatagaaacagaagccaattaaacctctaatatgttaaataagagttatttgcatctctgaagaa

SEQ ID NO: 471102 - DNA, 937 bp, Homo sapiens
gcttttcaaagcaagggcagtgatggtacaggaaaggggtcccgatccagacatcaaaagagggttcttggatctcatgcaagaaagaattcaggatgagtccatagactcatggacagctccgactcaggtaaagcctgttgtctacatgcttccagctgccgagctcaacctggacaagcagaggcattcactgatgaagggcagatggaggatgaggattaaaccagccaaaagggaagccacgtgccctcctttctccaccctcaaaatccagggatccctgatggggaccttagccccttggcccacactccactctctgccatgttccagcaagagtacgaaaaggcagaatccacctgagggacgcaggaagaggagagagacctttggactcatgggtgggaggtgtttggtaggtggaagaaggcttgatgagagggtatttagggctgaaggaaaagcaaccagaggtgatgacactcgctctgctggttttagcagctacagtcacaccttttgccgatcaacgcctacccagtactgctttttccggaaacactgagatatggaaagttgctgtagggatcaaaggaaaaatctcccgtttgccttccgaatatttgctgaaaatcaaatgaaaaaggcaaattgataggagaaaaggcatacatatttattaacatgcatgggaggatatcagagtgatcttcccaccacacagtagggtatgggtgctaagatacccttcttcttaggcgatagggagggaataaagcggacctttgagtcatctatatatctggtgacccagatatacagtatgggatcaacagatatatagatgactcaaagatacactttattccctgtaaggacttgtctacttatagttaactctgatttctaggattctgtcccttgacattgcagc

SEQ ID NO: 471103 - DNA, 645 bp, Homo sapiens
tgtgagtacgagcccagtggctgaactggaccggagtaactgttatggactgaatgtttgcatccttccaagttcatctgctgaagacttaacccccaatgttgtggtgtgaggaggtggagcctttgggagagctaaggaggaagggcccaggctttattatctctctttccagatgtggggcacaaggagtagaggaaggaaggagatataaaagccgtcaacaattaaacacaagaaaatggatccagattctttgttacaattacgtagatatcagagagaacaaagatgacgccattcttcaaagtgattactgtggaaagctggaagtcttgcaagaagcaaaaaccaaaacgagatcaaatgtgcaaggtcttttaagaaaaatgcctgcaggaaggaaatacctgtgggagggcattgctgtgcagacaattgccggatttgggcagggtgctgaactccagggagtaacaaggaaggtgactcacattcctacagcctccaagtcccttttccttttcaaaacacatctttctctaatcagaatgctgcttcttggctctgagtcttcctagtatcacttccttacctctcactctctaataaggccacccacacctgtcctccagattctttgcc

SEQ ID NO: 471104 - DNA, 570 bp, Homo sapiens
ctgaggtaaatgctgtgaggtgaaggaatgtggctttgagagagcagataacaaaggcatccatgatccacagggtggtccgagaaggttttcatgagagaatgatgtttcagtttagatcagaaggaaggttgcagcctgtgagcagttactatcagctctaccctcatgtattgattgtgaaccacgcaagtgagcagatgcagacaggtggaagcagggctgtgacccagaaagcacctacacagggattcgctgttcctgaacaaccagcagatgacactatgcccccctccccaatattaaaagcaataaaagctcctgccagaaaaatggtttctacccttgacctgcattgtgccctcctagagataggagaaagctatacttcctgccttctccaagttttggcattgaactctgaactgcacagccagcagccttctggaaatgaagctggagagctcaacagcagtggtgaagatgctttgaagagggtctctttgaggcctgggattctgcaatgcagaagtcagtgatccattccccttgtccatcctgtgcatctat

SEQ ID NO: 471105 - DNA, 574 bp, Homo sapiens
gtcaccactaacaactctattccaaccaggggaggcacagggctgcctcctgactgtcattcgtcacaatggcccatggcactctgagttcactgaagatgtcatccacattctgtccaagggaaagggctgtgaaatgtaaggggattgactctgcactgcttcaaagaatgagtgaggaccatatgaaagatgtcgtaataaaagacggaattttggatacagacatgcaagtagaaagaagagcatgtgatgatgaagacagagattggggtgatgcttctacaagccaagagacaccaaagattgccagcaaacctccagaagtgagagatgaggatggagagccccatgagggctccattctcatgggtaggattggtgccattataaaagggaggatttctgccttcatctatggtggggcagaggatgatgaggtcaaggaagattcagtccaccaaatagaattgctgcgaggagcaaatgacaatttcagaggtgcataaacattgagtaaatggtaaagcaaaagaaaagaacagaattatttgtattgctgctctctggctgc

SEQ ID NO: 471106 - DNA, 640 bp, Homo sapiens
gagtgtccatgtgcataatctcatttaatcttcatgctgatgctgtgacttagctacggggcttgtcaagtaggaaaatcactaatttccccaaggagcctcagagatgctgctggcagctggccctcctctctacctgctgctgctgctgctgctgctgctgctgctgctgctgctgctgctgctgctgctgctgctggtgttgaccaatttatcaacttttcttgtctttatgcttagcccttttgtgtcctatttaaaaaatctttgtctaccccaaggtcacgaagatgttttccttgaaaagttttacctgtcacattttgaatacaaatctgaggaagcgtctttgcatcttctagtgatattttttcccgggctcagtgaatctacggcagggctgaggggtaataaatccataatggtaggagcaaggagccaaaatcagacttcaggctcttccagttatcagctgtttaacgttaggcaattgtttaagcttgctgtgcctcagtttcccaggggtaataatcctgccttcttcatagttttctggtaagggcccattatgtcaatacaaggctgagaactgtacctggcatgaaacaaacatcactaagcgttagttattattattggg

SEQ ID NO: 471107 - DNA, 1088 bp, Homo sapiens
acccccttcctagcaggacagatgaggaggcatgaggagccatcatggtccctgggcagctgactccagtgtcccgggatgaagaggccgctactgcagctgtggaatgcagttataaccttttaccttcccttcaccagacactgcctataggcctcacacaccagacagttctcaagatgtccttcgggggagcctccaggaaggatgaggcttggaggacatataggagccaaagaaaagtgatggaggtgatagaggtggtggtgatggtggtagaagtagaggtgttgatggagatgaaggtggtggtggaaatggaggtgatggtggagatggtggtggtggtggaagtggaggtgatggtggtggtggaaatgaaggtgatggtggagatggaggtggtggtggtggaaatagaggtaatggtggagatgaaggtggtggtggaaatgaaggtgatggtggagatggtgatggtggtggtggaagtggaggtgatggtggagatggtgatggtggtggtggaagcggaggtgatggtggagatggaggcggtggtggtggtggaagtggaggtgatggtggtggtggaaatgaaggtgatggtggagatggtgatggtggtggtggaagtggaggtgatggtggagatggaggcggtggtggtggaagtggaggtgatggtggagatggaggcggtggtggtggtggaagtggaggtgatggtggtggtggaaatgaaggtgatggtggagatggtgatggtggtggtggaagtggaggtgatggtggagatggaggcggtggtggtggtggaaatagaggcgatggtggagatagtggtggaggtcttggaggcagtaaagttaaaggctggaggccatgcaggctgtggttgtgaaggtagagctgacagaggtagaagtggttgcagtggtgatgaaggtggtgatgatgaggagagtcgcgattgtggtggtggttatagtgttggatctggtcacttccctgcttcttttctggaactccacttggagtaagaaatttgttcttctttgctgtactttttccaagatgcaactgag

SEQ ID NO: 471108 - DNA, 534 bp, Homo sapiens
cggtcacgcaagcagaccaggtccccagctatcctttcttgtagctttatgggaatatggagagtgggttttccagaggctgcccaggcacacaccctcattcccctgttatgctgaccaggtgctttggcttagtggtagagggggtccttgtttcaccaccagacttttgctttcactcagagagagagaacggaatggcagaaagagcagtaggtcaggagtcagaaagtgtgtgttccagtccagccctgtggcctcggtatgaccgccttcccctggttttgtgggtcctgttggtcatctctgcaataagccatggggatgaggttgtgagaaatgtggacttgatcattatggcaaaccttaccttaaatagctttgaaaacaacaggtttatagccctagaatcaggagggctcatgtcctccaattctgtaccgtaaggagtctctctgagtggtatccttgtagatgcaggctaatctaaagactagtaagtaatcagcggggactgcatttaattcacccctt

SEQ ID NO: 471109 - DNA, 608 bp, Homo sapiens
gtaaaaccactgaacttttaataggtttatgtggaagccctcaagttatactatgcgggcggtggaagacagagatggtacttggaggattgcggccgacacgcaccgatggaagcttccattttcatgggggaaaatgcagccctggcaaggtgcacagggaaggtggccaaatctgcgtacagtggctaagcagtaaaggtgctgtcaagaaaatcactgttgggtacattcaagggggcaatggtgacataatcacaaggttccgcttcaagattggcttccaatcaactacctttgtcctgagttactcacatgtagggctgaagaagctgcaggtgaccacatgtaccaggcagcagctgaacctcatggagtctgtcagtcctcggcagcactcaaatcctcaaacggggattaatgatggaattggagcgaggaaggagggggtgacaaccggaggattcattttacctcttctggaaaggctacaggtcaccctgtaccaacagactattaaaatgaagctgcctatccatcacctggaatctgctggtccaaacacgctgaaattgatctagcaggaggggaaaaataccattacagaa

SEQ ID NO: 471110 - DNA, 587 bp, Homo sapiens
ggcgataatgatgtgtcaatggactataacaaatgtaccacgtgtaatcgatgtggggacaaggagccttggctgggggccacgtgcccttgcctggtgccaggatcctttggcattatcattttacacagggagatgcaagaatgtctttataatccaaggcttgggctctccctccttgatccccatgggattcttctgggttcactctccctgccataccctatacagcagccaccctggaccactgactcttctccagacttatcgagctttcctaccactccatgtggtatctggtgctcatgtggttctaccttctgggaatgctctttctccattccctgtccacaaatccaagccatctggaccgtgggtcctgggatgtaggagaccctctgatgttaccgactggccagtgctttgggggtgtgacttgtgaagcaggaaatatttggggaatttagcccccaaactggactccaattcaattggcaaacaggtctccaaccaacatcttcatactactcttaaaacttaattacctaggcagcttcacttttacctaactggacaggaatacactt

SEQ ID NO: 471111 - DNA, 586 bp, Homo sapiens
cccaggccagtggttcattaagtgtgatccccagaccagcagcatcagtatcgcctgagaatttcttagaaatgcaacttatcaagccctacctacaaccaacacaatcagaaactctgggggactctgattctgaagaaatggagcggaattcagaaaacttcatggaaaaagtaccattacctggtaaattccatgaggtcaaagatgtgacaatcaaacatatctacagacattgcagaatgtcccctggaggggcaggggggtggaattgcccccaagttgagaatttctgccctaggcagtgcctatcatggcccctgcctcccatcctggcaatacagtcactcttcctggtgacccaacagcagaaccaatgtcattgtcctcctttccagagctctgtgctccaaaggtggggtgtgctcctacccatgtcacttcaccctcatcatgcttatcatccacctttcttaatcataaccttcatcattatgtgaaactggggacaaatgatctctttcaaatgactggcatatagagttgatcctcatcctttgaggatttcatatttgtgaattcatct

SEQ ID NO: 471112 - DNA, 1135 bp, Homo sapiens
agcttctattacctgatacccaccccaaatgcctttgacacagtggggttggaaattgaggaggattggcagcagcggtggcagcagaaaatgattctgaggtcaccttcctctaacttcaccactaccattattatgactgtcatcatcaccatcatcatcatcatcatcaccgtcatcattatcaccatcatcaccttcatcactattaaaatcaccaccatcactatcaccactatcaccatcatcatcatcaccatcaccatcttctcaagatcaccatcatcaccatcatcatcatcaccgccaccttctcaagatcaccatcatcaccatcatcatcaccaccaccaccttctcaagatcaccatcaccatcatcatcatcaccaccaccatcaccatcatcatcaccaccaccttctcaagatcaccaccatcaccatcatcaccaccaccaccaccttctcaagatcaccatcaccatcatcaccaccaccatcaccatcatcaccaccaccaccaccttctcaagatcaccatcaccatcatcatcatcaccaccactatcaccatcatcaccatcaccatcatcattgctgaaagtgtccactgaaatgatcttttcaattgcctcaatcttcacagtcaaaaaaatccaaagtcaggagggagaataatattatttcgaacacacagaacaacattgtatgatgctaagttgtcacaggcccatttttctcttttccattccatcctcccaacaagcctattagaagaccaagcaagtgtaataccctcattttctggagatgatgcagacaagttatgacttgcccagtgtttgaggaggagataagattgcagctcttcagtctcactttggtggcttttccctctgcaaggacaggtggtcaggatcctgagtcctaacctgtcagggtctcaattctgctaccactcactagctttgagaccctgggcaagttacttcatgactttaaggctctgtttccccagatgtgaaatagagtgtaacagtttactttacagggttgttttgagaagcaaataagaatacgcaagaagcacaggtggtatagagtgggtcacaccgtacgcactctgataacctg

SEQ ID NO: 471113 - DNA, 959 bp, Homo sapiens
ctccccgtaaaccaaaggcatgtgggaatacgtagtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgtgagtcctggaggactggcggcctgtgggagggccagggcacaggatgtggtcgcagcactggagggggacagctcccagtggctggtgtcagccgatgtccaggccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgtccctgggggcagctagcttcatccagccccaggcttctgaaggggcttgagtcctggggctgcctgattctggctgagagagctgacactagcccctgcgacctccgagcctccctgtgcctggggctcctcccttgtaaggaggggcggcagaccttgtctcctagggctcctccacccccatgccagccacctccctggaaaccagggatacagaaataaacaagacctggccctggtctgccaggggctcgcactgtgttttcagggtctggcctgcagtgagagatgaggcaagggaggtctgattgtaagaggttgaagtgcccaaggtgcccaggtggagcgggggtggtgtttaggagccggggtggtgtttaagtgggagagtgacatggtcgtgtttgtactttgtgctctctggaatcttccagagggtggactggaggagttggaatagactctgggccgggtgc

SEQ ID NO: 471114 - DNA, 527 bp, Homo sapiens
tgtgtgtgccaaggatgagagtctatgagaccatacacatcaaaaaacgcggaaagaacaacttccggagtgctgcaagtagaaaaattaccattactcccacaggcctgagagaaattcacagttggagtaatcagagtactactccaaaccctgttggcgaaaccctgacaaggtttaaaacaaacctcaaaaggatagagttgatctgcaaggcctataagaaggaaaacaaagttgacatgcaccccaaaaagtatgtgattccagtgcttggaaatgcctggcacacgatgaatactttatgggttttggctattagtgttgtgactgttgatagaataccctccttcgaaggctccagaagagatatttttgctgccccaaagaggtggcggcacctccttaaaataactgtgctggctgggccactttgtcagcagcttcctcaggaaaacaaggctgcagagtttacttcctgttgggcttcctgtgccttggtttctcctcctagctgactcagggag

SEQ ID NO: 471115 - DNA, 721 bp, Homo sapiens
cacagactgaatcttcttgggagggatccaatgcaagaaaatgtcaaagggaaatcccagaaaaagcatctattgcaggtcttagagtcagtctctagagtagaacgggaggatagaggctccaagagggaagcaagagaggattttgagacacagcccttgcttccagtgctaaggccacttatattggacagttttacaactgaacaagttaaaaatgacagtaaggaacaaagatcaaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggagacctattatctgtcttgaaaataactacaaaaatgagtattggggaagctaatagctcatgtatagataatgaaaagcttttgaaagccatcaatccagataatgatcaatataatataaaaacccagtataggttagcagtcaacaaggctggctggaggaaagatctaaagtgggggccctgtgctttgtagtaacattgactgagaagtctgtaagtgggggaagtaattataaaccaagggagatcattgtcctgtttacaagccacttgttaagccacagactttaacatttcatgtagggacc

SEQ ID NO: 471116 - DNA, 1347 bp, Homo sapiens
aatataattccttaagttaaaatgaaaaacaaaaaagaagccattaaaaagaacattctgggtagctcttccctgaatctatttacaatgtgggttgggggagtggagagtaacacgagtgaaacagaggaggagtcaacacagaaaactcatggtactagaaatgaacacaacaggacttcagaaaatcgtgcctactgcaagagtggaaaggcttcttggatgtggcaaaactttagctgtgctccagataagaaggaggacttggatgaggggaggcgctctggactagaggaacacggtgtgcagaggtggagggagaggggtgagagtggtctgccagctttgtctgtcttggtagagaggaatgggaattctctaagtgctcattggtcgtacaagacagacctagcaaaggtctccaatccacttcagcagctgaaacggccggaggtgatttgcattcactggagtacatatagacttcccatctgtggtttccaggcatgggagaaattgggctacttttaaatctatttttagatatacagagctgctaaatatcatttgatctgggactaaggaatgtttctaaaattgttttttcatattcatgaatgtgttgtttccagtggctattaatttctacacatatcaaacaaacaaaagcaactgactatctagaaatgtctgggaaatggcaagatattacagaatcaattgaatagaattataaacccttttttgtgtgagtgcatgcaaatccattagaaattccttggtagcaatgctttccatttcaggcctcaattttgtgaaatatcatactagggaggaggtagttcctggaaaatatcattgcctttgtgactttagagtgtaacaggaaaatctacatttaataattttaccacattagacacttagggcaaatttgcaaaagataattttatgaattttcaaaggatataaggctttaatatgtggaagtgataataataaaaacattcaaaatgtgctaacaaacaggtaatgccataatgcacaaaatgatagtattgtgtattatatgtagacttgtggccactaaccaatgatatgctacaaaattattattaataactcctcagcatcatcaaccaaaatcgaatattgatcaacacttataccatattcatgaaataatttggaaatatctgatgatatataaagctttcttcccatgatacataaaacattttatttcattaaagtaggtatttgccttttgccattaaaaatattgagaagtttccttatgagaaaataaaaacaaaggtttggagacctttttcattgtactttgcc

SEQ ID NO: 471117 - DNA, 1324 bp, Homo sapiens
tgcaaaaccccaaccattggtggttcagatgaagccatcttcacactgtttggggctgggagctgctggtgcaggagtagcagagtatggtagagagaacagtgagggcagctttctcatctgtaaagttgggctagaactagtagctcctgtgaggactcaaagagatgatgcttatgaagtgcccagcacagggcagcatgtggacgtggtggctgttcatgtgtgccctgcttgggtgaccaccaagttcagcaaggcacctggtgagcagacagaccactggctccaggcagctggagacctgcttctggccctggctctggagctgactgtctgtgtgatcctgaatgccttgcatttcctcctgtgtctcggtatattcatctttcaaatgagagaggtggatgagttcacacttgccaactttaacagtcacgtaggtggttggctatttgaagattccatggaactgaacttctgagtctgctttgtgctgctcttccctctgcatctttgcccatgtggttcctccttccacaaatctccttcctgctcatccatggagatacaaccttctttaaaaaaaaaaacctgtcaactcacaccccagtgtcaccacactcaccaagcaacttgtcatcctgaatcctgcagacatccgaccatcacagccagccattcctctgtccacccccagactcttttgtctcactgtgtccaggctggtattgcaggtagacatgctgttttcacagggtggacttgatggggaaagccataccctttgtatcacgtacttagcaccacgaggctggcagcaaacccctttgctctgcctttgttcctggctaattagagcctgtttccaccgttgtcgctgtctttccagccatctcttcccccacaggaactccagcctctggccatgttgtttccatcctacttgtaaccccttatgataacaaatggccactctttgtaacagaataaaatccaaccatagctctgacccagcttagtgtctacctcacctggaatgcagccccttcaacagtgaaggtaatgttataaatactgactatcttggtccccacagatctctttcccgtcacacctcctctgagccctctagctttgctcctttgaaaacccataagccttatttctgtctttggagtataatcaccttgaaagtagagactgtgattataatagcatctcggtaaaccccaataaatatttgttggttgattgatttactgacattactgggccggaatctggtttctggactttgttgccgtgtttattgccatctgtt

SEQ ID NO: 471118 - DNA, 970 bp, Homo sapiens
aagagcaggggtgggtccagggatttggggtccagccaaggaaggagcctgggccaagactggcctttctgaggatgcctgtggcagagttctggattgccaagtggtgtggaggttggagaaggagggctgccacgggggccagccgtgttcagaaggccaggcccatctctctgcaagcattttctgaaggatggaatgaggctataaacaccaagatgtttatggaaatttatgtgactgttcctaatgtcataaatcatattctgacaagaaaagtccatgatcccggactggccctggtgcatctttatattgggaatgggggagtggactcttgtaaggtggctggagacatcaagtcagcaggacacagggaggatgatggacaaaacctccggggccttgagttctggcttcagcttagccatgttcttactttcccgctttttacacatctgtcaaatgggaataaaattcctgggaagtttcaagtacatacacaaaggtatcgtcatctcaagaaggattttctctctggcccagaccctttgacacccactgctagccctcatggacaccttcagcctggcttaactatgaaagaatctataagctattaattatagctttattaaaactcaacaaatctagccctaaaaagacagctgacatgggtttaggtcatatcttcttactagctgtgtgaccttgtacaacttatcctctttaagcctcagtttcctcatggaagaaggggtgggagacaaataagagtacccacctctggcttaacatgaggattctgtgagacaatgcctggaaagggcttggtacatggcacagattctgtgtgcatgacgtggtagttaccatcatcatcttcatcacaggtctgagattcctcttgcagagactcattccactgagaatttaaaactcagacacctggggggaacagattgcatat

SEQ ID NO: 471119 - DNA, 892 bp, Homo sapiens
tgctagcagcagtaagcagaggtctgagtgtggaaggttcccaatggagtttagcctgaaggatgctatatatgctgttgtcaatgcttggaacacagtaactaaagacacagttgtggatgcctggcacaacctctggcctgcaactgtgttcagtgctgatggtgaacaaggtggtgactctgaagaattctgtatgtccagtgaggaaaaaaaatgctttatcttcttacttctgaatcaaggatattatgataacagtgatgatgacgatggcattaacgctgcagaaaaagtgccggtagacgacatggtgatatgtgataggtgtattgaaggactaaagcagaatgtatttggaacagaacaaggaatcatgtctgattataaaatcaaagagagacttctaagacaaaatacactgtcaatgaagcagatgactgcaggaaacatttcaaaaagccatgcagcagaacgtttcctcatccctagaggatcgacttcccagtccctcaactgcttcccatgtttcttctcccttaaatcaatcaataattaattaattaataataaacaccatgcacagcagccttttaagtataacagcatcttagccgaatggcctccagttgcatctatattgtttcaaatgacagatttcattcctttttattgctgaatagtcctccattgtgtatatgtaccaagttttccttatccattcatccgctgatggacacataggttactttcagatcttggctactctccagaatactttctgcttgattctattatgttattttagtctcttcgttaaatttatctggtaaggctttaaatttctttctgttgtctgaaattttactattttgaattatctttctgaaaa

SEQ ID NO: 471120 - DNA, 1066 bp, Homo sapiens
ggattttcctcagaattaactggcagtctgtcgtcgtcctaaagttgttaccatttggcatgtgacgttatggtaaggttcttgtgggtggactccaaagccacacgccttctccttctgccatttgcacaggaagccgttcccccttgcggaaagggacttggggatggtgcctctgcagctacgagtgtgtccgagggtggggtggagggcctgaggagcggcctctcatctcttcctctgcggaacttcatcgcgggttccccaggactgcccaggcctccccaggactgcacaggcctcccctgggccggcggagccgctctcaccttccacacttcgccgccctcctgcgctcaggcagcattctggacacgggatgtacaagcttctcctgtacctgcagtttctcacgataatcagctcacaatagtccttatgccaaagaggcatgtgtggaggtgccatattctggtctcctacaacattcagtaatggtcaagatggttgatgcaggaaacagatggaggggcagaagttgatactcatctcattagatccaaagaagccaaatggtggccatcacctgtgacatgaagagggtatattttatggaactggacagctttcagaatcacaagcaacctcttcaaaatgtgatctactgaaacgtgcttgaaagagagaataggagtgaggcgggcaaaggaagcagaagccattgtgaactgccctagagaaaccttgggcatctttttgttgggcaaagtggtagaggctgaaacggggaatagcatgtaacattttatttgactgaaataaacagctgtttgttttttttttctttcatatgtaagatagacaaaaggtgtttgacagataaggattggggcaatgttggtatgagttcagctttttagtttgttctttaaaagtggccatcaagatgtgggtgtaaggtatttcacagtgatttgcattcattctcattgctgtcaccatcaaggcccagttactcaatatccaagtttgtttttgttgtaattcaaacaaaataaatacaagt

SEQ ID NO: 471121 - DNA, 524 bp, Homo sapiens
tgggctggccaggtagtctaaatcaccatgtgtagttacctggggaaagagacgttaattgcaaacagtcaggttggaaagggtgatgggaaaggtcatgaacattcccagacatttgtggccttctggattctgaataagctgcttcctggtgaccacctccctatgggacagccagatcccacctgcttgactggccctgctgagcgctacaccttgcagggactgtgtgatccttggtgtcattgcactaagacccagcaagggtctggtgctggacaggttggaagtggaggaaagccagcagtaacgggcctcagccagctcccacacaaactgaagggccgggtctctctcccaccacaccccacacgacagcccaaagtctgtttccaggaagaggtagataaatatttagcactgaaccccaatactgtccctggcactaaaaagacttcctccatggaactctaatagacctcaaagacaccttccttgagtccaaatatttgttttaccctgtt

SEQ ID NO: 471122 - DNA, 585 bp, Homo sapiens
gtttatcatggaccaggctctcaatgacactgtactgtagctgcttaggcttctgttctctgaagctggtactatggagaattctcagaacagcttcattacttttgatgagttattctatggggctaactgggtctaaggattcagttgactgttatggctgctggaggaggaatggggcatacaactggaacgctctggagacagaggaatatctctcatcaagatgtgttagaggagagaagagccagagtccaagaagtgatagtgaagctgagatgagaaggtggactctggagggatgcaggaggaacattgaaacacaaggtgaagcagcaagtgctgatggagaagctgcagcaaattatccagaagatctagctaagtccattgatgaaggtcgctacactgaacaaggccatgtaaaggacttggtcttcatcacaggacagtatgttatgtagccactgaagggcatggagtgccaaaattaaacagatgcagatggcagcattctgttcaattctgtatttgatttttgtcacgacaattctgacactgtttgtgcaatgagttatgcagcgc

SEQ ID NO: 471123 - DNA, 1376 bp, Homo sapiens
ctggtgccctcacaggaggagaagacagacaaagggaatgtgtttaatgtggattctgtcacttgcacctgaaggaggcctaattcacaggaaggccatggctgaacagggtcctcgcttcctccatgggggtggggccgcagggacacaggcagatgaaacagcaactctagccagagggaagctcccggggcccgggtcagcctgaggccaatgaggacagcttcacggagatgcaatggtcctgcacagctgtgtcttaagaagtcaggaatgtgtgcaaagcccagggcagaggcgctctgtgcttcggagcctcttctctgttctgcacttcgcaggacaagcacacccaccccggagcattccagactgtggggcgatgaggcaggccccggcggtgtggcctgccgtggcggtgtggcctggccccggcggtgtggcctggccccggcggtgtggccggccccggcggtgtggcctggccctggcgatccggaccccaacacttctgttcgcatcttgggtcacagccagggcgacgtccaacccccagcgccgacgagctcagcgcctggagacttctggtcccagaactctcaggacccaggagaggaaggcactggtggtggccatcgggggtacagacttatgggctccaggaacgcagtgcggccctcaaggcctggccgtcactgaactggaatcggatgagactatggaaagcactattccgggccgcggacaggaccgtgagggtcacgcctctacatgtaaacctagaaacacggggccagcgcggcactggacgctgcccatgacacgcagaagcgaggaatgggctcctgctcatgcagcaccgccgactccacacatgcagaatgctctccccaggctgggcgccctcctgaaggcctctggggctgtacggccggctcagaatttctagggctgacacaggtccagaacctaaaaagcgatgaggttacgccgcaagcaggtggaaacacagcctctccacccctcgcctgacccgagctggctcctgaactagagctggaactagatctaatgccgatctaatgaccctttagtgggctattattttctttagcagaaaatccgtgtcacagaccccgttctgattgccttgctgcatgcccgtcgtctgctgggaacgccctgtgcatctcatttaaccctcacagcagcagcccccgcagggggtgattttcgtttacggaggaaaagaccccttcctcctccagtctctacctgcccttaatacatctcgatttcttgagacaaatcttcaactgtctcccaatcaggatccaactgatcgaaggctggtcgtttctgtatctgaaagctgt

SEQ ID NO: 471124 - DNA, 1072 bp, Homo sapiens
taattaaatgttaatccagaaagattttaacaagcacttaccacattctggcttacaccctgctcgtgtgcatggaaaaagctcctgctgtttttcaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtgtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggaggcccgtgtccacatcagctgcagctcccactcagacagacggcctgccccacagcctgccctttgctgaagataccctcgctttatacttgcatttcgcttttcagtaaaaacagtcaagttactgagttctcacataaagagctcttctcacacactctaaaggcaagttgcgtaaacagtggcgtttccgaacgcaattccattgcggccaccaatgtaaatcattgcccagagactttgctgctagcatgcgtgtccttcccatcctttttctatttgcaaaatcacactcgaacaccatttctatatatagagatcagctgtcctgtaaaactcaaatcccctaagatggcccacttgcctggtcatgggtttcctattttattt

SEQ ID NO: 471125 - DNA, 642 bp, Homo sapiens
acgtgaaaggctggggagggtccagagcagcagagactccccttcactgctagggtgaagggagaatgatacagcctcttcggaagacagtttgggcatttcttacaaagagaaagcgcctcctcaaccagagagcacacagataccttcacctccaccgtgtgtatgcagagaaagtgcctcctcaaccagagagcacacatatcttcacctccaccgtgtgggacacgtgtctcctcaacaaatcctccccagtagtgtcatcagtagaagacatcagacaagtcgaaatcaagggcattccaaaaagacatgtccggagctttgaggagcagccagagcagcgtggggtcctgtgtggggccctgggcaggaaaagcacatttgagaaaaaccaggacctccacaccatttctctgccacggtgcgtgtctgtgtctccatggagtgtcgccctgggtgggctggagggcgccatggccccgggtgagctggacggcgccgtggccccggaccattaatagaagaaataaaagtgacagtggagtgagtgtggcaagcagaagagctgtcgggaacgtcacctgcccacccctttgctgtaggaccctaccaccagcatactccgtcgttggcaccctc

SEQ ID NO: 471126 - DNA, 1320 bp, Homo sapiens
cagcagctcggtcaggatcagtgcggtgaaggagatggccaccacgtggacgaactcagactcgaagagcaccagggccccatacatgaggatgccgcctgaaaaacagcaggagctttttccatgcacacgagcagggtgtaagccagctagaggaaacagccttgaaccagcaacgtcactcaagacccttaaaaataggggataggccaggcgcagcagctcatgtctgtcttcccagcactttgggaggctgaggcgggtggatcaccaggtcagagggaaggacggtgctcacggtggcgccggggagagaagccccaattaactggggctctgcacgcgtctctggccttggcaggaagggaagctggggaggaagtgtgggcttcctgccgttcagtgcctggcctgctctgctgagggtagagacgtgccaacgacgagggtgccaacgacggagtatgctggtggtagggtcctacagcaaaggggtgggcagggaagctgcagaagcagcgcagacagccccatggcgccctccagctcacccggggccacggcgccgtccagctcacccggggccatggcgccctccagcccacccagggcgacactccatggagacacagacacgcacccccacagtgtggttctgcggttcatgggccgctgtctgcattcctcctcccttagctccatgctggtgcccgaccacggacgggtctcttccctacagttctgcacctcccaggtgtccggtaaaaagaatcaataccagctttcaagtctggcttctgctgcacagcaaaatgcacaatgtatgatccatcatgtcatgctgtccctgtccacggagatgtccttccatcacacacaggctgtccccgtccacggagatgtccttccatccacgcacaagctgtccccgtccacggagatgtccttccatcacacacgggctgtccccgtccacggagttgtcctccatccacgcatggactgtccctgtccacggagatgtccttccatcacgcatgggctgtccccgtccacagagatgtccttccatcacgcgggagctgtccccgtccacggagatgtccttccatccacgcatgggctgtccctgtccacggagacatccttctgcccactggctgaagggcacaaggttgtttccagcttctggcagttatgacagtgctgctgtgaacattcatatataggatttagaatatgggtttatgcctctcaatccatgaacatctgtttatgcctccgaatccaggaacatctgtttatgtctctcaatccagg

SEQ ID NO: 471127 - DNA, 3165 bp, Homo sapiens
ggacacctccagacccagagcacccctcacacagggtccctcacacagacacctccagacccacagcacccctcacacagagtccctcacacagacacctccagacccagggcacccctcacacagacacctccagacccagagcacccctcacacagggtccctcacacggacacctccagacccaggacacccctcacacagacacctccagacccagagcatccctcacacagggtccctcacacggacacctccagacccagggcacccctcacacagacacctccagacccagagcacccctcacacagggtccctcacacggacacctccagacccagggcacccctcacacagacacctccagacccagagcatccctcacacagggtccctcacacagacacctccagacccagagcatccctcacacagggtccctcacacggacacctccagacccaggacacccctcacacagacatctccagacccagagcacccctcacacagggtccctcacacggacacctccagacccagagcacccctcacacagacacctccagacccagggcacccctcacacagggtccctcacacggacacctccagacccagggcacccctcacacagacacctccagacccagggcacccctcacacagggtccctcacacggacacctccagacccagggcacccctcacacagacacctccagacccagagcacccctcacacagggtccctcacacggacacctccagacccagggcacccctcacacagacacctccagacccagagcatccctcacatagggtccctcacacggacacctccagacccagggcacccctcacacagacacctccagacccagggcacccctcacacagggtccctcacacggacacctccagacccagggcacccctcacacagacacctccagacccagagcatccctcacacagggtccctcacacggacacctccagacccagagcatccctcacacagggtccctcacacggacacctccagacccaggacacccctcacacagacacctccagacccagagcacccctcacacagggtccctcacacggacacctccagacccagggcacccctcacacagacacctccagacccagagcacccctcacacagggtccctcacacagacacctccagacccagagcatccctcacacagggtccctcacacggacacctccagacccaggacacccctcacacagacacctccagacccagagcacccctcacacagggtccctcacacagacacctccagacccagggcacccctcacacagacacctccagacccagagcatccctcacacagggtccctcacacggacacctccagacccaggacacccctcacacagacacctccagacccagagcatccctcacacagggtccctcacacggacacctccagacccagagcatccctcacacagacacctccagacccagagcacccctcacacagggtccctcctgcggctgctctgcagctgcaaccacttccctctgctgcctcctccctaatccctggccaccatgaatccgttccccatctctaatctggtcatttcaagaatgctatgcaaatggaatgctatgcaaatggaactgtacagcagagccttctgtttccagctgaacttagcagaaggagcagggaggaacccatctacctcacctcccaccgtcctggaagtggagctgggccggaagctaacacctggctattctctctgggtggtctccgctctctgcgagtgggtctcttcgggccagcggtgtcaggactcgcccaccttgccgagcgtgtcctctgctttctctgtgctgcaggccagcgtctcacactatggacacaatgcagctcttccaccccctggtggatggccgttggtgttttcccagtctgtggagatcacagctgaagcggtgagagtcctgctgctggtctgcgtggaagctcccagtctgtggagatcacagctgaagcgcagtgccaccctgctgcccgcctgccaaaacgccacttggcctttcggcctggcctccgtggtagcagagccttaactctctctgtggcttaaatttatctttcctggtaactaatgatgttaaatacattttcttgtgcttactgaccattcttatgtcttcttttgtgatgaatgttcaaatctttcatcttaaaaacaaaactgagttgtctgtctgatcgttgagttgaagatatgtactgaaagtattttactcttgtctgcctttttacttgattagtactatgtttagaagagcaaaaacttaatttttatgaagtccatcatgtcagtttattctccatgcatcacgatgttcatgcttaggaagtctgtgccaatctgggcacaggttggggggccctagaacccaccagagcctggccctcctctgagatttgcacacactgaagtttactctgacaaacttcacagcagagctgatgaaatgaatgcagatgaaaaccatatttgtggaattaaattctatcaactgtcctctaggttctagagccagtttatcatagacatgattttgttctagttagatgttattttgtaaaaacatcatgttgatttttgttcaattcttggtatttatttcctaggtgaaggcaaactcattatttattttcaaagaagcttaactaaaggcatcgcccctccaaagctcccacctaacccaattcagagtatgagtgcttaagaaagtcacagacgtttcttttgtgacggacactcagagttactttacatgaagcccattataaagaagagctgtaggaacaggagctggggacgctgcagagcactcgggctgtgaggcaggcacaggcctcactaacccaagcagtagttctttaaagaataatctccatggtcccccacattttccttttcatgtttcaaatccatgatttttaaaatatgaaagaaggtgagaagggttatgcttttctatgacttccaaggaagaaacacactgttcaaactcaagatgcaatcagtattactgtgcaaattctgtactatttaaaagtaactaggctggac

SEQ ID NO: 471128 - DNA, 1332 bp, Homo sapiens
tgtgctccccatggttagcgtgttctccgtggttagcgtgctctccgtggttagtgtgctctctccatggttagcgtgctctccgtggttagcgtgctctccgtggttagcgtgctctccgtggttagcgtgctctccgtggttaacgtgccctccgtggttagcgtgccctccctggttagtgtgccctccctggttagcatgctctccgtgtttagcgtgctctccgtggttagcgtgctctccgtgtagtgtgctctctccatggttagcgtgctcgccgtggttagcgtgctctccgtggttagcgtgctctctgtggttaacgtgctctccgtggttagcgtgctctccgtggttagcgtgttctccgtggttagtgtgttctccgtggttagcgtgctctccatggttagcgtgctctccatggatagtgtgctctccgtggttagcgtgctctccgtgggtagcgtgctctctctggttagcgtgctctccgtggttagcgtgctctccgtggttagcgtgctctctctggttagcgtgctctccgtggttagcgtgctctccgtggttagcgtgctctccgtggttagcgtgctctctctggttagcgtgctctccgtggttagcgtgctctctgtggttagcgtgctctctgtggttagcgtgctctccgtggatagcgtgctctctgtggttagcgtgctctccgtggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggaggtatgtgagtgactctagcgtggttcacagtgtttctatggaagaggagggacgtgaataaattaaactccctgaagacctagtaaaatgccataaaaattacttttggtcataatgatgtgcaattaattgtaaaatacttctttaatttatttagctttatgaggccaaatcaataaatgttttgcaacagacagatgatgtcagaatgtttttcacaaagataactttattaaaaattctatgtacatttattttttcaacattatattttctttccttggataaattgttgtcccttcaccaatgtctttgttgtggtactactatattatgaaagcctttcattttattaaaaac

SEQ ID NO: 471129 - DNA, 740 bp, Homo sapiens
gcctctgtgtcctttcagctttacgatctgtaggaaaagatgttaatttcttcggcgtcagcatggccagccagcactcctcgccagggagctgcagccgtcctgcaccaagaggccaagtggctgctgtgtccggccttgagtgtcatcttgcaggggagctttgagtcatcttcgcttagtgcttgtgtctttgattatttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaatgaatggaaagggcacacagacggtccgcagcttcatagtcgctcgacttgatgcgactttgatcgagtggtgcggtagcttcactcgaactcgatggtggtgcagtagcttcactcgggactgtacttccactatccgtgcagcagttctttctttcactttcaatacggtgttcaagaaatcacatgggatattctttgtgttagctgattttgcccaactgtcaggaattgccacagccagtccaaacttcagccaccaccaccctgatcagtcagcagccgtcaacattaagacaagaccctctaccagcaaaaagattaaaagttgctgaaggctcagatgattgttagcacgttttaaaaatatttttaaattatgtcttgctagcgg

SEQ ID NO: 471130 - DNA, 511 bp, Homo sapiens
gacaccatggatacccagggaccagtctcccagccttttcagcagcctgagaaacctggtcgtgtccgtcgtcggaagactaggcgggaacctcgtggtcataacccagggcggctgagccgggagcaccggggtctcttcaaccacgaggtgaaatccctagatgttgcaaggctgcttagcagtgggaccctggtgccaggcagccccacactccccgccaagccctccccaagcccaggcagggcccaggaaccagccccacggtccagggacaaagagaaccaggtgcctggaggttcgggcccaggcccacccagttccccagagttgtctggcgtggggcagctgctggcagagctgcagtgtcagctgagtttgccacaggcctttccccggaggaacctgattaaggatgccagggatgccatcgtacacaccttgcaagcctgtaatggttgtgtgcctgaccttgccctggtgcttaagggatgatagtcacccttgccag

SEQ ID NO: 471131 - DNA, 873 bp, Homo sapiens
aaagggaaccatcggccatgtgtaagcggagcaacgaggagaccagatccgcagtccagagatactgctccagcaacccggtcaatgtgtgggagggaagcgggcggtgggctctgcaccgtccatggctggctccgggcgacttccagcagagccagctaaatagccacaggcaggcccaggactggagccaggaccagcaggacaaagccactccagtggcctgtctgcagggtgaaggggccactgggccacctttcgctccagaaagcgatatgcgaggtggttgcaaacggtcccgcttctggatgatgctcccgccactccctggcctgtgtctgcacactgtccatgtattccatcttcctcatcagaggagcccgcgtggcccactgcgggatactcaccttgccaaccgctgtgggccagggtcgtgttaacacccgagagatgcttcggacgcaggcctgcgtgttagttgaattatcctacgcgtgattatgtgaattgtgtatcacaagggaaatatatgtacgttctcaccttcgtggaggcagccgcaaagccttgcccgtaacaagggtccaatgaatagttgttgataagctgatatttgtgttataaatgcagaaatattctctgaatttcacagaaatctggctgaagagggaagccagtccaccagggaactttaatctcttccacctctcctctttctcttcttttaatagtaattattgacagggaatgctgaatggttttctgcggtcacattcccgtgttcagtttaatgatatggggaactgcagatggaggtgaggataacttgaaaagaaagggtattattggtaaatgcgctggaagccttgcaaa

SEQ ID NO: 471132 - DNA, 720 bp, Homo sapiens
ccacatagtggaatgttactcaccatgaaaaggaatgaggcactggagccatgggcaggcttgctcacagccgtggaagacaggaatgatgttttcctttggggcacagggcaggcaagctcagtgcctgttataaaaggctcgggggccctaagcccaggctcctcccatgccctgcagcagtttgcaggccctgcctggtcctcatcgcacaccccgtgggaactgctgcaaggtgctggggtgctggctcctgctggtggtgtgagcgacaacaccaagaagcctgggcagcagcccggactggcctggcgtgttccacctggggcagctgtgttgagcctggttgtgcctgtgaatgcgtataacagcagtccctctaatcggggtcagctgtctctgctgtttctaagcccggaaggcctggcccctcagtggagtgtgcacagtcaccagattgccgcccgcttgtggattaggctctcattcccactttccaattgcagcagcatgtgctcaggtggaagctccaatgtggagtgcttcaattatgcagacatttaagaacttattgtatattttcctcaacaattgtttatgccctttttgctgaagataaatattttatctcggctgtggaagtgacttcttcagcactgagctggatttacagcacaaagggaaagaaagctttgggtgggaaatgctgtgtgtataggc

SEQ ID NO: 471133 - DNA, 1268 bp, Homo sapiens
gacaccaaagccaaggtgctgcggcctctgcttcatgatgggcctgggtcgctacacctacctcgtgctaagaggtgagcacctggaatccagcagtcattatctggtacccagtggtcattacctggtgtccagtggtcattacttggtgtccagtcgtcattacctggtgctcagcgctcattacctggtgtccagcggtcattacgtggtgcccagaggtcattacctggtgcccagaggtcattacctggtgtccagcagtcattatttggtgtccagaggtcattacctggtacccagtggtcattacctggtgtccagcagtcattatgtggtgcccagaggtcattacctggtgtccagtggtcattacctgatacccggtggtcattacctggtctccagtggtcattacttggtgcccagagtggtcattacctggtacccagtggtcattacttggagcctagaggtcattacctggcacccagcagtcataaactggtgcccagtggtacccagtggtcattacctggtttccagcggtcattacctggtgtccagtggtcattacctggtgcccagcggtcattacctggcatccagcagtcattacctggcacccagcagtcataacctggtgcccagtggtacccagcggtcattacctggtgtccagcatcattacctgttacccagtggtcattacctggtgcccagtggtcattacctggtgcccagtggtcattacctggagcccagaggtcattacctgacacccagcagtcataacctggtgcccagtggtacccagcggtcattacctggtacccagtggtcattacctggtgtccagcagtcatcacttagtgtccagaggtcattacctggtgcccagccatcatcacttggtgtccagaagtcattacctgatgtccagcggtcattacctggtgtccagtggtcattacgtggtgccctgcagtcatcacttagtgtccagtggtcattacctggtgccctgaagtcatcacttagtgtccagaggtcattacctggtacccagtggtcatcaccttgcacccacggtcagttcctggtgcctggctgtcatctcctggtgcccagtggtcatcagtggccctcaggcttcacagccatggagacttttgcctgggaatattcttcagcatggagttttgttagcatatactaaaaaattcaaaaacaaaaagcccagcttgctgtgagcaccttttgtgagc

SEQ ID NO: 471134 - DNA, 1169 bp, Homo sapiens
gcagtctacacaatctaagcgccttctgcgtggagcagacaaattaacaaaacatcatgaaaccctcttatgaaaataccatagtcttaggtatggacgtgcagatctgtttcttccttagttatgtacccgtgcgtgttcatgcatgtgtacacatggatgtaaatatacataccaatctcccgcacacgccacacgtgcaggagagggaaggaaggcggctgcgttgtcaccagtcaccaaccctcctgtcccgctcctgggtgttccggtgcgaccctcagcctctgcacctgaggtcacctgtgccaactctcaccctctgcacccaagggcacctgtgccaaccctcagcctctgcacccgaggacacctgtgccaaccaaaaaaaaaaaactcaaaagaaaacctctgcacccgaggacacctgcgccgaccctcagcctctgcacccgagggcacctgcgccgaccctcagcctctgcacccgagggcacctgtgccgaccctcagcctctgcacccgagggcacctgtgccgaccctcagcctctgcacccgagggcacctgtgccgaccctcagcctctgcacccgagggcacctgtgccgaccctcagcctctgcaccgagggcatctgtgccgaccctcagcctctgcacccgagggcacctgtgccgaccctcagcctctgcacccgagggcacctgtgccgaccctcagcctctgcacccgagggcacctgtgccgaccctcagcctctgcaccgagggcatctatgccgaccctcagcctctgcacccgagggcacctgtgccgaccctcagcctctgcaccgagggcatctatgccgaccctcagcctctgcacccgaggacacctgcgccgaccctcagcctctgcacccgagggcacctgtgccgaccctcagcctctgcacccgagggcacctgtgccgaccctcagcctctgcacccgagggcacctgtgccgaccctcagcctctgcacccgagagcacctgtgcctccttcctttaactaaatgtgtttattaaccaaacgataaggcttttcccccaataactgaaactctgccatacccagaaccaggctcacactctcccagcccctcctgcccgtcccctgctgtctcccaactcccaccttcc

SEQ ID NO: 471135 - DNA, 1172 bp, Homo sapiens
atgggctcatgaggccgtgagcgctgtgagagcctcggtgatgacgtgcttccgtcacgccttctgtccgccgatgatgcgcttccgtcccgccttcgtgtccgcttccctttatgggctcatgaggccgtgagcgctgtgagagcctcggtgatgacgcgcttccgtcacgccttctgtccgccgatgacgcgcttccgtcccgccttcgtgtccgcttccctttatgggctcatgaggccgtgagcacagtgagagcctcggtgatgacgtacttccgtcacgccttctgtccgccgatgacgtgcttccgtcccgccttccccagttttagaaaggactatgtcttggtccttcttaatggtataaaagatatcctcagcccgccagatgctcctgcatttgagtgacgacacgcttctctggctgtgaccaacttttctccctttctttttaaatgacaggacttcttgttcaatacttgctggatatgaagatccaacccagtgcctcccattgcatccactcctcacaccaccgtctccatggcgtgacagttcctcagtttttctttgttgttcatgaccttcaccttttggaaaggtactggccagtcactttgcaaaatgttcctcaatttgtgtttgcttgatgttttctcctgattaaagtgatgcattttgggcaagaacatcataaaagcaacgatgaatgattttcaacacatcatatccagaggcactatatgtcttcatgcttccgtctttctgaaaaatggtgcatggatattaaaggaggtttttgcagaacgggatgattcggatcactatgctgttcagaaacaacgaacaaatgacaatctgctcctccccattcctgtgttgaaaccaggcactgctccgtacgtgctcgtggaaccagatggctcatcctcacttgtggaatgggagtggagttacatgtgtcacttctgggccaaagcagtgaagaagctgttggctattcccctgtctgtgtctgaatgcagagaatgccagagccaggaggggcgtggccgtgtgtacagcaccgatgctgataggaatagccatgatgggttgctaggtgaatgagaaacaagctcttcactggtgaagccaatgaaacttgaggacttatttgctgttgttttt

SEQ ID NO: 471136 - DNA, 853 bp, Homo sapiens
tttctagacctcacacctctgaaagcgtctctacaccttcaccttaactggtatgaaattccagcttggtatttgtaagctcttggtcgccagcatttcctctgtcctcccattcacttcctcctgcactgcagagtctttcgaggttttcctaacatggtcttatttccgaaagcattttggttctctgatggttctcagagcaatctgctttcagctcattgatgcacttttctctctcatgtctccagatactagtgatggttttcagttgttaccttccgaggagcctccatgtcctcagagctgtttgagcagtttgttcactgtggcctctctctgcgtggcagagggctcctccctgcatctgcctgtctttgctgtctgctcacattttagagtttatgcccctcaaacaatccctttattctcattgaagttgggctatgggtggatggagcctaatgcactcatccgacaccccgtcttcaactagacaccctgcccttctgcaagacaacctgtgcgtgtgccctggcagcctcagccaaaagcagcaggggagtcgtttcctggatgtttggaacaagtccatcaaagaatatttttgaatttctattatgtgcagaatatttgttatgtgacttggtcaaaactctaaaaccttctgtttcattatttcatatacagataacggtatccaagcacacagatattttgtgaagaaaataaatgactagacagaaaggaattatagaaaaaacattataaaaataccatctttagtgggacttcaatacgcctggacatttctacagtgctggtaaaagagaccacaagaagctgctttaca

SEQ ID NO: 471137 - DNA, 652 bp, Homo sapiens
aggatttatagttggacttaactggggaggagcagagaaatgggaacgagcatccggcacccttgtgcatgtaccctacaatgactgccaggcttggatggatgtccccactcctgacttggtctgccctgacaccacctgggcaatggggagagtgtcttcctacggctggggcgtgtgggagtccaggcttcacgcactctttgctgttcaatgtaggaattatcagcctttttgtgctggtttttccttatcttcgtggatttatctgcctttggtctttgatgctggtgaccttcagatggagtttttgtgtggatgtcctttttgttgatgttgatgcagttcctttgtttgttagttttacttctaacagtcaggcacgtctgttgcaggtctgctggagtttgctggagatccactccagatcctgtttacctgggtttcaccagcggaggttgcagaacagcaaagattgctgcctgtttcttcctctggaagcttcgtcccaaaggggcacctgccagatgccagccggagctctccggtatgaggtgtctgttgacccctgctaggaggtgtctccagtcaggatacatggcggtcagggatccacttgaggaggcagtctgtcccttagcagagctcaagc

SEQ ID NO: 471138 - DNA, 938 bp, Homo sapiens
ttcacagctctcactctccacccaggcatcctggttccagaagcagtcttcccctctgcaatgtctcagagccttccaggggactgcgaccctccacccaggcatcctggccttccaggggatgtcaccctccacccaggcatcgtggctccagaagcattcctcatagcccccatatctcagagccttccaggagactgtcagtttccacccaggcatcctggctccagaagcagtcttccactccgccatgtctcagagccttccaggggatgtcactctctatgttctttccagtgctccctctatggaatgaaacatccacaaagtgcatctgcagcttttcacaacgaaaggagaaggaagaggctggtgcacgctctgataatagtggatagtactatatgcaaaggttcttgtagaaagtactgtatgctaaggttctcgtggatggtactctatgctgaggttctcgtggatggtactctatgctgaggttctcatggatggtactctatgctaaggttctcagatggtactttatgctaaggttctcatggatggtatggtatgctaaggttctcgtggatggtactctatgctaaggttctcgtggatggtactctatgctaaggttcttgtggatggtactctatgctaaggttctcgtggatggtactctatgctgaggttctcgaggatggtactctatgctgaggttctcgtggatggtactctatgctgaggttctcgtggatggtactctatgctgaggttctcgtggatggtactctatgctaaggttctgatggtaccacatgctaaggttcttgtggatggtactctatgctaaggttctcagatggtactttatgctaaggttctcatggatggtatggtatgctaaggttctcgtggatggtactctatgctaaggt

SEQ ID NO: 471139 - DNA, 1746 bp, Homo sapiens
tccacctgtgttttgttgtccgtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgattttttttttaagcaagatttgttttactataaataagtggattatttcaatgcaggcaaaattgtgaagttctgttgggaaagatagcatgcttttcgtgtgcaagtacctgtcagtaataagccctttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaaaaggtaatgtttgtataatgtggttgcaaactcttaatttatactattgcacttttagtattttgtattagggaggtttgtctataatttgaaaatttaaaaaaatgtaaagtattttataaatagtacttcagtttaaggaaaatgggaaaactgttacagttccttgttttgtcttatggtcaaacaatattagaaatctctgccacttgaaaagccaccaagacttgtcagcttttcagtaaagtagggcctgccgtttcttaaattaaaatgatttatttaacttttccacaaagcccactttaaaactgtgaccgccccctaacgaaaccttggtgaattcatcctaggactatgacgtcagtacaagccaggaaggaactaggataaccttctgcaggtctgattttcatgtaagc

SEQ ID NO: 471140 - DNA, 978 bp, Homo sapiens
gcgtgagtcccggttgatgttcctgcatgggtgtggctgggctgtccatgtgaagtgggtcatgaccaaaccgtttgaaaaacatcgctgtatggatgcatcttttcctttgcgtctttcttttcttttctctcttctgctttgagccatcaccttgcttaggaaggattcacggctcggggtatgaagctgacactccttgtgcgggtgacactcgtggaagggagccgcgtgccgggtgacagcggcatagtcaacagcagatcacacgttccccgctgggcccatcagatcacagtggagctggaaactccccattgcctggtgatgctgggaccgccgcatgtagcacaaagggtgactcacatgtgtgtggagatgctggtgtacacaagcagactgcactgccgtgtttataaagtctacagccacgtccacaccctcactcacaactcacccaaggcagcccccagtcctgcaggccgtgttcatggtatgtttaggtgcataatacttaccattgtgttacaattgcctgcagtactcagttcaggcagtgcatgtctgcagccctgggccatgggccatgcttgcagccttggtgtgtataggctgcactgcccaggtttgggtaaggacactctgtgttgaccccacaaggacaaatcgcctaatgaccgatttgtcagaacacaccctcattattaagtgatgcctgactctttatgaagtgctcagagcagtggttgttatatagtattacataaatgttagtgataactttatgcaactcttgaatcatctattgcaccaatatttgctaagtttcttttttcattgtttctcaattttttttaccatttgctccatcccttaattatgtgtccttctttcaacattttatgttttgggtttggtttctagacaaacatttatatcccttcatattaaaattgtttatatggaaataaaaatatt

SEQ ID NO: 471141 - DNA, 1783 bp, Homo sapiens
acgtatctgcgctctgtgaatatacccttcttctacatgagaacatcctggctctacgtggacaaaatcttgttctacatggacacagccttgatctccacgggcccagccttgatctacgtgggcccagccttgatctccacgggcccagccttgatctccatgggccctgccttgatctccatggacacagccttgatctacgtgggcccagccttgatctccatgggcccagccttgatctccatgggcccagccttgatctccatgggcccagccttgatctacgtgggcccagccttgatctccacgggcccagccttgatctccacggacacagccttgatctccacgggcccagccttgatctccacgggcccagccttgatctccatgggcccagccttgatctatgtgggcccagccttgatctccacggtcaccctttgtgacacccaggcagtcaacatgctgatgaaaagctgtgaccgaggtctcccacaaacagcaggaggacatgcaatgcacccgcccccccagtatgtcctggacatgggttgggaggtggagaactgcggggctcgggaggtgcagacccgcggtgtcggtcatgggctcgggaggtggagacccactgtgtcagtcataggctcgggaggtgcagacccgcggtgtcggtcatgggctcgggaggtggagacccgcagcgtcggtcatgggctctggaggtgcagaccctcggtgtcggtcatgggcccaggaggtggagacccagggtatcggtcatgggcttgggaggtggagacccatggtgtcagtcataggctcgggaggtggagacccacggtgtcggtcatgggctctggaggtgcagacccacggtgtcagtcatgggctcgggaggtggagacccacggtgtcagtcatgggctctggaggtgcagacccgcggtgtcggtcatgggctctggaggtggagacctgcggtgtcggtcatgggcccgggaggtgcagacccgcggtgttggtcatgggctcgggaggcagagacccacatggtgttggtcatgggctcaggaggtggagacccgcggtgtcggtcatgggcttgggaagtggagacccatggtgtcggtcatgggcattgctctacctgggtgccctggccagtggagttggaggtccagactgggcccggacagacccacacgttcgcgagtcctgacaaaagccaccgtggtcaaatgcacgagcactcgagggccagcgcgggccggaaggaagtcccgccactccccgccttgttcagtgttacaggaggtgttgagtgaatcatccaagacatcaaagaaatcaggcgcagggagcatccagagaactgaagaaaaagagaaaagcagtccagctgcacaggcagagctcgctaaagcagctccaaaccccgcaccccgacggcatcctgtctaggctgactcttgccttttactttgggaatgggaagatggggggaaattaggactcctcagtttgttctgtttctttttaggggaggacagcacttgataggtgtaactaataagtgatcaatgaatgctagtttgagtacatgagcaaattcagataaactccttgaaaccagtgtccagactctcatatattcataactcagcatcctcacacctcatgtgtttcttgacataaagtttatgcatttgaattaaaatggtagttttagtgacatcactgaaattaataaaacatcttttggataccgcgttgacct

SEQ ID NO: 471142 - DNA, 3803 bp, Homo sapiens
acttttgtccccagaaaacccctgctctaactgtgcatccgtccagctgctcagaacgctcttccagggcaacctcacggcagctgccccatcccccacggtggcacccaaaacacacctgccctgctctccaccatttgcctgggactgaggggtttcctgggactgagggggttcccgggactgagcggtttcccgggactgaggggctcctgggactgaggggtttcctgggactgaggggtttcccgggaccgaggggtttcccggactgaggggtttcccgggaccgaggggtttccgagaccgagggggttcccaggaccgaggggttcctgggactgaagggttcccgggactgaggggttcccgggactgaggggtttcctgggactgaggggtttcccgggactgaggggtttcctgactgaggggttcccgggactgaggggtttcctgggactgaggggtttcctgggactgaggggtttcccgggactgaggggtttcctgactgaggggtttccgggactgaggggtttcccgggactgagggggttcccgggactgaggggtttcccgggactgaggggttaccgggactgagggggttccgggactgaggggtttcctgggactgaggggtttcccgggactgaggggtttcctgactgaggggttcccgggactgaggggtttcccgggactgagggggttcccgggactgagggggttcctgggactgaggggttcccgggactgaggggtttcctgggactgaggggtttcccgggactgaggggtttcgtgactgaggggttcccgggactgaggggtttcccgggactgagggggttcccgggactgaggggtttcccgggactgaggggttcccgggactgaggggtttcccgggactgaggggtttcctgactgaggggttcccaggacagaggggtttcccgggactgagggggttcccggggctgaggggtttcccgggactgaggggtttcccgggactgaggggttcccgggactgagggttcccgggactgaggggtttacccgggactgaggggttcccgggactgaggggtttcccgggactgaggggtttcctgactgaggggttcccaggacagaggggtttcccgggactgagggggttcccggggctgaggggtttcccgggactgaggggtttcccgggactgaggggttcccgggactgagggttcccgggactgaggggtttcctgggactgaggggtttcccgggactgaggggtttcctgactgaggggttcccgggactgaggggtttcccgggactgagggggttcccggggctgaggggtttcctgactgaggggttcccgggaacgaggggattcccgggaccgaaggggttcccgggactgaggggtttccgggactgaggggttcccgggaccgagggggttcctgagaccgaggggttcctgggactgaagggttcccgggactgaggggttcccgggactgaggggtttcctgggactgaggggttcctgggactgaggggtttcccgggactgagggggttcccggggctgagaggtttcctgactgaggggttcccgggatcgaaggggttcccgggactgaggggtttcccgggactgaggggctccagggactggggggttcccggggctgaggggtttccgggactgagggggtctcttgggactgaggggtttcctgactgagggggttccctggactgaggggtttcctgactgagggggttcccgggaccgagggggttcctgggactgaaggggttcctgggactgaggggtttccgggactgaggggtctcttgggactcaggggttcccgggactgaggggtttcctgactgagggggttcccgggactgaggggttcccgggactgaggggtttcctgggactgaggggtttcccgggactgaggggtttcctgactgaggggttcccgggactgaggggttcccgggactgaggggtttcctgggactgaggggtttcccgggactgaggggtttcctgactgaggggttcccgggactgaggggtttccaggactgaggggttcccgggactgaggggtttcctgactgaggggttcccgggatcgaaggggttcccgggactgagggggactggggggttcccggggctgaggggtttccgggactgaggggtctcttgggactgaggggtttcctgactgagggtgttccctggactgaggggtttcctgactgagggggttcccgggaccgagggggttcccgggactgagagggttcccgggactgaggggtttccgggactgaggggtctcttgggactgagggattcccgggactgaggggtttcctgactgagggggttctcgggactgaggggttcccgggactgaggggtttccatgactgaggggtttcccgggaatgagggggttcccgggaccaaaggggttcctgggactgaggggttcccgggactgaggggctcccggggctgaggggtttcctgactgaggggttcccgggactgaggggttcccgggactgaggggtttcctgggactgaggggctccagggactggggggttcccggggctgaggggtttcctgactgaggagttcccgggactgagggggttcccgggactgaggggtttccgggactgaggggttcccaggactgaggggtttcctgggactgggactttcagtgcgcaacccaggaaagtccccgacaaacttagtccaagtagccgccgccttcctcggcacctttgtgaaatttccgacctcgcccaaggccgattctgctgcttcctcttccctggcctgcctgtcctcatctactcacggtcgtgatctaacagggtgcacatttcctgcgtgtccgcccgtcttccttcaccagcacacgagctcccagcaagcagggactttttcctgctgtgctcagagccttctcctcggctgctggtcttgtgccaggcactttgttggagttcaatcaatattcctcaagtggacaaaagttggtattataatccctctccccagggtgcattcaggccaccccaaaccaggcaggggctactcagaaacaactgatcctcctctgacacaaaagggcacaccttccgggatttgccattctcgcagaatttctcctgatgttcgagcctccatcgtggtgtgtcccaggaggaaggcaatgctcctggaggacccacgtccagccccggagctgccctcctgggttcagatgcctccgcggccccagctccccacctgcagcaaacacctgcacacaggtcccccacacaccctctggccctgcagtcccatcctcagggttgtgcacacaggtgcccccacacaccctctggccctgcagtcctatcctcagggttgtgcacacaagtgccccgtacgcaccctctggccctgcaatcctgtcctcagtgttgtgcacacaggtgcccccgcacgcaacctctggccctgcagtcctgtcctcagggttgtgcacacaggtgcccccgcacgcgccctctggccctgcagtcccgtcctcagggttgtgcacacaggtgcccccacacaccctctggccctgcaatcctgtcctcagtgttgtgcattctgaaggataagtgggagggggcatgtcctgggacccccatctgcaggaatgtgatgagcttcaggaagggcagccatatgaaagcctccctctatgaaaaa

SEQ ID NO: 471143 - DNA, 771 bp, Homo sapiens
ccatcgtcatagaggaatgtccatagaaggacttccatggaggatcttccataaacagacttcgatagaggatcctctatagagggacttccatagagggaattccatagaggatattctatagagggacttccatagagggacttccatagagtacttcaatagagggagttccatagaggaccttccatagaggacttccatagaggacttccatagaggaattttcatagatggacttccacagagggaatcccatagaggaacttccatagatagattccatagagccatggcggttgtcacctgtggtaaacagaatggcgggagcaagcgggatgtcctcgggcgcgtgccctatccatgaacgtggtgcagcctgcagtgaccaagatgctggaggtcgcgactgggaggtgcaggttcccagggcctggacttccatggccccagggcacaggcagcatgatgctgagagagctgctgtttacaaggtgacgaccacatcctggcctaaatgcactcccgtcccagggcccacacttggtccctggggccagctcggtgcaggggcccaggtatgtatcatcttagtgtccaccagagggaagctttacccactgtgcaggaatcactgggcagccacgggcccgtgggctcagtcggcctctggtatggtggacacaggaactagaaggctccaacttaagctctttcttttaatctcctaaaatactcctgggggcctccatgttttgagtattcattcac

SEQ ID NO: 471144 - DNA, 1197 bp, Homo sapiens
aagctgcagtgatttgttgtagcattgctagaaagccacaccagcaaggagttggcatggggcatggtgcaggcagccctgttactctggctgagcctacatatgcacatcctcccagctgctaagggcttgggcctggggtcagccctggtgctactggccctcggagaagcaacacctgcctctgcaggctgtcaccacaaggtgcagaaaacgcagagtcctgagcttcatgagcacagccctctgaggggttcctgctccttcagacccaaacccagcaaagctgagggctatgaagagaactccaaaggcatcagagatggagcccatggcagagatagatgtctccatgggacccaggccattcttcctaggtaccagcaaagggcaccctcagattattctggtagtgatccagtcacagtccacagaacactctttggagtcactgattcacggatcatgacaatgagcggctgccccacatgccttccagacactgtcttcccaagtactctcggcagcgggaacccacttcagcagaggagatctggagctggcttttggacacaagggattttagatgacagagaaacatccaaactgaaagtggcccagctgctagatgtgatgacatacatggggaatgtggccggtctaacatctgatggtctaatgaacggtctcacatctgatggtctaatgaacagtttcatgtctgatggtctaatgaatggtctaacgtctgatggtataatgaataatctcatgtctgatggtctaacatctaacatctaacgtctacccgtctaatgactaagggtttaacatgacgctaaccctacaggactcctgtcctcacgagaagaggagaggaggacacggacacagaggacagccgagagatgaaccagggagggagagacgtctgaaagcccaggagagaggcctcgggaggagccaccctgcccacgccttgatcttggacttctgcatggagagctgagaaagttagcttctgttgtttatgctgcctggtctgtgggatgttatggcaaatcctcaggagacttgcacactaggggccactgggctggagccagagaaccacctaccagtctatagttgttctggaatctagcgaaggactgccgagtgtcagaggcagaagggagagcttggggtggactcacc

SEQ ID NO: 471145 - DNA, 685 bp, Homo sapiens
cagcaaaagtcaggataagcaaacaggatgcagaggaggggacagcccataaaacggaataaagtttcattattgggaaatcaaaacttaagcaggaaaggggaccggggcgacatccgggaagattgtaaccccacagtacttgatcagtggggaactggaggagggacttgcgtgctaggagataaattacctgctgtagctgccgcagttctagaggctgggagtccaagatcaaggtgccagcaggccggtttcttcggaggcctctctgtgggtgaaagccgtctccccaccatggctgcacatggcgtttcccctgtgtatgtccggtcttctcatgaagacaccagccagactggaaaattgggctttcaggctaggttcagaaacttaggctttcagaattttgattccaatgcctcgggccatgttctctgctctgatcctgtttagtttttggagacttttgaatctgcaagctcatgttttctgccggatttgacacgctttctcgtgtcatttcctccagcacgattccgtgtcccgatcactcttgtctcctggactccagcggccagtctggtctttcccgatcaccccacaggcctctgagccccgttcactgttgtttccttgctccttttccatgggtggtgcttattcatctgtgcttgaggctccg

SEQ ID NO: 471146 - DNA, 639 bp, Homo sapiens
agccttcggtgactggctgctgggtgtttcccgtagatagagtcatgtgtcatgatgacttttgagaagggccagattcccaggtcaaaattgcccctgagaagttgggtgaaagccagaggttttatcaaaagcctacctgtggaattaagtcacaaatggagtcagatggattcctccttcactccctgcccgggattacggcgtcaggaacctgcatgtacatctggaaggcatgagggtgaacttgaatccaagttgggctcttaccacctgcgagcctctgactgtgacatgcaggtaacctgtgggagtagtggggaccctgtgtctcaggttcacaactacctggccgtgggcccagaggatgaagcaggagaggcagcaggcagatgtagctgttgctatggcaacaagggacccatctatcttttatttatagatttctgagctcttttttctttgagattaatgtcaaagttttttcaaggaatgcattcttgtctgtgttgattcccttctagagtatgttcactttatttggggttaatttgttgttcttttttaaaaaaattagatggatgtatagttcattaatgtttcagtatttctccttttctgatacgtatatctaagcct

SEQ ID NO: 471147 - DNA, 552 bp, Homo sapiens
gtgacgttggcaggcaccatcatgtgtgccaaagcggcttgcacccatgaagcagggaggcctaggggctgcagctggagattgctggtaggttcacaggaacaagcaggccagctggctgtgtgggacccttgggccatgggtcccagccccagcaaggagcggggagcagtggcaagccggctgctcaccaggtccatcctgaaaaaggaaggaatttcctttccactggttctggttgtgcacaacctactattcaaggctcagcccaaagtaccatgcctccaggtggtccccttggccagcccagccctgggccctgcttccaatgcttgttctggccccttcgaagttcaggtggtcatcatcttctgttcactggtacttaatctcctcatccagactgtatatggctcaagggcagagaccaagtctcaatctggaggctatttaattagcaattgacctggcaagaagatttctttgcccaagccaaataagcacagaaacagtttaaagccaagctatctgcttcagtaactggcaggatga

SEQ ID NO: 471148 - DNA, 542 bp, Homo sapiens
tcgaagacattcgaaatctcagtttgaggttggtgaaaacgaagatgaattttttccccatctgtggtttttgggtcatctgggaagaagatgccaaaatgaaattaggcactgaaagctttcctgatgggggtccctgtgagcagggccgtgcaccggcccatgacggaactctgtttagactcagttccagactcctcgtctggggaaaggtggagtttgcacacatgcaggccctggaaggcctgagaacagctgtggctgccaggcaggaacgaaaacgtggaaacgtggaaacgcgggtctccggccgtccagctttcgcgggccccgtgttcttcccttcagtgaaaatacgcttatacatgcggctccttccctctccagaaaattgtaagtttcgtgtgctctgtttctggcccttgcgtcgtgctcggaaagggcttctgcagcctaagaccatgaagagacatggcgagttctaagcaggtggatgaaatgagtggggtgttaccctgcctgatcctccgggtgaaatgtcc

SEQ ID NO: 471149 - DNA, 557 bp, Homo sapiens
tttgcctagaaaatggctcgagatgctggagagcgtgctggattcctccttccgtatcttcacatcgcgtgtgacttggtgcaaaactcagtgggtgcccacttgggaaagagggctgctttctggtggcccacgctgtccgtgtcccctggctgtcatggcaaacagaagaaggaaaaggcgtttcaaggccattgagtcgatgccaggaggattttccaagcagggttcttatctaggaggatgtgaattgaggattttggcaaaaacagaaacctcagaagatctcacggaaactcacaaccgtgacgacagtgccaaggggatggtattaaaccacaagaaaccgccccatggccccgtcacctcccagcaggccccacctccagcactgggggtgacagctgagcatgggattgtggagagctggtgagcacactttccctaggggacagctaggaggctcacgagtcgggggggcagggtgggaaaacactttcccccctttttttctttccttctccactgtccagcaggcctgttgtccctgcaggccc

SEQ ID NO: 471150 - DNA, 596 bp, Homo sapiens
catgtgagaggatacgtgactgatgaaactcatacagatgaggagttgcttcttacggatgagcaaagaaagtagtttcttgaaatggaatccgctcctggagaagatgctgcgaacgtcgtggaaatggcaacaaaggattcagaatgttgagaaccgactgcatttggaggcaaacggaggcaggcacgagggttctggaaatgaagaccaggtccatggacgctcaggctgcctttcagcgacttctaattgttggacaccccggagaattctacatccggccacagatgacagagtgggccgcctggtgtggctggaacctctagggggctgcagaccctgcgtttgctcaggccgaattcattcaaacattaactgattagtcttcattgtgcgtggtattctctagaatcgtgacttgttggtgaaagctgggaaataatttggactctcagaccgagttcaaaattgaccattgacttagcagcctttaaggtgctgtgaacagtgcagggcacttcagggacccctggagcagctctgttacttaatgggcgaagacacgttttggcgagatttgccgatccgctctc

SEQ ID NO: 471151 - DNA, 2440 bp, Homo sapiens
tgctctctggaagggacccttagtgtcaggacttcctccagtgggtgattgtggggagtaagcccaataaccagttagcacttcctccagtgggtgacgatggggagtaagcccaataactagtgagcacttcctccagtgggtgacgatggggagtaagcccaataactagtgagcacttcctccagtgagcagtgagcacttcctccagtgggtgacgatggggagtaagcccaataactagtgagcacttcctccagtgggtgacgatggggagtaagcccaataactagtgagcacttcctccagtgggtgacgatggggagtaagcccaataactagtgagcacttcctccagtgagcagtgagcacttcctccagtgggtgacgatggggagtaagaccaataactagtgagcacttcctccagtgggtgacgatggggagtaagcccaataaccagttagcacttcccccagtgggtgacgatggggagtaagcccaataaccagttagcacttcctccagtgggtgatgatggggagtaagcccaataaccagttagcaattcccccagtgggtgatgatggggagtaagcccaataaccagttagcacttcccccagtgggtgacgatggggagtaagcccaataaccagttagcacttcccccagtgggtgatgatggggagtaagcccaataactagtgagcacttcccccagtgggtgatgatggggagtaagcccaataactagtgagcacttcctccagtgggtgacgatggggagtaagcacaataactagttagcacttcctcttcaccgggtgatgaccggcgagaaagccccctgtttattcagcacttcctccccagtggatggtggtcatggagtaagcccactgttggtgatgattatggagttagcccactggctagttagcccttcctctccagtgcatgtggatgagggagtaagcccagtcattagcactttctccccagtgggtgatgatgtgggagcacctgtgatccaggtagatcccatcctgttctcatggagctcagagtttggtgatgataaaggcccagaaatgaaaacatgcactttgtgctacctggacttgcatttccagtgccctttacacggtgaaaaacgtgaatacaagccatcagtagaaaaagaagaccctctgaaacaggaatttccaagacagtgcattgaggaagtccaaggaggaaaggatggggaatagaagacagcagcgaacaggactggggactgtcacaggagccagagaaagggctgattctaagaggaaggagacaccaaaaatgtaaaagggtgcaaaaatactggagagaggaggcctttatgatggccactgggtgggggcattggcagccaccaaggcctctgagagagcagaaaatgtggttccaccaaacactcttctggaacctgctcttttttttgtaaggctttgaggaacctccatgctgttttccatagtgggtgaaccattttacattccacagcaggtgcaccattttatattgcatagtgggtgcaccattttacattccatagcaggtgaacaattttacattccatagtgggtgaaccattttacatttcatagtgggtgcaccattttacattccatagcaagtgaaccattttacattccatagcgggtgaacaattttacattccatagtgggtgaaccattttacattccatagtgggtgaaccattttacattccatagcgggtgaacaattttacattctatagcgggtgaaccattttacattccatagtgggtgcaccattttacattccatagcaagtgaaccattttacattccatagcgggtgaacaattttacattccatagcgggtgaaccattttacattccatagcgggtgaaccattttacattccatagtgggtgaaccattttacattccatagcgggtgaaccattttacattccatagcgggtgaaccattttacattccatagcgggtgaaccattttacattccataatgggtgaaccattttacatttcatagcgggtgaactattttacattccatagcgggtgaaccattttacattccatagcgggtgaaccattttacattccatagcaggtgaaccattttatattccatagcgggtgcaccattttatattgcatagtgagtgaaccattttacattccataatgggtgaaccattttacatttcatagcgggtgaacaattttacattccatagcgggtgaacaattttacattccatagcgggtgaaccattttacattccataatgggtgaaccattttacattccacagcaggtgcaccattttacattccatagcgggtgcaccattttacgttcctgccaacagtgcacagtggct

SEQ ID NO: 471152 - DNA, 868 bp, Homo sapiens
gattactgttcctgtctagaccaggaaactcaagctcaaggccctgcccggtgtggcacaactaatggatggtcaagaccgaggctgcctcaggtcctccagccccagccccgctctccctgccactcatcagcctctcaaaagcagggcctctcaaaagcaggaagagtacacagatcctcatcctccttggggccatgctgttcttggcatctttcacagccactgctctgatcaccttggcatataaacttcctgtcgtggctccatcagaaaccaggacttcccggggagggctgctgaatgccaggctgttcaccctgtgccctttggttcatggaaaaagtgggtatgaaacttttggtctggatgggaaagctgattgccttcttgcttccaaacttctgaacctttcaacctgcactggtgtctgtgcaaatgtcaccttctcagagcagcctttgccgatcttccaaaataaaatggccagaaccgttcctggtattgaagaggcgattgtattgtatttcgtggagtactacacaaagccctactgccgatttgggccagttcttgtgggcctctttctgagcatttacatgcaccaaaaccaccaggaaaacattctcagaaccaaggaagtctttccttatccttccaggccaggctgtgtccttctttttggttcctctgtgcactgtatattcctgggccctggctttgtgggtaccttacctagatgttccagagaagaggccctggtccttggaaaaccttgtgttgcccatgggaggaagaagagataagattttaccgaaaggaatgaatatacagaagctgtgtgactttttctataggttgcagttac

SEQ ID NO: 471153 - DNA, 562 bp, Homo sapiens
aactgcctgaaaatccactttaaaatgaggccccatgctcttaggaggtggcctccatgcttatggtggcttgtttatggttttccgggtgtttgacttccttgatggtacaatccagtgggcccggtacaggaacaatgtcaaagactatctcagcaatgaagaagaggcctttggcaccagcttgaacagtcagagatcacaaatgactctggggacacttaggataaaaagcaatggcctccaggcccttcactggcacttcaacgccagtgaacatgactgtcttgctcagcaacaggatgtgaagaagtccatctattccagtcgtccagggatattgcttctgcttctgagtgtcttcgtggaagctttggaagggaccctgagagtacgaagtgaaagctataataaatcggaaaagggcattgtgatttttcacaaattatatttcaaggattagactttactttgtcatgtttgtgtgtgagcatttgtgtacaaatatagtctttaacccttttaaggaagattgttaggatgttgctatcctagaaggatg

SEQ ID NO: 471154 - DNA, 522 bp, Homo sapiens
cttctgaggaatggcagaggcaggagagtcaaaaccaagggaagctgagtgtttgaagaagggagtggaatttcttattttgtccaaatggacccaatctagtcttgaccagtggaaggttcctgctatttcttctgaggccacaactgcctttgccaatgcctcatcagggcctgaagcttatacctcaccatggattcccatgacagcatggggcaagggagtcctcgggacccaagacaaagagtgggaagggactgaagagatgtggaagagactgcagagatgtggaagagctcccgtcaaccctactgcagacctggaccgaagtcaaagcatgaacatggggctggcagtggcagcaatgggtgaggggaggcttcccacagtacatgtgcaagtgtgctgctgccctgctgctggagagggtggtgttgttgccagcaacttgtgcttctgccctggggcagcagccagcagcagaagtgatgactatgagtaggggggcttgctctcagggag

SEQ ID NO: 471155 - DNA, 1212 bp, Homo sapiens
ttgaagatcttggcaggaaagaatctgaggagctaccatgtctatgaactcatgcaccaaagatgaaaattccgtgctccgggacgaactgctgttcctgggcggcccggctagctctgcctacgcgctcagccccttctcggcctcgggagggtgggggcgcgcgggccacttgcaccccaagggccgggagctggacgctgccgcgcagcccgagggccagctgctccgggaggtgcgcgtgctcggggtccccttcatccctcgcgcccgggtggatgcgtggctggtgcacaccgtggctgtcgggagcgcggacgaggcccacgggctgctcggcgccgccgccgcctcgtccaccggaggagctggcgccagcgtggacggcggcagccaggctgtgcaggggggcggcggggatccccgagcggctcggagtggtcccttggacgccggggaagaggagaaggcacccgcggaaccgacggctcaggtggcggacgctggcggatgtgcgagcgaggagaacgaggtactaagagaaaagcacgaagctgtggatcatagttcccagcgtgaggaaaatgaagaaagggtgtcagccctgaaggagaactcacttcagcagaataatgatgatgaaaacaaaatagcagagaaacctgactgggaggcagaaaagacctctgaatctagaaatgagagacatctgaatggggcagatacttctttctttctctctggaagacttattccagttgctttcatcacagcctgaaaattcactggagggcatctcattgggagatattcctcttccaggcagtatcagtgatggcatgaattcttcagcacattctcatgtaaacttcagccaggctatgaaattgtcggcatgcctgttgattctttcaatagcatgttaagtaggtattatctgacagacctacaagtctcacttatccgtgatatcagacgaagagggaaaaataaagtttctgcgcagaactgtccttacatggacagatgtttaggacttcaagatcacacttgtgggaaatctgggggagccacaacttttcatgaaatgcattgtatacaaaattcgtagttatgtccaaagaataggttaacatgaaaacccaataagactttccatcttggcagccatcctttttaagacaattttgaaatatacaatgcattaactat

SEQ ID NO: 471156 - DNA, 638 bp, Homo sapiens
tagggatctaagttttaaagaatgctggtaaggactcttccaattatagacaatctgaaacgcaaattctggaaatccttctatagattcttaccgaggaatcctgtagtttccttggttggtcaatgctcatattattttttcctagttgaaaacaagaccattagtttggtcagtagaaaccatggcatgcacactggtgttacagtaaaagtaggtcacaaaccaagaaagttagtaatggaaagcaagtcaggaagtttgagctatgtgttctcctgtggccttagaacatccattcagccattccacaaatatgcccggacccccagtggagttgcagcttttgctcctggccttggggattcagcagagaatgctcctggcaagtttcctaccctcgaggtgctcactctagggcttattcttttggggcctcattgtagttccatattttcattcattcgttcataacatgcttgttatgtgctagtgttagacactgaggattcttgttaaaagacaggagtcccagtttttaaggatgcagccctgtaaatagatagttactctgcagagaatttctgattcccagttggagaactgttacagctctctcagtcccctgctgttctttt

SEQ ID NO: 471157 - DNA, 548 bp, Homo sapiens
tcctgcagcagggctgggcaggcggggtatggtggtgcaccccactgggggtgtctgggaagtgcagagcaggaccactctcagctcccaggcgggggcccagcaccctgagccttcccaggctgcctgttttagatgcttttcagactttcatattctgtctcctactcctgaacttccctggaatgacaccaagttgtatgaggggtttactgtgtccttgaatggggcggggacagtgggtgctgggaaatcagtcccttgggacagggggcccggccaggatgctaaaatatctcaggctcctgagtggctggatttccctaggaccctcagaccaacagaactcagaccctcagacctacgctggggcccggtgaggaaacaggcccggcttaccaaaacttgcagctgtaaggcccaactatttactccttcaaataaagcaagattccaagaataagtatgaatgttttgttttgtttttcactgaaatattccggtctgtagctactccaaatcacactaatctttctggagtctggtat

SEQ ID NO: 471158 - DNA, 798 bp, Homo sapiens
gtccagttcctcccggctccggccgctgagcagcttctggagcagctgcagcttgccgtcacgggcggcgttgtacacggcggtgcgggggtctttggttcgggcctgcgccaggccatgagccggccgcagggggagggggagacagaggatcacagcccagacaggcgggagccaaccttcacggtctccctcgccgccatcttagggtgtcctagagacttttaaatatgcagattattgacctgagaaaccatttcgcaaacgatacggtgcagcaagtgaaagagagtgcgggcatggactgggagtctgaaagacatcccaggttgaaagctacccagggctccaagtattcacagacacagagtgtgcattctgtctccagtgtcaaccaccaagattctgtgctaggaatcatgctttcaggagggcttcgaggagaaattctcaacaagccttttatgtctccttgtccatcattcagcatccaattccaactccatgcttttccttacttccaacttccatttttgccccgagcaacctgtgcaggaaaccatcagtttccctgctccactggacatctaaagactatggtggtgatagaaaatgagagtcatcaaaaaggtccaagtttagtgaagatgcgcaaagggaaccagcccttcccaaagaattcagtgaatgagccaagattctccagaaaccgctcagctttgcagtgataattttctgtgaagacatagactgaaatgggaataagagatagaaagttgaaaaagaattttctcagaa

SEQ ID NO: 471159 - DNA, 626 bp, Homo sapiens
gattggcctacgatatgaccgttgacactgagacgttcctgcacgtagacccgcatcaggacttgttgcaaggacttctcgaggctgtggtattccagatccgccaccagcacgggatagtgacctggcaacggccgcctccaccagcaaacagacgccagctcctgcagaatcaaagacaaacttcaaatgctgagaatgtcaacttcatccagtttaatacttttatatgtgttgccaagaaagaaattcccagaagcaaaaatgtcaaaataatctttggtgatagagctatccagtggaatggctcatccaggggaaaggggaagcctgagaattctagagcaggatttcccagtcctgaagagggggctcctgaattacgatatgatccagcagttccacttctggatatatacccaaaagaatttaaagcagaaactcaaacagatatttatgcaccaatgttcacagcagcattattcacaatagccaaaaggtggaaataacccaaacgttcatagatgaatggataaataaaaagtagtatgtacatatcatgaaatagtctttaaaaggaatgaaattctgacatgttacaacgtaaatgaaacttgaattatgct

SEQ ID NO: 471160 - DNA, 644 bp, Homo sapiens
ttcaagcatttcctatacttggagcttttttctttttggtttctaaaactagaggaaaaaggtttaccaggtatggttggcagaacaaggggcccccaaagatatccacaccctaatccccggaacctggagtggttttgcacagggtggagccatgatgagctgggctttggggtgcctgctgcttcctgcattcctgtgggcaggcccagtctacaccgacatcgggagaccttcgtgcctggtgtccatttccccaactctatagacttctcccctcctgggtctgctgcctggagtccagtcaccctgggtcccctcatttcccagtccagctccctggtgcagtctggggctgttaagatgcatactttcctgtttgctgtacatggctgtttagcagaagctgcgctgggattggagcctcggtctctgtcctcaaagcccacattctcacctactacaacaccttggcaggctgcaggtggacagaggctgttaagtttccagcagagcctattgcccaccacaggatgttcttggaaaaaccttgagcagtcttgtgcttcctaaactgtggttggcacagccttttctttaaaagaaattttatctggaaatgttattacttcaccttcattctt

SEQ ID NO: 471161 - DNA, 742 bp, Homo sapiens
gactcagctgcaagggagtcaagggaacatgactttttgttcccagaaggaacaaagaaggacaccagaaggaagttggaataaacactgcatgctaacctgctgcccccaattctatggtgactctgattcctcctggggagatccaggaaagcctcctaaaattgcttcccagcctccgacgcagggtggtatattgccaggcagagaggagcaaagatggatggccttccagttaggagaaagcaaccagggtgtgatgtgggcaggagcagggaccctgggcagcgatggggccaggatggaggctgggctaaatgaaaggggcatttcaccacaggttacagagttgcaattttacttaatttgcaataagagactcacagaaagttttcaggaaatgatacgatttgctgtgtacctacatcactcactgctagcatattctatgctagctctgagagccaaagataacaatcaaagagatctactgagaaactatcactataatcaagatagaacatatcaaaagcctatgctaggacagtggaaagaaggaaaaaaggtttgagaaactcagaaatagaatttccatggtttggtcagtgcttgaaaggagctgaaactggctctcaaatttgaagcctgagcctctgagagaatgaatgcagcgcaggaatggcattgttaacaaggtgcaacactatttgcatgcaagaggggacttcagtacacccattcc

SEQ ID NO: 471162 - DNA, 559 bp, Homo sapiens
cagtgggacctgactgaattatgggggcggatctttcctgtgttgctctcatgatgctgagtggagacttgttgaacggctttgcccaaaatgctgatagcaatatggacaataaagtccaggcggaggtggtcttagatggagatggggaacttgttggcaactggagcaaaggtgactcttgttatgttttagcaaagagactggcagcattttgcccttgccctagagatttctggaattttcaacttgagagagatgatttagggtacctggcggaagaaatttctaagcagagaagcattcaagaggtgacttgggtgctgttaaaggcatttggttttataagggaagcagagcataaaagtttagaaaatttgcagtctggcaatgtgatagaaaagaaaatcccattttctgaggagaaatccaagctggctgcagaaatttgcataagtaatgtggagccaaatgttcacactcccacccagtatctcccaggtactctaaatggggtatggaagtgaacctagggagccaagtgtgtaacatgggggga

SEQ ID NO: 471163 - DNA, 1127 bp, Homo sapiens
gtatataccacatcccgcacccccacacaacacagtcacactctatacccagagagtctcacatgtagcacccaggttgtgtcctacacaagggtgcccagctgagggtctgaggcagctcccagggtcctggggcagggctgggcacctggagggaggaagggtgcctcctaactggcatgaaggtgccctgtgcactggctgagactctggcacccatgaccacagagcactccccacccaactccagtcctctctggacgccaggaaaagtggtcctctttttggggtggggacagagtagcaagtccggggcagagcttggtgtcttcatgatctcccgcaagcacctctccaagcccatgggccacccacagtctagactatccttccccttcttctgtgactgcgtgcacagtacagcttatctcaccttcctgcttcccttcctccccaccgctaactgcccaggaaatccctctcactcactgttcggcacccagctcacacatcacccctcctctgtgtgtctgctggccaccctcccccagaaccttttgctccctagagagctgaggaacttgttggatatggagctgggcacagcaaaatctccacccccagctcagatggaggagaaacctggtgctccaataaaggaatacagatacccggtttgtaaagtctgctctgctctgactggcgtggtggagtgtggctctctgctgcttgcctgtgaccctgagcgttttcctcccctggtttcctgcacatttttttccagtcatcccccagccgggcctgcagagctgccactgtccctgcagcctgcacgttccccagccctggcagcaaccactggggcaggaggtcctgggctcctcagcccctggaagaccctgcgccagccccgactctagacatctgagctttcgtgctgcaggcctggagtttaagaagacatgaggtgaaagtgtgagagctaagggaaggtcctaacccctaagattattttccacgaacgggacaatccaacagctctgattgaaagtaaattggcctttctgcaattctttttttcttccttcgaccaaatatgctctcttctgtttttccccctccacacc

SEQ ID NO: 471164 - DNA, 2258 bp, Homo sapiens
ctcccatctccacatcctgctccccaggtcccagcgcctctcccacccatcagcccttgatacacagaggagggacccacatggagcaggtggtggtgatagcctgtgcctgtggctggattctatggtctgccctaacaaggcacagctcaggaacccaagagctgtctgtgatattgaccaagggcccttcttggaaacctccttgtggccaggcccagaaataggatggcaggagaagccgccagacctcctaggcatgggctccctttcagaatcctccaagctggcccagcaaacaccccagccagaggaactggggccctttgccccttcatggtgttcgcagcccctcatcacccgctcccctggaaggcctgctgaaatgcagatgccttctcctcctcctgggcaccaccctgaactgaccctacccccccagacactgctgcggcctggctgccctggggagggcaggccagggccagcaagacctgggagcctctgcggcccacgacacctacagttttagaatctggagagcagatgcctctggcttgctaagcaactcatgaaacaaacagcttgcttcagggctttcttttttgaagctgactttgttgtttgggtggggagatgtgtgtatagataagcttctcaaagtgatgacatcacaagaataataaaaatgccacattgcaccctgtgtctttcacctcccaggcacgttttcaaaactaatcataggtcaattccccttcttgccagctccagggacctgcagagatgggaggcgctgctgaaaaccctctaaggggggcagcgccgccttacctctcagagctgcatttccctctcttagaaaagggacgagctaggtggattttaaagttcctgccagttcccaattatttacccagaactgattttaactgagtgtttgaccaaagctttggtccatgagccttccattgccggggtgtttattttacataaaatttatctggatactcacacgtagaagtttttcttttgcatggaccctggagggcacacagcaagcctgggacggctgtgactccggaaggtcaggagggagaaagacgccctctccacgctgtatgttttggtatcatctaaatcatgcgcagttgacacaaattcatgattacttatttaattaaaaagtagaaaacccaagaaaaacacaggaacagactgctcaagtgtcctccaactacccagaggctttctgccaggcagccttgacacatggaaaggcctgaaaacttagattctcatcaaaacttcagcacctaaccccttcggagccacattgggctacagggccctcagataacaatatttccccttcttcccacatgcctttgtgaagaatgagaataaagaatttctgcagaaaccccttgcaatggctaaagtgctttgtacacaccagggtgcccctgaacctgcctcaagggtaggaaggggctgccatttctccatggccctgacactgcctggaacatagcctggcccggagctggtgctcagcagatgcccgaatgaatgcacgactgagtcagtcacgaacctgaaggaatgacaggaacccaaataacccatgatatcgagcccagcggtggcgtctgagtcgtcacctggcctgatgtgtctgatctatcagcagcattcgcagggatgtcctcccccttgactcactttcttcatttccaggcataaccctcctgcctttccctcctcacacaggctccttcccctcctccccctcttcctccccttctacctgtccccttcctttttcccttccccctcctccattttcccttccacctcctccccttcttcccttccccctcctcccttcttcctcgtcctcctccttcccttctctccatcctcctcccttttcccctcccccttcctcccccctcctcccccacctcctctccctcctcccctgcctcctcctagactccttcctctcctccctgccctcttgggttagatgcccggaacttggtccttgaactccaccctgcccctttggctccctgtctccttgatggtctcatccaatcttacctgttggctgacaacatccacattcactctcccgcccagacctctctcctgaactcaacaaagccgacctcctgagcttctcctccccaaactgttcttcctgaaggattccccagttgggctcatggcagcttcgtattactcaggcc

SEQ ID NO: 471165 - DNA, 1385 bp, Homo sapiens
ccaccgccgacgttcccctgacgtctgttgggtacacctcccagacggggtggcggctgggcagaggggctcctcacttcccagaaggggcggccgggcagaggcgtcccccacctcccggacggggcggctggccgggcgggggctgccccccacctccctcctggatggggcggctggctgggcgggggctgccccccacctcccggacggggcggctgctgggcagagacgctcctcacttcccagatggggcggctgccgggcggaggggctcctcacttctcagatggggcagctgctgggcggaggggctcctcacttctcagacggggcggccgggcagagatgctcctcacctcccagacggggtcatggccgggcagaggcgctcctcacatcccagacggggcggcggggcagaggcgctcctcacttcccagacggggcagggaggttgcagtgagcagagatggcggcagtacagtccagctttggctcggcatcagagggagacggtggaaagagagggagagggagaccgtgggggagagggagagggagaccgtgggggagagggagagggagaccgtgggggagagggagagggagaccgtgggggagagggagagggagaccgtggggaagagggagagggagaggaagagggagagggagagggagagggagagggccaattgtattaattgtaaagttgaaaacaaatatttccatttctaattatgggcagaacgaacagttcaatattactcaataccaaatctttgttcttggcatacactttcccactgaccccaagtggatcaattgattcaaattcctggagagcccagaatggtagatccactgacagcttgcaccgtgtgcctggaaaagccacagacactcaacaccagcccatgaaagcagccagcagggggcgctgtatcctgcaaagccacagtggcagagctgcccaagactatgggaacctacctcttgagtcagtgtcacctggatcactaaaaggcatctcccattctcggtgccctttcaatctgaggtcttttattgtcccccttcccccaattggggaatttatcttcaatatttcttcaagtttcttctcaccttcatgtatacttttgtctctttcttggattcctataatttagatattatttttacttttcatttcttttttatttgaactttcatgtcttttttattttctttgaactttttatactttacttcttccttttgcaagatttcctaaatctggttttccagtttattaactcattcttcagctgtatcattttgctacttatataatcacatattaccttaataatggtatgtatataaaatcactgtcagtg

SEQ ID NO: 471166 - DNA, 988 bp, Homo sapiens
cctctactctctaacctaagctggatgtgttttgcagatatgtactaaagggaaaatccagcagttgttttcaatggtaagaatgagagtggtattaaagagcagccagagggtccttttggtacatgaactattctgtgccttcactatagtgatttatgcacaaagctacaaaggttccccagtgagggtgtttaggggcagacgatccgatccctctttcccactttcacagtttgggcactcacagtatttgggccgtctcctgggtcctacaggaggaatccacttccttcaaagggatggagagcatccagatcaccagaggaatcaaaaagagggaattctaataatggagcaaaaagctgaaatgaaaggaaagacattaaacacgagaaagtcttacaaacagaaaatatcaggcatagccaaaaacacagactgtgcactggctcttcatattacactggttcattctgaattctgctactgaaatccagttacttctaccttagagaacaaaatacattctgaattacttaacaaattacattttgcccacctggcaagcttcgccccattacttagcatttgtacagcatttttgatttgctaatactttaaaataatttttattctcttggctatcatactttctgctgagtaaccatatttcaaagtactgtattgccttctgattgcctctttacatcactaaggaggagaaatgaggatgtagtgggatatccttgcacagtattagtttgagagttttattcagagttttaatgtttcaactaagtggaaaactttggaataaatggtctcctgtgaagtaaataaccattactttcctgaaatttagatttattattactcttgcgaaactaatgagacttctccagggtactcaactttctaaagctaactttttgctgaatcagacatgtcaataagtcactgatctatggataactttttaggttcc

SEQ ID NO: 471167 - DNA, 537 bp, Homo sapiens
gggggtttgagaagtataattgagagaagacttgggagccagttgacatgactgatccatgcatgttattgcccggaagaccctccactgggacgagatatatgccttttgccttccactgtgagtgtgaggccttgccagccacgtggaactgtgagtccattaaacctctttttcttataaattacccagtttcagaagaagacaggaaaatgtgggaaagtttgaaacttcctagagacttgttgaatggctttaaccaaaatgctgataatgatatggacaatgaaatccagactcaggtggtctcagatggaaatgaggaacttgttaggaactggagcaaaggtgacacttgttatattttagcaaagagactgcttgatgtgacagaaaagaaagacacattttctgaggagaaattcaatcctgctgcagaaatttgcatgagtaatgaggacccaaatgttaattgtcaagacaatagggaagaggtctcccgggcatcctaaggacttggtgttctgcatcccagcc

SEQ ID NO: 471168 - DNA, 570 bp, Homo sapiens
gaggggctgggggataccatgtgcttgaaatgttgaaggtcagctctcaccctcctgtctattttagtctctccgtggcccaggatgaggaggataagaagggagttacagtgttggctggggtgactgacccagattatcaagatgaaaacagtctactactctataacagatgtaaggatgagtatgtgcagaatacagcagatcccttagtgcatcttttagtattgccatgccctgtgattaaggtcagtgggaaactacaacaacccaatccacacatgactacaaatggcccagacccttcaggaatgaagctgtgggtcacccaaccagatggtctatcccgggactttacccaggatatacccaggtctatcatgggacttttcccaagacagaccatctgtaagatgaggagcaaggagaaagaggtttaccttctgaacgattaaattttctcattaaaatcaaagggataaattcaattccatgggacaaaaataagctaaaataatgtgtgtaaagggctttacagagtttcaatgatacactgaacgcacgagcatt

SEQ ID NO: 471169 - DNA, 945 bp, Homo sapiens
gccaactcataacccatgtactgaatgcttgttctgctccaagcactgggaataacaaaggtgggcacaggcacgtgccctgcccgaggcacacgtagatgcttgggaggagcaacttatcacatggacagtgagcctggagatgatctagaggacaaagaggcatccagagggggatggatccagaaagtcaacataaagcgacttgacttccatgtatctggcagagacagccttctcacagaagttacaacttcaaaaggctccaaagatgcatatcatgcccagaggcagatgaaacacactgcatggtcactgaacccagaggttctcctgaaaaagtgtatttcagtctcagtcattgtctggaaattcaaagtaccactgtggctcaagaaccctcattgtcctgacatgtggagcctcctgactgcacctgaaagcactgacccaaggctcccacctgggatgaaaggtgcagatgtctcacccagccaacaagccagattctctgtgagtgtctccagatgcagcaaacttgttcatcccaagtgcctgctccaggcgaggtcttgtagctcctgaggcactttcttttttgttaaataagaacaagctaattgctgttcaaaacttgaattttttgtttacactaaacagactttaggatacaaatttcatagtaaaggttgatttaaaaccattataatctaatattaggaaacaactatctacagctctcccacgtttcttcagtcttgcaagcaaaggcattgatagtcttttctgcactatctttctaaggatgtgtgcatagcaaggagccttagaagacagggtcttctcttagaagatagggtctccctagagcaaagatctggttggtttattgcccactgtaataaagacaatgtctccctctgggacaaacggaaggcatgttta

SEQ ID NO: 471170 - DNA, 855 bp, Homo sapiens
gcacctgtgaatgtgtatgccatgtccagccaccacactggtcctcatgatgtccctgaaacatcatggttctcaggtccactcttggctcaagccacactcccacctggctgcaccttccaaatacccaaagccaccatatcctccagggcttgcctaaaagcccaccttctccatgacagtgccctgtggacccaggctggcattggtttcctttcagagacactgagggtagcaacaggcaaaagagtggaggtggggaccagtcagcagggtgaacagttgctcttacccggcgtcatcctggaagccttccaactcatcccgctgctctgccagggtggcctccaaatccaggtaggcgccattgtgagagagctgcagagtacagtcatccagctgcaagagaaagagcctgttatacccaacctgctcctcagatggagactacatatggagaaatcacatcatgttgccctcctgtatgcagaggagccagaggagaccttgaaacctagaaaaaagcagagccccaaatgcaaggagcttgggttcctgagtcactgcatggaagagagcactttgctgcccagatccactgacccatcctggactgtgacagcatcaagaaacgagcctttgctgtgctaactcattaaggttttgtggttgctacaggtggaaaattccaatggaaattggacctgttgacacgtacagtggaccatgtgtctggttgtaatcattggcagctcattcttgctttaatttctactgctgttattaactaagaaagctgatttagtgtgttcagctgatagtatcaacactttgcctatttttaatcccacatat

SEQ ID NO: 471171 - DNA, 707 bp, Homo sapiens
tggagtcactaggccaaagccatgcaggtggtgtgggacctgatccagctccctctggctcagaaccccatgctcttcctactggtcctctccttgcctcgtttacctgctatagactttccagcacttcacaagccctcaagggaaggattatcatctgtgcactcacgcaatatgtgcatggaacgtggaggcgagagtacaaaaggcatggtgcttgcctatcgacatgaggcccctacaacccagggaaggcccggtggtccaggatccagtgctgctccccatgtgcccatctcacatgctgctcggcaccagcagccatcaccactccacttctctcaagaggaagaggaggaggaggaggaagaggaagaagaagaagaagaaggagaaggagaaaaaagaagggaagaagaaaacaaagaagaaggaggaggaggaggaggagggagcgttaaacacataagcatgagcatgtcagtaattctgaaacagatgtccagtacagtagaagcttttgctgagagtgaaaaacattttttcatcattaatgggtattgaattttgtccaatgccttttctgtatcaattgatatattattttttccctttattacgttaatatagtgggctacagatgttggaattatctgacaaagacttaaagcagatgtgattaaggttactgacttaaaatggggaag

SEQ ID NO: 471172 - DNA, 567 bp, Homo sapiens
tttttccactgaaataatccccagcaatggatccaaaccaagaagaaatctttgaattgccagactacagtggaataaaattggaaattcactgcaaagggaaccctcaaaactatgcaaatacaagaaaattaaataatctgctcctgaatgatctttgggtcaagaatgaaatcaagatggaaatcttaaaattctttgaactgaacaataatagtgacacaacttatcaaaacctccaagacacagcaaaagtggtgctaagaagaaagttgataacattaaatgcctacatcaagaagtctgaaagagcacaaatagacgatctaaggtcacacctcaaggcactagagaaacaagaacaaaccaaacccaaacccagcaggagaaaggaagtaacaaagatcagagcagaacaaaatacagttgaaagaaacaaacaactaaagataaattaaacaaaaagctgattctttgcaaagataaataaactttatagaccattatcaagattaaccaaaaaaagaagagacaagatccaaacaggatcaattagtaatgaaatgc

SEQ ID NO: 471173 - DNA, 597 bp, Homo sapiens
tgccagcatgtggagccgcctgccccgctgtagcagctggcatatgaggggaacatggtggcacctgaaaacttggagacgtcagtaaccacagagccccaaagggtgttacagctcttgcctggggagtcccaagttctgcccccaagaaatgttacagctctctctcattcctgctgcccacagcttgacgaatggggtcttgttacagcttgttcagtcctgctgctcgcagcttggcaagttccgggttcttgtcccgtgaccaagaggaataagaatgggggagtacatgctgattggtccataggtgggctggaaaaagcaccatttgatcggctaaaatgtatcaagaaagttctcactccagtcacggactctatccatagctggcagctcggttttcaggcttcaggctgtctttggcttgaaggttgggtttcaccagggacctgtccctgaccccctccttttaacttattttcaagcagacaaaaatgaaaatgcaatatatcaaaatttgtgggattgtaggtaaagcagtgtctagagggaaatttatagtattagatacttgtattaaaaagatttcaaatc

SEQ ID NO: 471174 - DNA, 666 bp, Homo sapiens
agcaagcaagctcccttccctacaatgtcaagacatagaacaatgccagcaaagctcatgaaaataatcactactctgactttgaagcatctctatctgccactgacacctcaagcaccagttgatctgctgggtcaaatggcccaagtggcacagcaacttgcacagccacctggacctgttgcagagccttctcctgttcaggactgtactcaaaactggcagcctttcaggtcacttgataaatgggccagagtaacacacccaaataagccttaccctaaggcttttggcaatggatttgtccattttattggagaatccacagaaggtagtatctatatttattcatccattgaagaaatcttcagttacctgcagttggtatcccacaatagccagggtgtaggcagatggttgattgatccaagatttggaatttgcagaagaaagaggaaatgcttgaggctctggcaataaattggttaaagttactcatcattagttctgggctcagcaggcaaggaaatgaaaaatgaaaccatgaggtatacgggaaatgggggacgagagactgttgagtttattcaggtgaaatgctttaaagtgaaaaagggaaagttgggggttgtaagaaggacttggcacattgggctgtaagatctc

SEQ ID NO: 471175 - DNA, 648 bp, Homo sapiens
tctagcaaatgggtggcccagcagcactggaggctgtgggtgactgggtggggatggcattgccagggtcctggtataatgaatgggtggggggccggctgggaccctcgacgaagttgatgcagctcagccagaaagctcgaaggatgcaggctctccaggccagaggctctccaggccacaggcccaccgggagagcggagtacccagggcaaagtctggaagacccgcccttggggcttgcgtggagggcagcacgggagaacagtgttagaaaacacagccttccactccccaacaggagacccgcagggctcagcgcagggctcatcacagggcagcttctgcccatccagcccctgtggcaggtggcaggggctgggggtgctccagtcctagagtcccagttggggataggcagccgagggcagtccctgaacctccttcggattctgagcctctggagcctcctaggcatcttcctctttgcagctggggtgcccagggcccggctggagtgacaggctccctgcggctcctcccgcttcgctgccctcctcctcccctaccctgccctggaaggtgggtttccctcgagcctgcacgctgcccctctgttctgcatggaagctgtcacctgtctcctgt

SEQ ID NO: 471176 - DNA, 1030 bp, Homo sapiens
ccagcaccttacaggcttgctggcataaggcttagaaaaaaacgaatgcaaacttgtgaaatagcagcaccaccgctcttgatcttctctccaacttctttgggagagccaaggcccatgagggccacgtgcatccctgattaccagggggaatccagtgacctttccggaaccagctccggccagggatttccaggccgtccctcaggtctgatcattgctagaaagactggcggaactcacaggaagccgtcagagccacagcgcttcagcttaccatcagccaagaggagacaggtgttggacagggcaggcacacagggacatgcaggcaaagatgaaggcagagaccacgatgatgcttccatgagccaaggaaggcccggctgccagcaacccccagaagctgggagagaggcctggaacagcttctccctcctgccctcggaaggaaccagccctgccgacaccttgtcctccacagctttcagcgaggtatcagtaggctcccaagaacagtctatcgagaaagtccaatttggctggtgtggtctgtcctacaacaaagcacatgtagtagagatttaaactttttctcactgattcaatttggtgctatgctaagaaagcccttctctctaacattaaatgtaattccccttattttttagtattttttttatatttagatttatcattgtgtgaaggataagaaggaaatttaattttatactttccaaatggatatctagttgtccccaaatcactgattgataagctcatcattcttcccagtctaagatgtctttttttaggattctgggcatttcttagaattccatagaataatgcgtgttctgatccattgttccatgtccctatcctgaatctcagattcgagttttacagctttcagggtcactgtcacactctgaggctgcattgttgggggagtctagaaattatcctcctcatcttggaattgatcaccccaagtgaaacgactagcttggggtcacagggagcattt

SEQ ID NO: 471177 - DNA, 474 bp, Homo sapiens
cttctgggtgttctgatacctggagatgcctctgagccaactggggctcatgcaaattgttccatctgcccaaagtggcactggcatgccccgtaccaccaccaggagcagggcctcatgggaggcatttagagaaggcagcgttccaggtaccatcttggaagcagagagcagttctcaccagacactgaactgcagccctctggccttggacttccctgcctccagaatggggcttctgttccgggaagtggctcccaagaaattactggtggattgttggtgctctgagggtgaagaggtgaaggaggaagataaaaaggagcagccgcagctttccgttcattatagtgttattagtcagtcttcataaaagtgctatgcatctttattaaaaatggaagttcacatcattttatgttcccataaaaatgggtggtggtagctttgattaatttcttcacatacagtgaa

SEQ ID NO: 471178 - DNA, 1007 bp, Homo sapiens
ttgagagcatggatgaatgcctcattacatgtgggtgaatccaggggcagaactggaaggggtgttgaagccattgaagggacagtcaccaggaagcaggcataaaccttgcggaatgacgagatctgcaagctcaggaaagccccacgcctctgtcttgggatactcaaaccacacctcccgggcaagggctcccctgggcggcaccaatgctgcaggcctcttgcgatgtcgtggttgctgtccacacggcctcctccatggttgtttcccctggtggcctgacaggaccccgcagacccctaatctgctcacccggctgctgacctgccctgcaccacttcacccgcgcagccctgggacttggctggacctgcagaagagatggcaaaagccagggcctgctttggtggctggtgttcagggacctccctggcacctgaactcccactccaagagtggctggaaggacgtggggagcctgtgcacacctcccagacagccgtttccagagttctcctctgtgcctctctcattccaaggggaacgcagggagaggagctggtatgactgagggctgggcatcgggacaggtgctctctgccttatgggaaggcatccacaggttagggttattattattcctcctgcatagatgacaaatgaaaatgaaaaatctgaggttcctgttggttaaaaatcttgcccaaagttgtggcgacaatctatggaagagtgggctttgagcttaggccagtctgacttgcaggcacatgcaggcaagacacaagtcccatcacccagtggagtctccccagacagcacccttgtccatttggaacggggtcctcacatgtgagccaggcacgatgggcagaatcctaaagagactcttagtggaaggatgaaagttgggctagtttatctttgatagtccttcttatctttccaagggtttagtattcagtgttctgttcacttgctgaatcattcatctggcatattgg

SEQ ID NO: 471179 - DNA, 3123 bp, Homo sapiens
gtatgacctcctccctgcctcactcctgcagtaggtaggggtgagggtatgacttcctcctcctcacctcacccctgcagtaggtggggggaggttacttcctcctccctgcctcacacctgcagtaggtgggggtatgacttcctcctcctcacctcacccctgtagtgagtggggtgacctcctggctggccctgccaggctcttccctgtccccagtcgcaagggtactctcccagcctccacgctccacgcccacaccctcgccccacttgcccagccccggcaggagcttctccccgcagagtccccagtgttttctagaagctttgcctccccctgtgggctctcccttccgtcccgctctgtagctggcaggcggcctgtcctccctgcagcaaggggccagggtgggcgcaagccctcctgccctccccgcgtggacgtggacggggcggtgcgggctggcccagggtccggggtgcctgcagcgtgctgggccagccaggcggtagagggtcggctcagccagtgcccatggcagcacctgcatgaggtccccgcttcctggaaactgagcccgggaacggccttggcccggggaaagcagggctgagtgcatctcccctctgagagcatgaggtgctagcagagctcgtgggccgggcctttacctgtgttcttctatttctttttactggtaaagtcaattactgaagaaaaataatttcgaactagaaattatctttttagtttgaaataaaattatgtgcaaggagcttctaaattatctaatattttttcctctttgcaaaagtgttaatattatatggaaaaattggaaaaacacagaaaaataaacaaaccaaaaaaagcattattcaagatcctcctaccccaatgtagcttactgtgaacattcttatctgaattctttcagggtctttttctttcttgttttttttttgctctacagatatttttcaaacaaagatgggaggatggtagtatttattggcttgctttttcactcactaaatggtgaacagctttttacacaattctttatacattttcattattctttctttagggtttttttttttttttgacattgcttggtcaagctttggcacctactgcaaacctgttttcaaaatatatccatctatctttccatttctagtgcatgaaaacgatcatattcctgggccgttgccagcatgggtattttttaatttgacaatctttgccagtttagtaactgtgaagtagtgttgtttcagcttgcatttcttggattacacgtgaggggggagcaatttttccatatgttttatgagacaaaggtattttttcctttttgaattattttcggtcatgttatttgctaatttttctgttgctttgttccatcatcttactcatttggaaaagctggaataaaggtgttaactcatcgctttagcatctctatacttgcagtccccaccttctgttgtcttttaagattatgcaagtgatacaggcttattttagaaaaacttgaacaaagaaaaaaatttaaaaattaatgaaacttatttgaaatcccatcatccagaaattaccaaaattgatatttgggtatatattcttctggatcacttcctatgcagatctattaatgtctgtctgtctatctatatttatctctgtctctgtatctatttatctatctttgtcattttcagtgcatgtatagtatcccattttgttgttatgcacaaattactggagaaatcaaccattgttggaagtgtggttttctcccactttcatattataaacagctgtgtaattaatatctttgtatgtatatcttggccatagtctcatcatttccttgataaattcccacaagtaaaattaccaggtcaaaggttttggatgttttaaattattttgttgcgtgtactgccaactggccttctgggaaggtcgtgcacattttcagtcccaccagtgacatgcatttctctgggttatggcattttttgatatattgagttgtttttatgtagtttagttggtcctttcttgcatagtttctgcttttaaagtgatgtttaaaggtgccttccaattctcaagattatgtaaatattcagttttatttttatgaattgattgttttatgtttaagtatttgatacatctaaaattaattttggtatatggtgtgggaagggcatctcaccttattatttttctaaatgccatttatttaaaaatctgtttttcctaattggaattctaaatgctaacttcattgtacaccaagaatatagatatatgtatatatgtatatatttgcgattgtctttcaaattccattttgatttcaatgaacaatctgcctctgttcctgccctgtgtccccttgttttaagtactatatctataaaatacaatttaaataatatagctttctacccaccccctgtgcccattactttccttttttcaatgaatacttttttctgttctcctaaagaaactttagaatcatttttgtcacaccttgggtaatttgactgaaatggtatttaataagttaattctggaatactcagcatctttatagtggtaaattttccattctaaaaacaactttggtatattttcaagtttattcaaatcttatttgctactattaagttttgtgagttttttcagaggtaatcgcctaggttatttatttatctgtttttgtgattttctcctttgtgaatggacttttctgttatattttaactggttgtgtattgagatgctgttgattttgggaatctttctgattagctgtttgtattagcagatgctgttgtttgcctttgtatgtggtagctagatttcagtactagattttagtacttttttatcatgaccttctcttgtggcttttctattttgagaaaatactataactcttcaacattgctgaatcaatggggagtgtttggatttttaaaaaatcaaatatcagttgacaatgatgccttaacgcatcttctgcaaataaataatcaatggttaaaatcagcccaggctgcagcagcatgggaactcccgctcttcagc

SEQ ID NO: 471180 - DNA, 3348 bp, Homo sapiens
cggccttttttttttttttaagtgaaattggtgatgcacttgctccatgcactcctggcaggtagcaccctgactgctttcactctctccacagtgagaacgcttcatgttagccaagcgctttagcattgtagagaaggcaggagaacagaaccatgggagagcagctgtaagcacaattaggtataactcagaagtggccgccaagtatgtgccctcagtgctcattaattggacagctattgaagagctgcttataagcgccaatcgccatgtcctgccaggtgtcgtgagggtccagggtagacacacgtggggcagtagcacacccacgcagatggtgtctggtttcccagagctgccccaaaagagtaccacgagctggtggcttaaacaacagcaatggactctcacacagcgctggaggccaacagtccaaggtcaaggtgtcgaccacatcggctgccagtccaaagccctcacaaaggccttccaggcccgtgtgactcggacctttgccttttctcttgctcctccacctcccactctgtcttctcagcaatgtcagcctccttctgtttctcgggtttgcctggtgtggtccagcctcatggcctctgccctggcagttcctgctgtctgcaccagccttctccaggcacctgccccaccagctgccctacccgacagttctgcctgagatgccagctcccacatgctgcctccaaaccccacccctggaagtccaattacctttattgcttcataagtaatttttactgttgatctgattgattctgtaatctgcattcaaataaaatccatacactgcagttgattaatatgtcccttaaatatcttttaatctctaaattgtcttctccccctgcacctctttgttttctttgtgatgtgtttgatgaggaagctgggtagtctgtcctagagttcagtgctgtctgggctttgctgatggcagccccctggtgtcctctgacatgtgacattgtcccctgtatttcctgttgttgggtagttatatttagcatctgggtaagatggaagcctttttttatgcctatggaagtgagtatttagtctttctttttccctttgcacataaaaatatgtacttgcttcttcaacagactttcaagtaattgtccttatttcagatctcttttcacccccacctccaggggttgcaggagctgccagctcctgagctttggtgggaggctctggccacacatcagcctcctctgggctgttccatgctcctggctcacttcagcgcttttgggtctgctaagacgattgctgttgttccatctgctttacagcttcccacattttgctgctgacatctctccccttctctttgtcctcatgggtttatggtcccccctcttgttttttcattgctctcctctcacattagagtggtttcagcagggagccaacgtgaacatgtgggcttaatccaccatctttagcaggaagctgctccctccttctttccccatcagctttcggtgagcaaatggtactcagcacctcctggaagccaccaagagcacctctcatacctgtgcacacaaggccagccccaccgcctgctgctcaggccgcggttccctccgttccttccagaaactcatgcaggcacctgggagaagctgccttcaatgctgcctgctctgttgaaggagaattccattttctctttcgtggctactgtcttatctcaggtccctttgcccaagtctctagttcctttttttcttccagccagtcatttaaagtttatggaccttttcctggcaaatccatagattttttttccccctatctaatcatgaccctaattttaaatctgacctaagcagggcacctgctgtggtcctcccatttacagttctcttgagcatttcattcatttattcatctgccattctctactctagaagtctctagtagcctttgtgcttaatcattatattgatgttgattttgaggactgtgaaatattttatgatctcaacgtgtctcatcaaagcaattgtttcatgcttttcaggtgcagagtttggaggtctggtaataggtgctccaaccaatctgaagttctcatttcatatactgttaatttcctttagaattcatactctcaaagcacttatagaatgtattatttaccttgctggtaatttgtatttccttctacctcaattatgcaatcttagcaagactactcaagcatttgtcattgtaacatttctataagattcttctgctgcatgttcttccaagatttagaaagtaaacacactgtcagctggtgtcagaaaacctcacactctcatttgaaaaagacagctatggagtcctcttctctacactgtagtgttatataataattataatatgaataaggttatagcttgaccttagcttttcagtacttttcctccttttcttttaaaagattgatttaaaaagtatcagtggggaaaaaacttatagaaatacgacttgagaaatagaagtaggtttgcatgtatcaatttttttctattgtcagagatggggcagttagagatattagggtacacacacacacacacacacacacacacatacacacacatgatttattctcaacaaggggcacagagtgagccgttaacgcacaatttctattaacaataatgataattgtgtaagtgagtctccattcatgcctctggaaatttaccccttacggtccacataaatttgagctgttgaccatgtgaaatgttattttatgggcaataagggcactcagaagcagctgcatgttttcctaaacctggccacctaccagtatatgtctgcataattcttccatttttcttcctggaatccaaatatagtatacaccttgctggtaagatataggcaatcctatacttctccatctccctgcagtgatcatggaacagctgcatcttttgttgtgaaatcagacagtggcctataattcctcctttccggtgttttgattagaaatcttcaagctaatgtagatcagtgagctctatttctttatttctgtacttcaggcagtatttgtaggatagtatttgaaaatgaagcctctcaccacaaacaggttcttttctacccacactcaaccccaacacaaacacacaaacacacacacagaaacatacacacacaaacacaaatacacacaaacacacacacagacacacacacagacacaaacacacacacagacacacacgctggacaactgctgggtagagtgttaatcatatggaattttgtctttgttggggt

SEQ ID NO: 471181 - DNA, 495 bp, Homo sapiens
gcagccacctgcaactcggaaaagggccacacagaacccaccatgcagacgagggttctccaacaggtgcacgtgtttccccagggtgtgcaacctggagagctgaatgaaagtattcgaatttccctgactgttcatgtctatctttacctaagaatagaagttgctggcttttgctcacttctcttcgacaccagacctctggcatgtccatattctgactgcagccacactcgcaatggaacaaggggacaaaaacaatgtttacttaagtacattgtgaaagtccagaggaacgcttctgttttctggctgaaatctcacacgggaataaaagcgacagaaaactctaccctttcctgcacgtggccagcccctgtggaccctggtgacaggcactctgctcaccttctgcctggaagttttgccaagcccatgatggttttatgaaatcctttctttgatttggctcctggcagtttgcagtttgaagtc

SEQ ID NO: 471182 - DNA, 544 bp, Homo sapiens
agttaacaattaacaagttaatcttgttcagaaactactgccatgttaaaagatgaagattctcgtggacccactggccctgcagaagtggcccacttcccctggtcagaaggagttttggaacactttgaaatgaattcccgggatcctttttttgtttcccctaaattttcgggcgcgggccgccccgggccttcccctttgttaattcggggggttccaaaccgccgttccccaaaaaccgttccttccggagggggcctggacctggacctccaaaaaattttaaaaccagcccccgtttttacttttaccgcctccctttttggcgggggggccgcttcagcctctcgccgaaagaaattacccaaaagacctaacaaagaaccccaaaggccaaattcattctcccacctggaacaactaaaaaactggataaataaatgaaaaatgttttttatgtattagatacaaggcactgagtgatgtaaaatgaacgaggtgagccctacacttgccccagctgacttcctagagacaattt

SEQ ID NO: 471183 - DNA, 1753 bp, Homo sapiens
cccaacagctcattgagaacgggccatgatgacaatggtggttttactcttcctccatgcctcgccgctcttcggttctactctgtccactgccatggcccaagctgacatcgtgctgatcagattggcagtcatgggccagaacttaattctgaccatgaaagaccatggctttgtggtctgtgcttttaataggactgtctccgaagtggatgatttcttggccaatgaggcaaagggaaccaaagtggtgggtgcccagtccctgaaagagatggtctccaagctgaagaagccccagcggatcatcctcctggtgaaggctgggcaagctgtggattatttcatcaaaaaactgataccattgttggacattggtgacatcatcattgatggaggaaattctgaatatagggacaccacaagacggtgccaagacctcaaggccaagggaattttatttgtggggagcggagtcagtggtggagaggaaggggcctggatagagtatggggacatgcagctgatctgtgaggcataccacctgatgaaagacgtgctgggcatggcacaggacaagatggcccaggcctttgaggattggaataagacagagctagactcattcctgattgaaatcacagccaatattctcaagttccaaggtgctgatggcaaacacttgctgccaaagatcagggacagtgcagggcagaagggcatggggaagtggaccaccatctctgccctggagtatggcatacccgtcaccctcattggagaagccgtctttgcttggtgcctgtcatctctgaaggatgggagaattcaagctagcaaaaagctgaagggtccccaaaagttccagtttgatggtgataagaaatcattcctggaggatattcagaatgactcttggtggtgggcagtcagcactggggtccaggctggcattcccatgccctgttttgtcactgccctctccttctatgacaagtacagacacgagatgcttccagccaacctcatccaggctcagcgggattcctttggggctcacacctatgaactcttggccaaaccagggcagtttatccacaccaactggacaggccacggtggcaacgtggcggccgcggctccgttggctctggtagctcccacctccccagcgctggcagcatacccacgccagcccggaggagcagaggatattgcaaaggatacagatgaagagatgcatagaccagaggcagaaatcaaagtccaggaggccacctccaatgacccatggggcccatccagctctctgatgaccgagattgcagacctgacctacaacatggtggccttctcggggatcatgagcatgatgtggaagcggctcaatgaccatagcaagaactggcagcatgtgtacaaggagctgctgctgctggactaccccatcaagacaggctccgagtgcatggcccagcagtgccgtgagatcatctttgccatccagaccctgaaggacttccagtacattgaccaagatggcaaggaccagggcatcaacgtgcatgagaagtcaaagcaactggtggccctcctcaaagatgaggaatgactgaaagctgagggggcccaggctctcaaaaccaaagagcacatggcccaggttgccactggcatgggcagcaaccagatcaccttgggcgaggctccagccagcccaacctctccaccagccactcggagcaggagtatg

SEQ ID NO: 471184 - DNA, 1854 bp, Homo sapiens
agtcaccagttgagtcagttccttcgtatgggtccaggtggagtcagttggttatcagaatgcgaaagtctaagaaatatctcaaagaccaatcaatcttaggtttgacaatagtgatgtcatctataggagcaactggggaagttacatatcttgtgacttccagctttatgactcctgagcagaaaaagaaatttaaacaagctgcttggaagcagagtttattagttctagagggtcaaagccagagttgttttcagttcgctggtggagatgccattgctcggcaagtgttcttccgagtgtgtcttccccgaattgctgcagtcctaaaggatgtctataaggccatttttacttcctgcagaaaggatacacttgccagcagttttgccacgagagtacaccgaacaaaggagacagggtcatttaacctgatgcgtccaccctactgctgtgtctggtttccattggctgtaacgggacctcacattctgtatttgtcctgattggttagcaacttagaactttttaaaagaggcaaaggtagaggagaacaaaggaaggaggaagtaactttcggaatgctgaaaaagactgtgccttgaaatatattaaagaacaaagcccctagtaatgctcattcctaagccaatcaaaggctctaaaataaaaagtttgttctttctagttttagtgttgtgttgaatttttaggcaatttttcaggatggttgtctccagcttcctccatgttgctgcaaaggacgtaatttcattcttttttatgaccgcgtagtatcccatggtgtatatgtacctcattttctttatccaattctcagttgatagacatctagatcgtttccatgtcttcactattgtgaatagtgctgcaatgaacatacaagtgcatgtgtctttttgatagaaagtttttttttaatgtatacccagtaatgggattgctgagttgaacagtagttctgttttaaattctttaagaaatctccaaactgctttccacactggctgaactaatttacattcccaccaacaatgtattcccttttctttagccttgccagcatctgatgttatttgactttttaaaaatagccattctgactggtgggagatggtatctcattgtgattttgatttgcgtttctctgatgattagtgatgttgagcattttttgatatgttttttggccactcgtatgtctttttttgagaagtgtatgttcatgttttttgctaatttttaatggggttatttgtatgcttaattttgtaagaaatggtctttcacgtggctggctgtaccattttgcattcccaccaggaatgaatgagtgttcctattgctccacatcttcactagcatattgtcagtgttttggatttgggccattctaaagttatgtagtaatatttcattgctgttttaatttgaaattccttaataattaatatgatttgagaatcctttcatatgcccatttgccatgtgtatgtcttctttggtgacttgtctatttagatttttaaaaattgttttgctggtttccttattggtgagtttttagagttctttgtatatttttgataacagtccttttctatgtgttttgcaaagatttgctcctagtttgtgtctttttttaaaattccttaaacagtgatgttttgcacagaagtttctaattttaatgatgtacatcttacccattttttcttttatgcttttggtgtggtagctaagaattcaggccaaatccaaggtcacctagattttctccaacgtgatcttcggttttatagtttgcatcatatattctattccattttg

SEQ ID NO: 471185 - DNA, 584 bp, Homo sapiens
caaagaagggccaacaccattggtagctctcctgtccaaagttttcttgggagttaataagttatgggagcttcttgttcgcaatgtttccaatcagtgcagatggtgctgagggtgactggctctgagagtgttgtgaccttgcccccaggcattaaacttgggccctccaggatgacaaggaccagcagccctacacacttcctcttgcagagttgcctgggcacactcaagtgctccaaggaccagcccactgggaatggggtggctggaccagagcacttctggtacagctgtgtcatcaggtaccttcgaccccctcttctccctgctgctcccatgttcctggggtctaaggacgagctctcctgtaccctggcccctgccccacctctcccttattctcccttcacatcagtcactcatcccatacttcatagacagtggcagaggagtctaagaggggagggctccactccccagccccaaccagagcagatctgcttggttttgagatacatgtgtagcatttcacttgggggaagaaaaggctttcgctgattaaaaagtttgaaaaccactgt

SEQ ID NO: 471186 - DNA, 614 bp, Homo sapiens
acactcaggggctgccagcatggaggtgccgtcctgggccagccttccagagggtgccatcaccgcgggcaggagatgcggctgggggtgctggcccgctgcccccgtgggcgatcccagagcctggggcaatcccgctgctcctccaggaaccggggaccccttgctcttccgcgtcggggagaacctgctgcatctcccctgcatgctctgttcactcgaccacacgacccagcagcagaggtccccgttctcgctgcccctgcagcaccacctgtatttccacactgtgtttaaggaggccttgcagagcctcattaacacccccatgaagccagaggggactcggccaagagcagaacaaggggccaccttggtcccagcaggaccaaccacacgcagaatcgccttcagggagaaaccactgtggaaggagggaaggtctcccagcctttcccagaggtctccacacagcatcaaggcctcgttcatcggcccctgcccccaccccccggcacattactccctgcacgttttgtgcccctccctataaactgtagaatcttctgctttctttgggtatcaacttgtacatctatttttgttttctgtcc

SEQ ID NO: 471187 - DNA, 1193 bp, Homo sapiens
ggcaggggcatgacagcaggaggattcagggcattgcagcgtgaacatgagttctctctctctctcctgccaccatattggaggtgccttgcttctccttcaccttctgccatgattgtaagcttcctgagacctccccagccaggtggaactgaccatgagaagcataagtctttcctggaagagcagaggattcagccgtggatgcccctgcaagctggtgatgggcggcagacgcatcacgccagtgcacagtgtctcaggcccccagcctacgggctggcctcctccaaacacagacccagcaccctgcaccagacccccacccccaagcaaaaaaccagagagaatgttctaaaagccaagttctcaggacaaaacccctggatggcagaacctcacccagtttccctggtgatccacagccaagttcatggatgtgaacaagggtctggaatgtgccagcgaggggctcagaacaggcctcagtcaccagctgggtgccctgtgggctgcagcattaaggccagggtgcctgggcagaggtggggtctggacgacaggcagtgcagacagtgtcctggaggagccttcacggtaaccggggacatcagcgaggatggcagaggctgctcactcgaagctgtagccaagaaggctacactgtccctgcgcgtggcagagccttgaaggtggggtggggaggggaagcttcccattagaagatgggaaggctctggttggatgtgcttctgtgtccgctaaatgctgccataaacgctattgactagaacaagaatagaaacatcaaagacaagttgtaattgtccattagtgataggaaaatagcaagagtcccaataattcactttgttactggaccttacaagattgattatatagtttatctctctctctctctctatttatatatatatatatatatatatctatatatatatacgaatatatgtatatgtatatatatatactttctctcaaataatagaaatcaccctatatattaaatgtgtatatataaattaagaaatattgtggttggtttaatgacacaaaacttctcccctcttagataaatatatatcttgagaataccttttctcctgggctctattaataataaataaggttctataattttttttaattgcacatatgcagtaataaaaaat

SEQ ID NO: 471188 - DNA, 1001 bp, Homo sapiens
tcacaaacgtagttctgatctgcagacccactggcagagtccctgggaacttaccccatgccaggacccacaggccacgcggtgagaacctcctgccatgggtgagaccaatccttcacggaccgggagggaggctgtggatggggctggagccccgggtatgtcctcagctggctggagagcctcccccaggggcgatgtgggcaagtccacgtctgctggggtcccttccctgagctatgaggcagccaggaagctgggccacaggcgggaggcctggggtccgggcgctacagccagtgccagctcctgctttccacggccggcgggttctaccatagcctcggcaagtcatcagcaaacgtcccttacagacactccatccggacacgtgtgcctcattgccaggtggtctctctgccgaacccacatctgtgatggcagaactcagctcagagcagacggtggagccgtctccccaggccgtgtcgcaggtcctttctgctccgggcaaaagaatcgcagagcctgattccacaggagagcatgagtcggccagctcctgcggagcctcccgacagagcacgaaggagcgtggacagggctccagcttagttctgacatgcgttggaagcacctgcggacatccactttgcaaagcagctgctgtactggtgcggctggggtgtggcctgggccgttcctctattctaggaggagtggggctccagatgctgccgtgctcctggtcacccatgggagctgccaaaggggaccccaacttttcttgggaaagtgcccatccctgggcctgtgggcccctccggcgatgggtcagcgccaccctctgaagggcacaggggcgtgggggcagcggtgtcagtttgcttcctcggcgtcgtagccacagccgtgacatgccagcctgcttcccacatggaagaggtattttgctcctcccctgaccctgggaggtcctgggccccttcacacctttgcat

SEQ ID NO: 471189 - DNA, 1488 bp, Homo sapiens
gggctccttctctgcatttgcccgtggcccggagcccaccctgctctgctcatccagcacctggacccctcgccggctcccgagctcgtgccttggcttccccactgggtctgcgctcctctgtgtgctggggctcccacacccagtctgcgttccccgccaggtctacgttccccgccaggtctgcgttccctgccaggtctacgttccctgccaggtctgcactcctcacctggtctgccttcctcacctggtctctgctcctcacctggtctctgctcctcacctggtctgcgctcctcacctgttctctgctcctcacctggtctctgctcctcgcctggtctgcgctcctcacctggtctgcgctcctcacgtggtctgcgttcctcacctggtctgcgctcctcacctggtctgcgctcctcacctcacctggtctgcgctcctcacctcacctggtctctgctcctcacctggtctctgctcctcgcctggtctctgctcctcacgtggtctgcgttcctcacctggtctgcgctcctcacgtggtctgcgttcctcacctggtctgcgctcctcacctcacctggtctctgctcctcacctggtctctgctcctcacctggtctctgctcctcgcctggtctctgctcctcgcctggtctgcgctcctcacctggtctgcgctcctcacctgttctctgctcctcacctggtctgtgctccccacctggtctctgctcctcacctggtctgtgctcctcacctggtctgcgctcctcacctggtctctgctcctcacctggtctctgctcctctgctctgtgtcgcctctggccctgctgtcaccactgctcccaacctcctccacatcccagttctccaggactgcagtccatgtgcgaaaatgcacagacccaggacactcgtggagactgcgaaatgggcttaaaacgcagccggggctcacgccctcttgggggcttccgcgtggcctgtacctgtgaggatgccggcaggcttggcgcacgggtggctccggggtcaactccacgggcgctgcccccaccctcgctcccgcagtgcctgagccccactgccctccccactgctggtgtgcgtgcacctcaggcccctccgggagctgcacagagttcacgccgggtcaatccaccatccactgcatggagaggccagcggcctggggcagctgtgctggcccagggtaaacggcccctccgtaagccccaggaagacgggaccccacatgctccaggaagacaggaccccacatgccccgggaagacaggacctcatgtgctccaggaagatgggaccccttgtgccccaccgtgaccacaggacaccgtgcactctcaggcgcgccatcctccctgactgaccgagctcccccaaggccgtcatcacctcctgggtaagggctttgcctgggtgagtggaaagtgaccgcgaaggacttgctcc

SEQ ID NO: 471190 - DNA, 577 bp, Homo sapiens
tttggccagcacctcgccacacgatgggtcatggtgcgttgtctccgtacctccgtgacttttctattctttgcaaacagcaggttctgccgggggtcagtgctgctaacacagacagcagtgactccacggtggcttccgttaagccaggggagggcggcacagaggtgctcccctggctgcagcatggggagctgcctgcgtggtttcgaggctctcagtggggggccagccggagcccagtggatgggacgcagctgagacgtctgcagccatcccaggatgcgcagaaccaccaccaggctgtgtcaactcccgtcggcgtagagcagctgatgcccgcgggtggactccgggttcagggcactgggaccgctgcagagacgccgtccccggcccccacctatacccgcgtcatcccccgaggcttctgaggactctgggctgtccccaaacctcaaacaaaatgtcactttaaaaactggtacaaaagcacctcttaaagattcaaacgataattcgaaaacatcgtggtggcgctgcccaggttcagctgtgagccggtccaggtgtggcc

SEQ ID NO: 471191 - DNA, 1002 bp, Homo sapiens
gcacagttcaatatggtcaccaccagccacaagtgggtgtcatacacaaaaaaagtgaaatttgacaagccagatggacagacagacaagccttctatgggcctagcgagaagtacagtgaactactctaaggtcgctgagcggcaaggcccaacaaaaaggcagtgctttgcattgataagacgatttcatttgatcctgaaagacaggggcagtcgcctatggttcccacactctcggggtctatctggtcatctgccccctcttccagatccctccattcccagctctaaaacattgcaagagcaaaatgatcaaagctatccaagtacactgcctgtgtttcctgaagtcgccctgcacacgctgttgtggggggaagatgcgaacaacagcaaagctgtgttcaccctgactctttctggtcttgtggaagtgaaagagctgcagcgggagcccctaacccctgaggaaatacagtctgttcgagaacaccttggtcatgaaagtgacagcctgctgtttgttcagatcacaggcaaaaagcaaaactttgaagtgggttcttctagtcagcttaagttttccatcaccaagaagtcttctccttcagtgaagcctgcagtggaccctgctgctgccaagctgtggaccctctcagccaacgatatggaggacgacagcatggatctcattgactcagatgagctgctggatccagaagatttgaagaagccagatccggcttccctgcaggctgcttcttgtggggaagggaaaaagaggaaggcctgtaagaactgcacctgtggccttgccaaagaactggaaaaagagaagtcaagggaacagatgagctcccagcccaagtcggcttgtggaaactgctacctgggtgatgccttccgctgtgccagctgcccctaccttgggatgccagccttcaaacctggggaaaaggcacttctgagcaatagcaatcttcatgatgcctaggaaggg

SEQ ID NO: 471192 - DNA, 699 bp, Homo sapiens
ggtgcgtctatcaagatcatcaggcattagattctcacgaggagagtgcagcttaaatcacctgcatgtgcagttcacgagaaggttcatgctgctatgagactaatggcaccgctgacctgacaggaggcaaagctcaggcatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttgatgagaatgttaaacatgatgatcgttgatgtttatatgagtgccaagatgctgtgtcttttagctaccaaattatatgcctttggtttcttacatcctctttcagatcatggtggatattctttagagtctactggtttatcctgcatgctgaatggatcttttacccacgtatgatttttgtaatgacattcattgttcattgggaaaatactggttcactgagttatgcagatctttcaaatgtttccagatttattatttaagatat

SEQ ID NO: 471193 - DNA, 667 bp, Homo sapiens
aactattaatcaaggaaattcgtctgtgattttctttttcttttttttttttttttttgcaatttgttttcctggttttggtgtcaggtcagcaggtgggggtcctgccaggactgggtccttctctttaaggtatggattcctttccagttcagggagtgtctagaaatgttatccaggagctagagcctggaataggggcctcacaactgtgcccaatgacttatcctactgtgactgagctggcatccaagatgcaagatacagtactcttactctttcttctcctgtcctcaaatgaaggaaaggtgtttcttgtagccatgaatgtgcaggttgagatgaggggagggaagcaggcagagggagtcaaagtcataggaataggtggtatgatgctggaaacagggactggggtgaagtgctttgaagatggaggaaggtggccacaagccaaggaacacaggcaaccactagaagatgagaaaggcaaggaaatggattctgtcctaggagcctccagaaggaatcagctttgctgacaccttcgccggtgaaatggattttagacttctgatctccagagcaatacgcaaatgaatttgtgttatattaaaccactaaggttgtacaaatttgttacaggagtagtattaacttcatatga

SEQ ID NO: 471194 - DNA, 1112 bp, Homo sapiens
tcccaggcgttgcattttggtggcctttgatcagctgggagatggctcagggcctgctgtcttctctttctattgagctcacagcgccatctcttgtcctcccaggtgtcctcgcaggagtgacatcgtctttaaatcctatgtggcaatccctgacgcaccgtcgtgatgcccacggaagacagggtgacctggaagtccaactacttccttaagatcatccagcttttggatggttatccgaaatgtttcatggtgggagcagacaatctgggctccaagcagatgcagcagatcctcaagtccctccgagggaaggccatggccatccaagggcacctggaaaacagccgagctctggagaaactgttgcctcgtatccagggaaatgtgggctttgtgttcaccaaggaggacctcactgagatcagggacatgctggcatcatcactaaaacctttgggcaccactgaaatcctgagtgatgtgcagctgatcaagactggagtcaaagtgggagccagcgaagccacactgctgaacatgcggaacatctctcccttctcctttgggctggtcatccagcaggtgtttgacaatggcagcatctacaatactgaagtgcttgacatcacagaggaaattctgaatcctcacttcctggagggtgtccgcaacattgccaatgtctgtctgcagattgattatccagctgttgcctccttcaaggtgttcttggttgatccatatgcctttgcggctgctacccctgtggccactgccaccacagctgctccttctgctgctgcagcctcagctaagattgaagccaaggaagagttagaggaattggatgaggatacaggatttggtctctttgactaatcaccaaaaagcaactaaatcagccagctttatttgcaaaacaagaaaataaaggcttacttctttaaaaaaaaaagtatatttaaaaaaaaaaaaaatatatatatatatagccaattcgtgaaataattatatttcattttaatgaaaaaaattggggggatgttgttccactttatctattttttattttactttttattttagactcaagggcacatatgtag

SEQ ID NO: 471195 - DNA, 605 bp, Homo sapiens
acactgatgctaaatcagtggcgtttaataagtgctgactgccatgcctggactcttggtagcgcccctgacacggctcctccatccgcacgtggccctcccaagcaccgagtttctccactggccattagcagttaggctggaagggggttcagagccacaactactgaaagtctcactccttgagtttggaagagataatgaacattttcctgaacattcaacaaacatggtcaagggggctggggattcccaagatcaaaagagggatctgtcacaagatcattatgtccagaattgttgggcacaggggtgtgctgtctcctatgtcactgtccgtggttctgaacccagctgggcaattctctgggaagttgggggcggaggaaacttgcacccattcctaggcccttgtatatatcgtaagtcctcacttcacatcattgatgggttcttggaaatgacaacattaagtgaaacaacgtaagatgaaaccaattttaccatcggctaattgacataaagaagaggtaccccaatcagttgtaggttcagtcttttcacataatcccatagttcttagaggttgtgttcattccttttca

SEQ ID NO: 471196 - DNA, 736 bp, Homo sapiens
cagaccgtgctgcagctgaagcaaaagcattcacgcagttgatgccagtgaggtttgcatggacttgggatgttttgcccaccctcagagccatccaaggggcatcaggacacaatgatggcaagggattgcagaggcaattattaaaatggacactagaaagtggggccagagattctggacagccgcctctaaagtgccagtgccttcattctgcactcctgctgccacacagaggggctgaagggaaccaggatgcagccacccagcaggagattgctctgctccccaacaatgcagctgacctgggcaagtatatcactggtgacaaggtgctggcctcaaacacctaccttccaggacctcctggcctgcctgggggccagggccctcccggtgagtgtggaagagggcacaggagggtgatcaccaacagaaaaagcctgccaaaagctcacatttgctggggcctggacaatgttctccagcttccatcgaggagaaacaaggcaggtgtccatgggactgccacacacccatgcaatgagagagcctgggaaataggccctcaagcctgagaaaccctcatagccaatagcaatgtgggagaaaaagctcattgtcctgggattggataagattcctaaagatcattttaagttaaaaaaaccaaatgaaaactatcttaaacctttttctggaaaaattttaacatatacaaaaatggaacagtatt

SEQ ID NO: 471197 - DNA, 565 bp, Homo sapiens
gcggctgtttacaactctctgtgttgtgggtcaagatagatgatgcctaaaggtctcttccccatcagcttccatgataaggtgtggatgtatgactggcagtccgcgaaaagagaggaagatggggaagccgcttttgatcgtatcaagtttaaaatgcctgtgggacagcctgatggagatgtcagaaggcaaaggcagagagagtacaaagagaaatggctgcaggggtcctggactcttgttagccagggccctttgtccttctcatgtgctggtccaccaggggcaccaggaagagatggttctaagggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcac

SEQ ID NO: 471198 - DNA, 921 bp, Homo sapiens
ggtgatcaggagtatcgatggaccactggtttaggctctagttaattgaatattctggttacatgacaggatctgcaactttctgccttctgttgcccaggggactgtccccggggaacggcacattcctggaaggtggcatgaggaaagggttccaaacaagctcagaacagcccacagtcctcacttctctgaaggacattacagtccctccgggttggagactggaggtagaatcttcatttccaagaaatggccctggatgccaaatgattatccacaaccctacaagcccggtcagattccgagtgtggggggcacacgctgttgccatgtctcactcactgatggctgccaccacagtgcaaacctgggaaaactatggttacagccagcgttttgcccaatcaccactcgctgaggcttttcaaggaagaactgggtggaaattggctaggcctgaggaggaatctgcaggtggggcaggggcagcgggtgacggggaggtggaagcggaaatgctaagaaagctaaatattgtggttaagtcggaaatgtggatttctgacccttttaggaggaagaggatgtggctgagtgtggcactggggcacgtgaatgcccacatgcagaggggatgcttgacaattaaaccacccataaagcaaggcattataaatggctgtcctctaaggctgtgctctcctagccgaatccgcacatcagccctctccggagacctgctggatggtcctcaccgccgtgtcatttgaaagcgctcttggcctttgtttcctcctagaacatacattgtcctgcaaagagcatgtgcttcaggtaaaattgtattggaatccagctctgttcctcacacactgtgcagcattggtgaatcccttaagtttcaacacatgtaaaaac

SEQ ID NO: 471199 - DNA, 2593 bp, Homo sapiens
tctgatgccaaaataaatccatggtgaaatagccaaaatggttttggattacagtgatagtgataattgtgacaatgaagatgatgttgttaacattgcagaaaaagggtctatagatgacatggtgaaaatatgtgatggccttatggaaagactagagcagtgtgtattcataacaggaccagaaatcatgacacaaaaattgacaacctgtaaaggagacatgggagcaggtgatagtgctttagaaatcaccaatgcagccaccaatgaggaagctgaattacagagacagcagggcacagaaacaggtttacagtggaattctgggctgagaatagagattcggtgcctgcgtttagtatggcattcagaagacaaagaacaggagactcgtagctgtcaaggaaaatcagaaaactgtgccgacagagagaagtcatctcaggctctgaactcagaagaagataattgctaacattatggttgtctggaaagagtcactattagggctttctccttccttttgtcgttatgaagcaacattttccataaggttgtttttaactggtgatgagcgacacttgatttcttttcttttcttttcctgctttgtaactcagaagcccaattttaaattatgcgattcttcactttaaaactttttcacgtttctctaatgatttaagtctaacaatatttcctgcttagtttctagcctaaggcagagctgtggaaaacattataatttcctgcaggagttctatttgatgatgtagttcatatcattggaaaaaatcatttgtaaccctatttccataaacccgtttttgacattggggaattatatccagacatctttcctagcgaggctacactaaaggcaatacgctgttttactggttctttctcctgagcctgttagagttcatggaccacctgaatgggaatcacccttagatctttgttaaaaatgaagatcctggcatctcatacacaagattctaatttagtagggctgagatggaacgcaggctttccattttttaacaagcatcttcaggagtttcttctggatacctgcagtaaatatgagacacattggaaataaagtttccccatacatataatgtgtactcatagacaaaatcaagtggaaaaatgaggtaataatttgactattttttgatgaaaatctttagtaaataggcatatcttcttagaggatcctgcaactcattttgttacaaaattgcaactctcacagcctcatttttttccccctatgtggccatagtaatgaattaggagctcaccaaatcagtcaaatagttgttcacatttggaggtttttaaaatataactcataaattctttgatatctctcccttcaaaagaggcagcctaatacctcccttctcatgaatgtgggctgctggagagagagagagaagagacagagggaggggggggagagagagagagagagagagagagaagatcttgtgatattaattactttttacctttgttcattcccacttatttatttattggtctttaacattgtttgttattatttctttgttattgctaaatatttactgttggttttttgtttatttattttgagacagatgttggccacaagtgatggacttagccgccagcttggcatgtctaaggttgaccagacagctctggccagtcagtgtactgttcaggtccagcagagagtttgaagatgtggaatgcaaacattttgattctttgctgtcacaaatcactcaactttttaaaattggcacttcctaaagcatctccattttcacacatcttttgaatataacattctaactattgtcagaatggcgggactgctatgagatggctatatcttcaatatgatgcaataactgttgacaaccactgtagtgtgcaggctactggagaatgatgtgagactatcacaatagatagtacatgtacattttcaacaaatatttgctaattgaatcatggctttattatagtattttgcctattattagtaagttgaccaaaataaaatatttactggaaaaagaataaaagtgggcactagttgtttgagtgctattatcagtgtaagtatgcttttgtctatctagctcatggccatgaatatgatacaggagctaatcaaatagtaatttagcttcctgtcattaaaaaagtctatgtacatctttaatgaaatcaaatcaattgaaaataatatccttcttagagtgaaaatttgtcaccagcgatgttttatataatcttgaaaaaatatgctatttgatgccatttagaatcaggatagaagtatttaaaatgcaaattataaaatttaaaggattctttttttctagcccacgtgtaacattttctgtgaatatattattgatttttccaaaataaaaacaataacatataatgcagtgcactctaaattcatggtttagagtgtttggagatctgaggatgtagttcttctataggagacttgaagtgagttttgatgtttcaattagtgccaattcacagcccacaagagctgtggagagct

SEQ ID NO: 471200 - DNA, 669 bp, Homo sapiens
gtgagggtccgcggcttcattcttgaagtcactcaaccataaaagacggccaccccccgaagcggccattttagaggcctaccctcagggacgcattctctttctcagggatgttccttgctgagaaaaagaattcagcgatatttctcccatttgcttttgaaagaagagaaatatggctctgttccacccagctcaccggcggctacacctatatcaatactttaaaagctttttgctgctttgaaacacaggattggtttcctgacaatgatttatgtactaatatctctagcatattgcctctttttcataataataaacctgttcaagttgggatattggaggagcacaaaagtgagactctgcccaccctttgcttcttctccctgctccaagcgtggaggagaaggaaggaggagaaggataaggagaggtgccaggacaccacttccaagattaaatttaagaagatagtgacttgttcctatttatactctcttgtccttttccgtggtttctctgaagaaagccagctgtcatattgtaagctccaatatgaagagacccacatgggaaggcgcaagatagaggagacctccaggaaaaagtctgtgagacgctgaatcctgccaaaatcccttttgtggatttatcccaagtcacgcc

SEQ ID NO: 471201 - DNA, 532 bp, Homo sapiens
ctcctcaagtgccgccaaagtgggagcccaggcagaggagacagccaagtctctaggagctatctccaagcccgtgaaaatgagtgcacagtgcaagctgcaggtggatctaccattccagggtctggaggatggtggccttcttctcacagctccactaggcagtgcctcagtagaacaaattcccattcacaattgccgcagaagaataaaatacctcggaatacagcaaactaaggaagtgaaagatctctggaaggagaactataaaacactactcagagaaatcagagatgacacaaacaaatgcacaggaagactcaataccgttaagatggccatgctgcccaaagcaatttttagatttaatgctatttgcattaaactaccattgacattcttcacagaacaagataaaatgtttaaaattcatttggaatcaaaaaagagcttgaataatcaaggcggttatgggcaaaaagaacaaaactggaagcacaacactacctaacgcaaactatactacagggct

SEQ ID NO: 471202 - DNA, 641 bp, Homo sapiens
tgattatcacacaggaaaagtaaacaatttagagaaaggcaatggtctcaagtggactgccttcaggggaggaagtatacctgaagcttggaaagccatccccagattcatcaaaacagatgggtaccccacaaatgagtgcaataggagattatactttttccctgaaatttggcctcaaagagaagacagaagccaggtttttggacatcactggaaaagtcagagaattggacatagagtccagtcttcttttccctcctcagagagaagccaagagctgggagtttcctcctgatcacgtggcaccatcctcggagaggaactatggtgagagaatgacacagattttcatagtaacttcgatacagcagttttctggtgtacggacacattttaactggtttctagatatttcaccgtagaaactggtttatgtattgtcattgaattagtgtctccatgggaagaaggaaggtctagggctacccattccgctatcttgctgatgtcacccctctaaatcattagtttttaaagatattatccaagatttgttgtcagaaatttagattttctttgaaatatgtaaatcatcttcttcactgaaactgttaattactcaagattcatcttctgtt

SEQ ID NO: 471203 - DNA, 1270 bp, Homo sapiens
aaaccatatcaatgggaaactgtcttttttacagataaagaaactgaaaatcgaagtggtaatgtggcttcttctaggacacatgggtaataaacagaaaatccacaaattaaagataccggttaagatgcatctaataagtgaagttaaaactgtagaaaaggtttaccctatgctgctactcactgtgtgggaggctcagtggagcaagacgtgtttctgtggagagacccagagatccccaaatataccaaattccattgaagacttaaagggctcaggagacaggaagatgtgggaaagtttggaacttcctagacacctgttgaatggctttgaccaaaatgctggtggtgatatggacaatgaaggcatgtcagcgaccttcacagcagcctctttcctcaccagccagaggcttagaagggaaaaatggtttcatgggctgggaccagagccctctggctctatgcagcctagggacttggtgccctgcgccccagttgctttggctccagccctggctaaaaggggccaacatatatttcaatcagttgcctcagagtgtgcaagccccaagccttggcatcttacatgtgatgttgggcctgcaggtgagcagaagtcaagaattgagacttgggaaccttcgtctaggtttcagaggatgtatggaaacacccggatgtccaggcagaagtttgctgcaggggtagagcactcatggagaacctctgctagggcagtgccaaaaagaaatgtggggtcagagcccccacacagagtccacactggggcactgcctagtggagctgtgataagagagccactgcctccagactccagaatggtggatccaccaacagcttgcactgtgtgcctggaaaagctgcacataacaccagcctatgaaagcagtcagtggctgggctgtctcctgcaaagccacaggggcagagcttcccatggctatgggagcccacctcttgcatcagacacagtgaaagataatcagacattagattctcataagaagcatgcaacctggatccctcacacgcacagttcccaatatggtttgcacttctatgagaatcgtatgctgctgctaatctggcagtaggcagagctcaggcaatcctactctatacttctctggtaaattcactctgtcattcaactcttattggctcttctttcctcaaagctctataaccttgtctttcttctaactctaagttactaaccatgccattcatgaatagaaaaa

SEQ ID NO: 471204 - DNA, 550 bp, Homo sapiens
tgagaacgtcaacagcacctgccctgcctatcacatgtggccattgtgtggatcaaatgacatctagaatatgcaagtggcttgttagctgcaaatgcctttgtgaatatttagtattatttgccctggaagataaatttgattttcatctgcagaatccagttttcccagtgaatttttatgctatggtgcaatgtggaaaacagactgggaaaggcagaggagatacagagggcctagttagagacatttcaatagttcaggggagatatggtggaggtaataagtatgaagtcaaggtatacactggtgatgtaattggtgcagggacagatgctgatgtcttcatcaatatttttggagagtatggagacacaggactattttgtagatggggttcccacaatcctggcagaggaaggcagcttgagccccactttgggctcctctattgagcatctcacttcttgtgatgtggtttggagtgacctgtcctgggcagcaggtgttcattttgtgttgtaaagtttatgtgtgtgatgtgttttcc

SEQ ID NO: 471205 - DNA, 614 bp, Homo sapiens
gcagcattatggctcttcacaaaggaaggctcttcacagaggaaggtagaaaaatggataataagcatatgaaaaaagctatccacttctcttcctccaacaccttctttagccacagagctgcctgtcagctcaattatgttattttctccagtagtggggacagcttggaagcagaagtggatgacgaagtcatcactgactgtggattggccaggaagcagatcatgaagaccaaatgcactaacaccagggaggcacttacaacagtgcctagcacccaacaagaacccagtgatgctgttgttgtagctgttgttgcttttcagagctttggagaacctgaggagcagggacagggtggaacatgtggtaatgacatgggtgtcttcactctgtgataatttatggagagctgtatgttatgatttgagcacttttctgtacatatgttacacctttttgaaaaggttaaaaagatggtgattttgtagcatgcagttttgaatcctaatgtatttttaaagttcatactcaattacttatacagctctcctctgcatccattcaaatgacattaaaaattatgtttaagaatctgaaaatatccaggt

SEQ ID NO: 471206 - DNA, 657 bp, Homo sapiens
gcacagctttgggtgccctctgaggcgtgcactggctggtagcagtgggtatcaaccatggaagttcacggaagattaaaccgcaagttcccacgcaaggccaagtggctgccaggacttggaggcactgaccctgagtggtccttccacctcagctcagcgagccctcagccggatgctcccgtgctggccactcctgtcatccctgctctgtcctccctgcaaactcctccctcaggaccctgcttgaagttacgtcctgcacagtcatccctggccttccctcagcagaatctgtcactccctcaaggtgtccctgcagtattctgctcatgcccctgctacgtggcagaactctgttgtcctatcctgtccagagctccaaagcccccagaccctgtggctgctgagcacttgaaccatggacagtccaggagcaccctcaaagccatcctgggaggctccactcagctctgctccagggaacaggatcagattggaacctggatgaatgccaagaagaatcttgtagttatctataagatcatcttctaattcaggctagagaatttcaatgaacgtgaactttgattttaatgccctacctgttactgcttggcattgagttggcagtactgacaaatgatatgaacgtgt

SEQ ID NO: 471207 - DNA, 566 bp, Homo sapiens
ccaggctggccatgcaggaagggagcaggattatatcatcatcatcatcatcatcatcatcatcacgtgtacttaatgatcagcctagtcaacatagtgagaccttgtctctacaaaaaatcaaaaaattagccatgcatagtggcatgtgcctgttgtcacagctacttgggaagctgaggaattggacgttgaacttgaagaagagaaggagacatgtcatgatggtttttcaccatgataccatgatacccataaagaagagagattcacattatttcttgaagtcccagagagagtttaacagagggccatttggtagaagttactgggagagagaactgggctcagtatatgaagatccttctgcagactacattgttttaaatgggaatccaaagagtcagcaaatgaatcctaggactggaggattgaagactaggacgtgagaaatttctggaacagaatgattgtcaaatttgaagcctatagagataatagcaagcaaatgatcagaaagcaaatgacggattcagcaatgacaatgtccttagtatcattgacaa

SEQ ID NO: 471208 - DNA, 716 bp, Homo sapiens
tgtgcttaggccacacttaagaattcattaccattttagctgtttccttccaacctgctttttctggcagccatgtcctcctccatttctgacaaaggcaatgaaatccacatcctcctaagcgaagcagaactcggcctcattcattttaacaaacatttgctgaatgccttgcttgtcaggctctgcacatgcagacaagatgaaacatggccttcgctgtctgctcgcagagcatctactgaatcagacgaggagctgtcactgcaggatgtggtcattgtctttgtttatgacaattgggcacccgaggctgtctgggacagccaagagagctttcatctggaaagtaaagctcatgtggatgtcttgcagaggaatagaggtttccaggtgggcaaaggagggcctggccctgaaccccaagtttgctgctggagctccctgacagtcaccagccatctagattttataccagacaactccccaccacaaacacaagcctatgcagtcacaaaagatggcaaaaactacagccttgcacaaaagccacagtaaccttacatagaaaatacttctgcaaggacgtctatccagcaactgccgtctaaccttggactgatgccacccttgttattgaaccttgtaggcaacgatacttgattcaaaatgcttgatgtatttcttctcattttgcctttaaaaccttccccttt

SEQ ID NO: 471209 - DNA, 939 bp, Homo sapiens
tgcctgctaccaggagcctgagagctgcagggccgactcaggattggtacatcgtcgctgctttagcgtgcttctatcgccacctagccaccttggggagaaatgccctctccgagcaagtctgtccagacttcccctgaatgtagtttgcccacttacagctatgagcaccatcctgcatgaggttcctcagcaggggactgagcactcgcaggtcgctgccaggacgtgcagaggaaagcaagaccatcgcgtcagtgtgggaaaagtgaagagcgaggcccaggactctgagagaaaggagtcctggcccagaggttgtgtgaggaaagcatcaggcctgtcatcgtcactggtgaccctccctgccgggggaggtggccctggcagcaagcacctgtcctgctggctgagcggcagcccacgtgtccggggcagggtggccagctggccagctgggccagagcccagagtgctgaggctcgcagcccgatctcggcagtcctgtaccgtcgcatcaggccacaggccacaggccacaggtggctcttcccgcatgccggaggaaacacaaaatccctgccagcagagaaggagcggcccagccacttgcctgtgggtcttgcctgtgggtttcatgaaatgtgcgactctgatctcataccccttagaatttctagtaaaagatccagaatgtctgacttcccaagaaggaaccttcatgggaaagaataggcaggaatgttttcagagccagttcctcaatttctccaggttccaaaaagctgcaagaccatactcacctcttcagggtctccacatcccctgaatatcatattcagctgttgttctcatcacatcttgagtaaatttttgtggctgtttctaattattccctctgcctggggagttcattttgcatcaccgtgttactttggg

SEQ ID NO: 471210 - DNA, 1123 bp, Homo sapiens
ggtggaagttttttcttctcgatttgtttcattaagatcaatggcaaggtctgaactaatgtaacctaccctgctggattcatggacgtcatgagcactgacaagacgggagagaatttccatctgatctgtgacaccaaggctccctttgctgtacatcgtattgcacctgaggaggccaagtacaggttgtgcaaagtgagaaaaatatttgtggacacaaaaggaatccctcatctgctgactcatgatgctcataccatctgctaccctgatcccctcatcaaggtgaatgacaccattcaggttgatttggagaatggcaagattactggtttcatcaagttcaacactgagaacctgtgtatggtgactggaggtgctaacctgggaagaattggtgtgatcaccaacagagagaggcaccctggttcttttgatgtggttcatgggaaagatgccaacagcaacatcaacaaaccctggatttctcttccccaaggaaagtgaacaatatatcctagggtttttgtgtcaatacgcaagggcctctttttttcttttatagttgtacaatgtcctctcctgttggtgtaccacagtttatttaggcagccctctattaatggatacgtgggttgtttttaattatgaagtgtgctacagtgggtaatcttgtacatatatcattttgtgttgtgcagagggggatttggcaggatcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagagcaaaatgaaaagtctcccatgtctacctctctctacacagacacggcaaccatccgatttctcaatcttttccccacctttcccccctttctactccacaaaacc

SEQ ID NO: 471211 - DNA, 789 bp, Homo sapiens
aaaataattcacacggccaaagatttgaagagcttcccggttgaatacatccacatgcagggagggtgactgaacccccaactccatggggacagaagctgctgtgcttgggaatcttgcgaccttgccctatgtacatcttcatctggctgttcatgtgtcctttgtgcagtacagtaaattgcctctgctccagaatatttccaatgctgacttgcgaccttctgctcagaagggcctggagagtatgctgagttctgggtatttccatggctggagatttcacaagctcatgcctgacccatgtggcctggagaatttccttgggttgggtttctggtttgctcctgccttccctgtgaggcagcagcagttccgcccgagccgcttccctcttcagtattcactgttcagctcctgtcaatcccactgcataagtacaaattcaacttgtccacccctcactgagaaagccaggtacacccccatggagaaaattgcatggatgtatttggaattaactcaattgatgatgtataaaaatacttaaagacatttgggaaactggggctggagttttgttcaaactggcagtagcagaaatttctataactaaaagtaaaaaaggcagaaacaggactggcagtgatgggtggagggtgagtctttgttataattgctatgttttgtttttttgttttttaagtctatgtgtaccttggttacaaatatactagtacttaccttctagggttgtagtaaggattgaattggtgaatatatattaaa

SEQ ID NO: 471212 - DNA, 727 bp, Homo sapiens
tctgaataaactatagacttcagttaataacaacatatcactattgtttttggaaatgactcagaatgcccagttactccaccacattctaccctgtaggaattgtgataaagaagcagtgctttccggtgatagctaggtgcaataaaaccaaacaagtagattccatacctcatcgtgcatatgcaaagcctagcccattctttcctgcagtagttggatacaaatcctcaaaaagatctaatggatcatggaatctaatgccctatgaggaccagagggtccagaaaaaccccgggggtgggagttgtcttctaggttctgagatgaataattccaggggctgcatggcaccggggcatctctcccttcttccagcacgcagtgcaattttctttactctgctggtggctcattgtctatctcttcccaataaagtgcaaactcacagggtggggaccctctggtttgctcactgatggtctctagtgctgtacctgcctggcacagcttggggctccctaagaacctgctgaatggacaaaagggacattttcaaatattaacctgttgaaaacagcttattccatatccagttcaggtgtggaagcagatatcccctccatggctgggtgagtgggctgcagaggatctaggttgtcatccctacccccacaggagtcagggcaggggtcacacatttctgtttaagcttcttcttgggtta

SEQ ID NO: 471213 - DNA, 1517 bp, Homo sapiens
tttccatctctggcataatcaaccacatagtgacaatctcctaagttgatggttgattctgtggccactgcagtgagtgtgtgtgtgtggtcacatagtgaaaatgcactgagtattcactatgtacgaagcacgttacacaactgccctttgaggaacggcaagggggacacccaccccaaccaggcctttcctccaacactaggaattacaattcgacatgagatttgggtggggacacagagccaaaccatatcaacatccaagcctatgtcagatcaaggcctagggaactcgtgcaaaggcagtatcaaatgcatccaacttcgccaggaggagggagctaaaggatcagaccaggtgggatggagagtgaagggagaaagtgcaagtagatgccagagtggcctgattttgtgggtcacttgcagctgctgcaaattgaaggtgcctgaagccaacacatgcttcctctttcaaagagatggaggacaaggagcctgtgcacaactgaaattcaccaatgaagtgctgaggagctgtggatttatctgcatatcttggacagaggtcacctggggcaagaatagctgtcacgattcagcagctgatttaaatatgacatagctgtcattcaggaggatacatgatctgtgattttactaatattttaggtttacttggtccttctatcctttcctatctacaagtagcacacttggtatttccattcttttaatctatgcttaccaaacatatgttctgtatatgctatttatgtttaacctaaaagatttctaacttagtacatttgctatcattcctcaacatgttttatgagtgtcacctattgttctacttgtttgtttctcttgttaatttcagaagaattgaatattctcaaatactacagaaaaatcacattatagaagtaacgatagcataaatagactttttgtactcaacacttggctgtaatggaaaagagaaaaaaaagttattgctatagggatttacagaatcatgggaagcttaaaaaaaaagaagctgaagataaagaacagccagagacagaagttaatttgatgaagcatgattactgagagagaataaaaggtggagggagaattggtaggagatcgtattctcttacaggagaagagggaaggaataatgggtggcaatgcaaatatgtatccagtggtgggtgggattcaccaggtgtgtttcagtttactttgtgaaataatttggctcttaaataagtacttccaggcactggttgattgatttacaaatgtttactttttattaagtgtggtgtggtggccttgtaatgtattgacttggctaagctgaactacgttttccacaattttgtttcttgtatgtttctggttatggtgggccacgagggagattcttgtgagattcagaaagcagatgggaagctgcagtcattttgtagctcacacacattgttgctgatctgctgactcacctcatcagcatgaagc

SEQ ID NO: 471214 - DNA, 2237 bp, Homo sapiens
ggactggctctccttgctcctcaagcttgcagacagcctattgtgggaccttgtggatcgtgcaaggtaatgttgattctcctctggagccacccccaacacctgtttgcttctagacctataactagactaaagtcccagtcggtccctagaggtgaggttgagagtgtgacccatgaggagagagacctccagccttttaccagtgtgactgtgcattgcagaaagggaaatgaccagacatttgggggaccactggacgctggctctgagctgacattgattccaggggacccaaaacatcattgtggtcccccagttaaagtaggagcttatggaggccaagtaattaatggagttttagctcagtgccaccatcaaggacttgaaagacgcaggggtggtgattcccacaacatccccattcagccctcttatttggcttgtgcagaagacagatggatcttgagaatgacagtggactattgtaagcttaaccaagtggtgattccaattgcagctgctgtatcagatgtggtttcattgcttgagcaaattaacacatctcctggtacctggtatgcagccattgacttggcaaatgcctttttctccattcctgtccataaggcccagcagaagcaatttgccttcagctggcaaggccagcaatatacctttactgtcctacctcagtggtatatcaactctccagctttgtgtcataatcttattcggagagaccttgattgcttttcgcttccactagatatcacactggtccattacattgatgacattatgctgattggatccagtgagcaagaagtagcaaacacactggacttattcacagctcttggcctgttactggctttggtggaaactgaacatttgactataagtcatcaagtcaccatgcgacctgaactgcctatcatgaactgggtgctttttgacccatctagccataaagtgggttgtgcacagcagcattccatcatcaaatggaagtggtatgtacatgattgggctcgagcaggtcctgaaggcacaaccacccctgtcatttcccaatggccccatgaacaatgtggccatggtggcagggatggaggttatgcatgggctcagcaatgtagacttccactcactaaggctgacctgaatacagccaccgctaagcgcccaatttgccaacagcagagaccaacactgagccctcaatatggcaccattcctcagggtgatcaaccagctacctggtggtgggttgattatatgggatctcttccatcatggaaagggcagaggtttgtcctcactggaatagatacttactctggatatgggtttgcctatcctgcatgcaatgcttctgccaagactgccatttgtggactcacggaatgccttatccaccatcatgatatcccacacagcattgcctctgaccaaggcactcactttatggctaaagaagtgcggcagtgggctcatgatcatggaattcactggtcttaccatgtttcccatcatcctgaagcagctggattgatagaatggtggaatggccttttgaagtcacaattacagtgtcaactaggtgacaatacttggcagggctggggcaaagttctccagaaggtcgtgtatgctctgaatcagcatccaatatatggtactgtttctcccatagccaagattcacaggtccaggaatcaagggctagaagtggcaccactcaccatcacccctagggatccactagcaaaatttttgcttccttttcctgcaacattacagtctgctggcctagaggtcttagttccagaggaaggaacgctgccaccaggagacacaatgattccattaaactggaagttaagattgccacccagacactttgggctcctcctacctttaaatcaacaggctaagaagggagttacagtgttggctggggtgactgacctggactataaagatgaaatcactctcctactccataatggaggccgacctccggggaccttgtgtctccgtctcacttgtcagcgaccctgtgttacagagaccctcctgcctgaccaatgcagccaagaaatgactattttcagccttccctgcccgactccagggcccggtcagtccgaggacagaatagtcatcctctccctaggccaagcatgtgaccccagcctgagtgcttcccgccccaatgaatgagataatga

SEQ ID NO: 471215 - DNA, 2212 bp, Homo sapiens
cctccacttcccggattccaggtgggcaggaattgaatatggctgttatctttctaagaggaaaatgctttaggaagacactgacatacagaaagaacagccacatgaagatggaggctgagattatagagttatgtggccacaagccaagaaactcatgtggccatcagaagttggaggagacaaggaaggattcgcctctaaagactttagaggaagcatggctctgccaggacatggatgaggctggaaaccatcattcgcagcaaactaacacaggaacagaaaaccaaacactgcatgttcttactcataagtgtgagttgaacaatgagaacacatggacacagggagaggaacatcacacaccagggcctgaagacagagacacaccaggacaccagggatgcacacactcagagaagaggccaggtgagggcacaatgagacggtcatctgcaagccaaggagctcaaggggtaatttggggccttcgtaatgccacaatcaagccaatgatttagcagagcagggtccataagtgatcagaatgctaaggcagaggagccaggatttaaaatttaatcttcaggcctctgacttcagaggtggtactcttcaccccgctctatctctgtgacaaccaagctgactgcctcctcagtattcccacaggtctcctattttcagactctttgagtgtttcccatgtctccagttgaaaaactctctgaagtaccactcctaggctcccctgaagaaactggctgaggctgagactttatctcccttggcttctttactcccttcattccacacccttatgggtctctgcagagagttcttgctcagtaaatcacttgcacacagtgctcatctcaggctccacttctggcaaacacaaactaagcacaaagggttaattactagagagagattttgagagaaagtagaagacctcagtgtgtgaatagtgatgttctttttaacacgcgataaacatctctacagatggaggtgttgaggaagcgtatgtggggcttgtggaaactgaccaataaaatgacacagtgggagaaatccaatagaaacaactatttctgaacgcttgagaatatgcacatgaggttgactatcatatgtataacagaagttcattcaatgaatttcacaatattctttcactctgctcaatagcttgatgaacagttgcaacagcaacaaaatctctcagtaggtagtaggcagagactcagcatgtaattcacattttgaaggcatagaaatagaaaacttttaaacctaaactatcttaatgttgataaaatcccatcacatgctatacactttcttatttaattttcattgaagaagcaaataaaagtggaagaaactgaggtatagtcaagaaatagtgtataaatttgtttgattgaaaaggtactttcaatacagaaatactgagaaatgaaggtaggaaatgacacttcttccctgatttcagaggagtataaatatccagttaaggagttttgaattctctttgaggttttactaaatctattttagtttgaaagtgacaatgaagaaagaagattaattgtgggtcatatagttttaaggatattaggttaagtgaatttttcagtaatttcaatggaaaattataaaggcctctcctatactaatgctacatgggtaaaaaaagacaagctatattttgaaggaaaagaactatcaaattaaacaaaaatttcaattaaatatatgcacacacttaacaaacactactgagcatctcctataaacaaaattccatgattataataaatgatatataatcatatttcatttctttcattccataacatttattgttcttattaatgttcaaattgtctcttcttttgccaaggatgtcttcttcaaattgactctcaagtactttttgataacatgcttaatttatgatctgataagatgtaccagcataattaacatatatacataaacatatgggagatatatatatatatacacacaaaaatgcacatatgtttatgggaatatatatatttatatatataaatatatgtttatgggaatatatatatttatatataaatatatatttatgggaatatatatatttatatataaaaatatatgtttatgggaatatatatatttatatatataaatatatgtttat

SEQ ID NO: 471216 - DNA, 835 bp, Homo sapiens
agaccggagctgttcctattcggccatcttggctgccagaaccgaaaggtaaaatgaggctgagacctactggattacattcccagaaggttagaccttctaggtcacagggtgagatagaatgtcggcacaagatgcaggtcacaaagaccttgctgataaaacaggttgtggtaaagaggccagccaaaacccgccaaaaccaaggtggaccaccaccttcctatgcccactacacagtaataaacaaatacattgagacagtagggtttgcagcagagaaagactttaatgattgcaggaaagctgagcaagaagacaggaggagccctcaaatccatctatctgaggagttctgggctggggattttaagagcatcattgaaagaacagtttcacaagtggaggttagcatattgttttgttatcttgaaaccaatcactgctccaagaccatacttcttgcctcttgatatctccaggagggatgaaacttcatctaactgggtggatttgccacttatcacttaaacaggaatttaatggtaattttcaggattttctgcatccttagaagtattactctatttgctttatagaagtggttgtaatagaatatttatatgatgaaaaattaattttggtgtgtatctaggcaaaactggaaatattctacagaattctggtattttttcaagtgtaattgtaaagtattaattgacagtatcttgcttaaacggttatattcatggctaccatttagtcatggttttaactacttaagcaaaaattttttaattagtaaaatcatattgtgctttttattagtttattt

SEQ ID NO: 471217 - DNA, 625 bp, Homo sapiens
ccctttgcacttcctgggtgagatgctgtcatgcttgagaagtagtcacgttaagagtatgacagcatactttgggggactaatgattgttcagggcaagactatggacaaaagaaataaaaatttaaaaggcagagagaataaaagaaggtatatgcaatttgccccatccattgacggctttcggatggcactaatattactgaacatccaatgccttagtcgtaattataagagatttattgaatgcctgaaaaagtgggaacagaagaagagtgaggcacaaaacactcaatgggtgcagttgacagaaaaaaaggctgaaaagcaaacttcatcttttgcagttaggccctatgatatctggaagctatctggaaacattgttttggtagagttttcataattcaaagctactcagaattttatttgatatttgtctttaacagtggtttgtttagttgtctgttctttaaaccattagtgtgtatcgcagtgtgtaacatggagtagtgttctaactcaattttttattcttcacttatggcagtaattttccaccaattgttgactaagaaataatttcttaaattatttaaaatgccccctttatcttaaatttaaa

SEQ ID NO: 471218 - DNA, 602 bp, Homo sapiens
ttcatgacgtatgaaccctctatgcttaacatacttgtctccgaagaatctgtcctctgccctgtcttctttggagtacagcacacttcctcattgcacctcacctttaggggcctctgggacttgagtccagtcattgttctagaagaaaagaggcatggtgggggtgggttcccaggagaaccagcattgtcttatttgtcaactgcctcagcagatgccattattgtttcttcaggcaatgcatggttaattcctccagacagaggcagaaagatgaaaaccactgtgagggctgttgccactgccactgggagtagggaggccacttcccctggcaaaaaaggctcatcagaatttaggagctcattgtccccaagcttcatcggagtcctcccatacatccttattccaatgtacagtatcctattcttttccaatcaatgtcctcattttaacagtagtcacactacaaggctgagagttcaccttttgttgtaagtcagctaatgacatgatgagggcttgtgtttgattttcaacaatcgaccttgtggctacaggagagaagattctccttcagagaatacttagaagctttt

SEQ ID NO: 471219 - DNA, 628 bp, Homo sapiens
agcagctgaagactgacactgcctgattgcttcggaagccccctagaccatcacagacgccgagcttcaggtaactctcacagtggaagattattgatggcagttccgccaggcctaatcgccactcagcagcaaaggcaggctatgctacagtatcttccacatctgtcattgagtgactctaaatatgcctttcatattctgcaccaccatgctgttatacaggctgaaagaggtttcctcactacgcaagggtcctccatcattaatgcctctttaataaaagctctgctcaaggctactttacttccaaaggaagctggagtcattcactgcaaaggccatcaaaaggcgtcagatcccattgctctagacaacgcttatgctgataaggtggctagacaagcaggtagctttccaacttctgtccctcacagccagtttttctccttcacatcagtcactcccacctacccccccgcccccccgctgaaacttctacctatcaatctcttcccacacaaggcaaatggttcttagaccaaggaaaatatctccttccagcctcacaggcccattctattctgtcgtcatttcataacctcttccatgtaggttacaagctgct

SEQ ID NO: 471220 - DNA, 1320 bp, Homo sapiens
ttctcacgagatctgatggttttataaggggctctgcgtgcttcgctggcacttctctctctcctgctgccttgtgaagaaggcgtctgcttccccttctgccatgattctcattaatcccacatataaaggcaatcaagtatatcttcacagatgccttcaagggcttcctgtctcagagcagaggtcaaaagtcattacaatggtccacaaaacccttgtgatgtggatgctgagctctttcccctcacccttgctgccttttcctttgcccctgacctccacttatactgagtcctcattcctctgcaacacagcttctccctcatggtcaccaaaattgattgcccttctccctgttatctgcatggcctactcactaacttttccagatctatgtttaaacttctcaacaaggtttttcccaaaaatcctatttaaaaaagaatggccctacttctgggcacttcccgtcctcctttctcctttccttcttttctgtttcacctaaatttatcaccatctgccattctggacattttacttaccttatttattgtagtccctccccactgccagctataatccctaagagctaggcatttttttttttaacttgttttgctcatgctgtattctggccctgagaatagtagaatatgagagagacaataaatacttgtagaatgaaatgaataaattatcgcattgtaacaatgccacactttgcaatatatcaagtttcttaataattgaggtagctctaatacatactttattctcagagacagaataaatgccttcctacaaataataggcaaagctaattagcaacttagcactcttattttggccagaagccaccttgactgagttctataatttgtgaatataacctagctcttagagtgttaattaatctgttctttcaatagccacattttcaaaagaattccttgtttattttaactataactttctttttctatactgaatttggttaccactttactaccttgcaatagagcttcttgtgggtgggtgtttagttatatgtggctatataacaaatcatccccaatttaatggcttaaaataacaattattattgctcttggtttggtgggttaactgtggaaaggctctttcttggggtctgttagagaaaaaatgattcaatgatattgttaaagcatcattaaggatagcttattcaggacccttgcaataggtatagcaatcactgcaatggggtctcacagtggaggagagagattgggccaaacttgactacaacatgggcaaatggaaatttatagc

SEQ ID NO: 471221 - DNA, 577 bp, Homo sapiens
ctgtgtatgacttgctttattgcagcagtctggaaccaaaccctcaatatctccaagggcacaatgcccatcaaacactctggacttgttgtaggaagtaagctccaaggagacacaaaacaaagcatccatccatccatctccaaaaacgttatgcctcttgactgtgcttcctatggtgatgtctttttgctattaaatggctgcacagccagggaaagcatgacaggttttatcagccttgacagccgtctagaagaaacagcaggcaacctaaagcgtcaacggctgtgtgcagctctctcttcaggtcctgccagagctcgcaaagctgatatcttgaaaaataagtgtgtcatccaggacaagtgtgtgcacttcagaaccagaaacaactgggatttcactgattctcaggtcaatagctctatcttacatcctgtcttctgtttccagacctgcactaaagctgcaaactgacatctctaagtgaaactcattttctttgtctccgaaatactgtggccttgttaggggttaaagtgatgttcagaaaatgaaattaaatgatgcagaa

SEQ ID NO: 471222 - DNA, 787 bp, Homo sapiens
ctgcctcctcaagtgggtccctgacccccgagtagcctaactgggagacatctcccagtaggggccgactgacacctcatacagccgggtgcccctctgagatgaagattccagagggaggatcagcagcaacatttgcccatctgcaatatttgctgttctgcagcctctgccggtcaaactccaacagacttgtagctgagggtcctgactgttagaaggaaaactaacaaacagaaaggacatccacacaaaaaccccatctgtatgtcaccatcatcaaagaccaaagcaacggaacaaagctggatagagaatgactttgaggagttgagagaaggcttcggacgaccggtaataacaaaattctccgagctaaatgagtatgttcgaacccattgcaaagaagctaaaaaccttgaaaaaagattagatgaatggataactagaataaacagtgtagagaagaccttaaatgacctgatggagctgaaaaccatggcactagaactatgtgacacatgcacaagcttcagtagtagattcgatcaagtggaagaaagggtatcagtgattgaagatcaactgaatgaaatgaaagaaaaaagagtaaaaagaaatgaacaaagcctccaagaaatatgggactatgtgaaaagaccaaatctacatctgactggtgtacctgaaagtgatggggagaatggaaccaagttggaaaacactctgcaggatatttgacaggagaacttccccaacctagcaaggcaggccaacattcaaattc

SEQ ID NO: 471223 - DNA, 713 bp, Homo sapiens
cacactcacacagcttaatctagttaattcttacccaacgtttatgaataagtctcacaagacctggtggttttataaggggaaacccctttcacttggctctcatactctcttgctgtcgctatgtgagaagtccctttcaccttccaccatgattgtgaggcctccccagccacgtggaactgtgagtccattaaacctcttttactttataaattacccagtattggtacatagcaaaagtgtccaccattccctgctggctcctttatctcctatatctgtggaggctgcttctgtcagtgctgggtttatctgtctggagtatgcagacttggttgctggcatgtccacagtgcctgctttggtgacagccatgctgctgcccctttgcgaagcactgcaatgttgtgactccgagaaggaatgtgtttccatgtgcaggaatgttgattttcttctccatcagtgtaaccagaagaggggtcaacaaacagaggccataaaaagattcctgctgtttacctgaactttataaccttctccatggacctctatgtcctctggactcttcttgtcttctgcctcaaacacaggtatgtccattgtgtctccagctgggatggtctacactacctacactactggaagcttccaccaatggtcttaggaagtaaacaacttattctcagtaacttcaaatgccttttctc

SEQ ID NO: 471224 - DNA, 1061 bp, Homo sapiens
gggaagagctgcccaatgtcatgggagccacctcttgcatcagcatgacctggatgttattcgggggtacagatggtgcttggttgcatgaaaacccctgcatggccattcagacaaaggtgttactatattcagtcatcattctcattgaaggttatcaccgagaggaaagtaacttgaaaatttcgaagtgcatcttgttgagggtactgatgcgattaaaagaagaagaagcagcagaagaagaaggaggaggaggaggaggaggaggagaaggaggagaaggaggagaagaaggaggagaaggaggaggagaagaaggaggagcagaagaagaaggaggaggaggaggaagaggaagaaggagaaggaggaggaggaggaggaagaggaagaagaagaagaagaggaagaggaagaagatgaagaagaagaagaagaagaggaagaagaagaagaaagagaagaaaggagaagaagaagaagaaaaccctgttaaatgttaactagtaaaatatgaccaaggaagagatttgacttgatgggggaatgctggtgccttagggtgccgtctggatgggttacaaattgtagtagtcaatgaattcaatggctttttattttcctgataaatttacatgcatgtctcttaatttcaagaagataaaactttttttttttttttttttttttttttttttttatgatttgccagcctgtgaagaagacataaagccatttgggaatattgctgggtatatccatccagttaggaagttctttcttttttctgtaaacagtaagactgttcccagtaacatggcctcgtcaaaaactgttaaattagatcccatagtgtttgtggggatggtaaacgtcacactgacatggtacttatgttttcattggtcacttgcagcagaactgacatgttcctcactcttattttttaatgaccgtatcctccatgtgaggctcacctctccagtaactcatgcttcttacttttacaattcacctaaacgtgattttcttgtgaggctttcctaggctaagccaac

SEQ ID NO: 471225 - DNA, 590 bp, Homo sapiens
catccaattcatgtcagttcccctcccctgtctttccagctgttcagtcgtattcccacttcccaccaccatctccccgcaccgcacgctggccacgtggaagggtcacgcagggattcagaaccactgggtactccgggttcacagtgtgatctttccaggatgccacttactgactgaggacttgggagcagtcctgctcagtcctgcaccccagccacctcagtccttgcccctctggcctgccctgcccagggtcaccacatcccgcagggcctccttccccacagagtacctcacaccttgggcaccactctcccctcccctctacctaaaatcaccccttcagacagcttctggccacatcgcagctgtcaatcagaaaaagaaggcagcctcatttcaagggcatgggtcaaagcagagtgtacccactttctggatggaaagcatctcactccagcacatgggcctgaggacccatgatctctattggcactgacagatgattctacccctgctgtgggagtcagagagctgtgctgtaaagaatgactggcagatgtccctgaaccccttcctccatggac

SEQ ID NO: 471226 - DNA, 757 bp, Homo sapiens
gcggtatttttaatagaggcttttcagcaagctcaagtgattgcaaagggggcctggggaggtgagcccactggaaaacaatgtgtgcgcgccccctgctggctgcgagcagaggtcccgcctgtccgctgggggtcttcaggtggttcgtgttagcaccacctgctgctgccgggtcaattgacccaatattcacagatcaccccccaggtgtcagcaaagaaatttgtaagaaaggcaaactgtcaggccccaccccagacccactgaattgggaactctgcggaagaggcccagaatccgtgaatgagcgtaccaggggcttccgatgcatctctgagcaaagcaccatatggcagtttcatcaggcccacggcctggtttccatccagcccactctaatttccttccagtcatggatctgcagaataacccatcctgtggaaggagctcagaggaagaaaaagataacaataacagtaaagatatacagagcacaaaccacagcggggagctgttccaattatgtgtatgtttgacgcttgcaacagctctaggaatatcgctgttagcatccccattttatagatgacaaaactgggagacagatgttccgagacattctcaaggtcacatggctagtgatgacagagctgggatgggagccatgttaaccgtcagactttgctgattcgctgaatcttggctaaaagatgttggcaggaagggctgagagcttagaagaaggggtcctccc

SEQ ID NO: 471227 - DNA, 581 bp, Homo sapiens
tacgcaagagccactcgagcatgaaatcccaggaacaacgtgattcgctgagaagccccgggggaggaaagcctgcaccgcctgccaggacctgcccagcctggggcgcgcgggcagccgggctctccacaaggatgctattcactgacctggttgggttaaaacaaatacccacaccccaaaaaggggggttggagaggaaggaagccttggacggcaagaataggcagaaagctggcagggcggccgaccaggccacagccagttcccactggcccacaccgacctggggatttccaccgtccggctacggagacccgttgccgccggcgctttcctgctggggccaccagaaggcggggcctcagagcgggaagcccctccctgcagcctcgccatccctcggtcaggtctgggctcggaagagcattcccagacattatttcaccaatccctacatcaaccctgtgaagtaggtgttactttcatcaacctcctgtatagctgtatagacactcacccaacatgtactgtcctgtccttaggctaggggccacatgattgtggcaggctacagtcct

SEQ ID NO: 471228 - DNA, 676 bp, Homo sapiens
tctggccagaggtgatattcacaaattttaacaacctgcacagcaacacagccccagcaatcagaatggacattccaactgcgttaggatcccggagacagaaggagctaagtagggacctgcacagaaagtcaggctttattactgaagagctgaatgcagaattggcagggtctccgactgccttcctcgaatctagtccttgcacaactctgacaaatcttccaattgcagctaaagaacttagaacccagagagcaaggacccacctgaacctgccggcaggagaaggcctgctctgtctgcttaatccaggacagctggaagtagagccccagctgtacatcctgcctccaccagcacagaacaagagtgaggagggcggtgaaggaggctatggtaggccaaacaatgcctgccacccagaagaaatctacacccttatccccggcacctgtgaatccattaccctatgaggcaaaaggactttgctgttgcaattaagtcaaggaccttgagctggggagattctcccccatcatccagaaggtcaaaagtagaagaaggagatgggacaatggaagcagaggtggagtgatgagctttgaagatggaagtaggggccacaagccaaggaatgcaggcggcctctagaatctggaaaaggcaaggaaac

SEQ ID NO: 471229 - DNA, 1655 bp, Homo sapiens
ggagtttagtgcctgcccccctcctttgttgtcaatcagacacttggggcccacctgtgctgtcctcgcactgcccacccacccccactgtttttgggaaagactttgcggggccacctttttgcttggtcactttccagaaccccacactctgggctgtgcactcactgggctctcctctcagtcccctttgctgggtctttccctcctggcagtcttcgtcacgctggtgttcctcgggccttggtcccttttcttctctgcccgggaccatgaatgacaccctgcaccgttaccactgctgccccgggaactccactgaacttcaacgttgcagctaccacagggaattctctgtagcccttggttctttggcctatgatactgcgctgcccacaccacaccccccagtgctgctggcccctggtcttcccaccccaccctccaagaccatggacaaattcttctgttttaatgccagcctgaagccatggcctgagattggaacaccccccatgtccagcctggcagaggggcggggaggcaacgtggctaagccctcagggagccacagctgtattgccagggcctggatcttggcgttgctacttactggctggggcaccttgggcaaaatgcttaaattctccacacgcccccctccgcccccgtttccctggctgcaaaatggggattctacagtgctcactatgcagaatcactgtaaggatgctaggagtgagtgcatgaagccgcattgagtcgggtatggaaggacagcaagcacagggtgccgtctctctgggttgcagcctgaccacctctgaaggctgggccagcgcctctgagccatctttgaccttgacgcccctcctgctcctgcaaggcccctctacctctgcctcgtcctccatgggaaagctgcagctgctgctggggtcctcctgcctgccagcctcctgacctgccaaactgacaaagcgcttgtgcagtcctgtcctcatggagcaggactcctctctgcggtctgcccagcttcagggcgggctgactggagaagatgaataaatattcatggagctcttcctgggtgcctgattttcttcctcacaagggtgcaagatggtcacaatgaggacacggagccttggagaggtctgcccaggggttgggctgctggacctttcgaggctcagattccaagttggcgttcctcaggggcagaagtttgggagatcagagaaacttgctaagaccccaagtttaggagaaggcaaagcacaattctccggatgacttttggagctgacctgacacctagcggccacaagtgggaattactccacctttggaggctcccagggccgctgaggcagatgggcttggccacccatctcttacttgagtgtcaaggggtggcctggagggttggggtggggtgtgggggagattttaacttccctgtaatctccatcatttcgccaaagccacccaaacaaaaataagatttgataagaacaactgctgccttttccattttatgcaaaagatgagaacaaaattatcttgaaaaaatgtgtttttattgatccataagcattacaaatttataacttgtccatcacacattttgctacttcatagcctctccttct

SEQ ID NO: 471230 - DNA, 1263 bp, Homo sapiens
tgccctgccgtgtacgagagtatatttcagaccacagagatttggaaatttgtttgaaaagagatgagactccaggttctggtgtctccactgtatgggaaagcagctgagacacagtcacatttaaataaactttccagaaactgcaacttagccctccaagtgccaaaatggtttttctgattattgtttttgtgctgccatggattttctggtacatgtctcctgtgaccattgcaagagtttctctctgcacacgtttaggaatgaaactcctggatcaaggactctgcacatgctcagctctccaaggtgctgccaaaccagattctcaagtggttgttcttctaccagtgattggggaactgctcattgctccgcatgttcaccagcactggataatgtccttcccaagcagctatcccttggccactggctgcacaggctaccttgagagggtggaccatggaaacaggcccacccagaacctggaagtgggcttgggccattcgggcagagattctggggtcctgagctggaaggtggtcgcactggctggagctggagcagtcatcttggactgttgtggaatttggaaatatagcccatgcatggtggaccaacagatagaaggaacttgggttaaatattgcacaaagagccatatcatcagcagaagccatcttgaacttgttcaggcaataccaaagaaagcttcctggaagaatcctgggatatccatggaagccagggccagcaggctttctccaggaatagaagcccaagaactggaaaggcactgggaaccaggcagtatctctgcattttgaatctgcagctctgtttttttctcctctctgcaaaccaagctgcttttcttctcagtgtttcatgaattcataatatagttagattcctttgtcacaatctgcatttcatgctgcagatgatgaatgatgatgtctggcctcctacatgatttttttaaagtttgcacacattaatgttcactcttcatgctgtaaagttctatggggtttgacaaatgcataatgtcatgtatccaccaatacagtatcatacagcatgattccaccaccctaaaaaaatcacctgtacttcaccgatccaaccctctcccctctatccaaatccctggcaaccactgatctttttactgtctctatagttttgccttttccagaatgtcatacgattggaataatacattatgtagcctttccacaccagctttttccactt

SEQ ID NO: 471231 - DNA, 606 bp, Homo sapiens
tgagattaactgagtacattagctcaaaatgcagaaatcacctgccttctgcgttggtctcactgggagctgcagacgagagctaatttctgattcggtggatttgggattggggctgaagataagcattcgtaataagcttacaggtgatatgatgctgctggttcacaggaagtattttgagtatccattttttagatttctagtctttcaggtttcatcggagatcaagaatgggaaaactgagacctcaaatgtgataacacaaaacaagcaaaacattcttatagttttaaagacatttaattttttaaaaaaatatccaaccaagacatttgtttggaaatccccttatttggacataaggaagctgccatctttgaggagccagccctcaccagacactgaatctgctgtagccttgatgttggatttccagtttccagaactacacagacgctgataatcaatataggaagttcacattttttgctcctaccacaagcacttttcctagtttaaacgtaacatcctcagaggctctactttaagcccaagtctaaattacctcttgttatgaatcagaacactctgctatttatcttt

SEQ ID NO: 471232 - DNA, 511 bp, Homo sapiens
gagggtccgagtcttcattcttgaagtcaaagccacaggaaagacagcatgaaaaagattctccttccgaacccccagaaggggacaaattctgccagcactttgattttggacttctggcctcctgaatttgagaaagatccacctatgacctcaggtcctcagaccaaccagcccaaggaacatagcagcaattttaaattggacaaatcccagccacatctccagcatacaagaacttccaaacgcctgaactgcagcggccaggcattcctcctgaacctcctcccccaggagcttgctacaagtgccagaaatctgaccaccaggccaaggaatgcctgcagcccaggattcctcctaagccgcgtcccatctgtgcgggaacccactggaaatcggactgttcaactcacctggcagccactcccagagcccctggaactctggcccaaggctctctgactgagtccttctcggcttagcggctgaagactgacgctgcctgatc

SEQ ID NO: 471233 - DNA, 850 bp, Homo sapiens
ccacgagagtgacctctggtggttctcaatgctacactcccaccagtgccatgacagtttacaaatgccatggcaacattacgaaaaatgttgttagactagaagagtctggctgttcaggggattctaggcaggtgatgctccagcccctccacttggtcaaggatgggagtaaaaatgacctgcaaggtgctgcagacacagtgtggataaaaaaagggaaagaagtgtataaactgctggatgataagcacattgagggtaatcagataatggatatgttccctactggggtaggccgaaaactaaatcataataggaattccatagcttgcaatttatttcgtgaatatcaagtgactggagttccatttttgaaaatgaataaacagaatacatatagttttctactcaaagagagtgagctgattaaaagtaaaatggatgtgaaggtggcactttacctccggtaaaggaatgacaaatgaactcagattgaatgtgactgtaaccacatggtaaaagatcacagttcaccctgtttatatattgaaatggaggacactttaccacagcagagttgaaatgagaacattgaggatctgaaaactataagtaacttgttttgtggagtcaggaaactaatcacaatgactatattcgtttccacgtaaaggctgcgttctctagtttatctttattaaaattccctagggggtatatatttgaataaaacagtgtaaccaaaacttttcatttatttgaatatattttgtgggccttcactgagacccttatgctagaaatgatttgaaataactaaagtgaactagagctgtataaagagctt

SEQ ID NO: 471234 - DNA, 665 bp, Homo sapiens
ctggaaaaacccagtagatcaaaaatagtttcatcacctaagaacggcaactataccaatatttgatggcaaacttaataaatgtatgtgttctaacttctccaccaaccagcatttcctctatctctcttccagttcttgggcctctctatattctaagacataacaatattcaaattaggcaatttaataatgtgacaatgtctgataagtgttcaagtgaaaaagacagtcgcatatctttcactttaaatcacaagctagaaaagattaagcttactgaggaaggcatgtcaaaagctaagacaggccaaaaactaggcttcttgtaccaaacagtttgccaagttataagtacaaagaaaatgttcttgaataaagttagaagtggcacatcggtaaatacacaaatgataaaaaagcgaaacacaaatgataagaaagtttgttgtggctggtctgcatagaagatcaaaccagccacaacattcattaagccaaacttaatctagggcaaggttctaactctcttcaattctttgaagcccgagggagagaattgtaactcaccattggacggagaatatgcatcctagtgacaattttcctcatgaggacagagtctgataaaaggtatgtaaatatcatttgtacaaaattttctg

SEQ ID NO: 471235 - DNA, 2608 bp, Homo sapiens
ctcctgtcgcatgtcttccacagctggagctgaagcagctggaatacacggcaccatgtcttgaggctgcatggaccggggggccctgggcctggcccagaaaaccatttttccctcctatgcctcggggcctgtgccaaagtccgggctacagcgcctgggcttggcttcaactttgttccgaaatcagagagggttccaggagctgcgagaagccagggagcgggagcaggcacttctgagcctgtgggggaagtgggacttcctggaccctgagaacgcaaggatgcctggtccagagccccgactggcgacagtagctgcgctgaggagcactggactcccgctcccgccaacttgggaaaccaagtatctttatcaccatttggtatttagcagggtaaacaatatctttgatgaagtcttgcaacaaagagcctcagcagatagaggaatagataacacacaaggaaaataaaactaagtatgggtgaaatagcaatataagaaattttaaggttacattagatatgataatattacttttgatcttatgtaaatgcttggtcctagggaagagggtttcattcgatcagtaaatctttgttaatttcagatttaattgaagacttcatgtatttattcacccttctcgtaagcaaaatgacttttaaatggtttttaattaatctgtgtaatttaggtatacaatgaactgatctgaacaaactcacatttaaccattattttttgtgttaatctccatgaatataattaactttctttgctatcaccagctaccctttgaaaaaaaagtgagaagaaaaatggtgcattgttgaaaactaggtgctatgaatattttatcccaaagcatacctgcaataattctctgaattaggtttcattgtaatctgccagacaatttgtgtatcacctaaacttctctgctcatacactatctcctctacaaagtcttccttgaatgacttgaaccaattcatgggtcatctctgaattgtacagcctatacaattttcaccttaacatatcatttcatactatctattcactataaatatatgaatattatctccttatatgactgtaatttccctgaggacagagataatgtaccaatacatcgccaatacttcttgtcattacaaattggtatgcatgtgctaatttcagtgctttctaaagctttattgaaagaacaacagtctttgcttcacacctattctttgctaagatatctgttcggtataaaaacaaacatgtaatcaagctttaaaatgtattaagtgatagatgcaggttatcttaatagatgaatattattcaaaacatgaaatctttcttcacagcattttagagtcattgtcctacccacacacaagcacacactcattttgattatccgtcattcctagaatagtcttgaacaaataaactcgttacatggtttaacaatccatattagtttgcaaatgatctccacagtcattttaagtcacgctttgttaatggactaaaatgttgaattcgattagaaaaggggaccaataatgattcttagttaataatcaaatcctgatcctttgaccttttattcgtatttctgaattttttccttagacacattgacagcttcgaatgtgtctcagcactctaccgtgaatgattgtgcatgtcaccaatctcaggcattcctagtttttctgttaaactatatagactcattaagctctagacctcacatttttctaccaatatcagctatttggatgtcaattgtgcctggcctttcactggttgtggaaaaggtaaggttcaggtagtttataaatctcctcttaaaatttgtttttgagctctttgaatcctgatgcaggcttgtcgcctatgttaatgaccattaatttttcatcaacctgtccaattttaccttaatgtttcttcaagaaataagatacttcagacttacatattattttatattattttctaatatttcttaaaaaataaaagtcacattttgatattgaggaattcaacattatatagattagtaatttacttatttttgataattatgtcactttgttttatcttagaggctagtacaaatgagaacattgaatctaataaatgtaaccatgtacatttgctatatgaatatagatttgagatgtatggttatgaaaatttctcataaagcattttgcaaatataaggacaaatactaactagtaattatgcatggactcacaattagtaatattttgcaaagagaaaacaagtgtacaatatctaaaactcaaattttacctatgtttactggaaagaattatatctgattaatatttatgtatctctgaaatataaaagaggatctagattgtgataccttacgaaacaactaaatatatattctgcagcgttctgatatttgatgtgttaaatttcgaattacatgtatagaatgtatatttaatttattactacatatacatgatattttaggaaatgacatatatgaataaaatgaataaatttcagatgcattagatctaaaggctagactttgaaccatttaaagtac

SEQ ID NO: 471236 - DNA, 723 bp, Homo sapiens
aacattcagctagttgttacttatgcaaatttctgcagcagccgccctggttcagcggacagtttggggtggagcaaaacctccttctgtcagctctgaaaattcagatgtgtcagttctttctccctctagctcaactgaaagttctattgagaacccttcataccctcccccatacatttctagtcccactgtatacccatcgctccctgaggaacttagcccaatgaatactactcgtagtggagcctcctatccacctccaaaggaaaatctttgtccccttagaaaggtggcaaacagagaagaaggcactggagccatcggcagccgaaccaatgatggcagaaatagccaggcaatcccaaaagtgatggagcctgagagcttccgccacagctctcagacaactagccatatctctagagaagacttgggtaatcacgacgtgccagatgctgttttgctgcccatggaagtagttgtaatccattgcagaggacatcaaaaaggagactctagtgtggctaaggaaaacttttttgcagatgcagttgctaaggaagtaggttaaaggaaccagttggacttatctcgtaatagacatagatactttcaagctacagaattatgtgatcaacttaggacaaaagcaaaatgtattccttcaatatggaaatcaaagactcccttcccccactaagaaagacaatcttgttataa

SEQ ID NO: 471237 - DNA, 1492 bp, Homo sapiens
acttctctcgtatgttcttgtttgtttgtttgtttgtttgagacaggtgacagtggctctttacccttctaagtgcagaggaggaagcccagcgcattctgggtgcacttccagctgaggaaataaggaggaggaattcctgaagccctgaacaagtgcctgggatggatccaaactccatcttgctttctcctcagccccagatctgctcccacctagcagaagcttgtacggaaggcgagagaagctcatcccctccagagctggatagagactccccgtttccctggagtcaggtccccagctccagccctacagaccccgaatggtttggtgatgagcacatccaggcaaagagggccagagtggagaccattgtccgaggcatgtgtctctccccgaatcctctggtgccaggcaatgcgcaagctggggtcagcccacgctgcccaaagaaggcccgagagaggaagaggaagcagaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaaggtactattggatccaccaggccacctgactcagctgggcagaagcttccaggggcaggtggcagagggtagaagcgagccctcacctcctgtgggaggggcctgtaaagatccacttgctttggctgccttgcccaggagggtccagctacaagctggggtcccagtaggaaatttatcactggccaagcgtctagattctcctaggtaccctatccctccaagaatgacccccaaaccctgtcaggatcccccagcaaactttcccttgactgcaccttcccacatccaggaaaatcagattcttagccagctactgggtcatagatacaacaatggccattggagtagcagtcctccccaggactcatcttcccagaggcacccctcctcagagcctgccctacgaccttggagaactactaagccgcaaccattggtcctgagccagcagcagtgtcccttgcctttcacctctgcccatctggaaagtctaccccttcttccctcggtgaagatggaacagagaggcctgcatgctgtcatggaggcactgcctttctctttggtccacatatcctttaatagcaattgaag

SEQ ID NO: 471238 - DNA, 893 bp, Homo sapiens
gatctgaaagacaggggtaaacagcatgctaatgaaacctgcagatgattggtgttacaaaccccagagaggacagagaaatagcacaacgagacccagagagcttagaaatatgggcaggagactgtcaaatgagactcgtcctaggaaaatgaaagtcgacacgtcagggaggaatgatgaaggtgcctctgggtgggggcctgcaaacctgaaaagcagagatgggtggcagggtcaggaggttgagggatatgataaggtttggggtgtgttggagggagacagaggagctgaccttgaggacccaggggacaaatacccttgtgcatttctggtcaggactgaccatggggccaacagttcatgcagctggggaaccaagcaggttgtactggcccattggcctgtgtcagctccaggacccctctgcaacccaggacctctgatttcacagtcacaagctatgcctatttgcacccaagccattaaggctaaaagcgccattttgacccgacctgctattttcctaaaatgaaacaagccaaaatacatctttaacattttgcactaaattattggggaataggaaattcaagagcagagaaagcaaaaaatgtccgtattttcaagggtttcccattcaataaagatttatcagagcgtaactcatttatattaaatctacaaatcttaagtgaacagctcaatgatttttttccttgaccaaatcacttcacttcaccaagtcttggtttcctcgtctgaaatgagcataacagcagaacatatctcacagctgtgttgtaaagattaaattagactcggtaaagccccttgggcacatttccttttccgttaaagggggaaaataactacttcaccaggttgtc

SEQ ID NO: 471239 - DNA, 586 bp, Homo sapiens
tgcagtgtgtaggcgtttttaattgagcggatggaaatggttgacagagtaatggttgcaattgttcaccattcacatggaaaagaatttgctcacagagcacgcagaaggtcatgtcttcaattttatggtcagttagcagtacttagatctaccactgtggcagatgggactgacacaagaggtggagtgaatgagttcagtccagcgccagacttttatgacccctgggctcctgggcatgttcctgggaatgtcgaactcatgcacatttacacagaccacacaagccacggcttgaacagccacttatctgagtcttggaggaactctgtgataattccagaacttgaaaggagaagaggcctgaagttttgttataaagctgcaagagatccacactcatgccccatactacttgtgtttgaaggcagagagtctaaataagagaaccaatcaaagcaaagcaaagaaataggcaagctcactgtcaaacaacttaacaaagtagcaaattgaatccacaaaacagccttaattcacatccagtttccttttcagtttaacatcaagacaactgcattta

SEQ ID NO: 471240 - DNA, 565 bp, Homo sapiens
ccaacagacttagcatctcctcatggtagttctgaggaatccaggcagcccaaatgacaattgtgcggtactgcggcggctgactcaaagtatgacattaccaaatctgaaaggggttaatcgtgaaattaaacggcttagttatttgtgtctgtgtgcatttttggagagaaaaaataaacaggttggaatattcaatataagctcagcttctacaacggatttggtaggaatcaaatccgagtacggctacagcagattcagaggggaccaggccttccgtgatgacaagtctgatgacgagacagttggagcagatgctgtccgtgtcagcaagtcccacatttctgagaccttcctcaataaactcattcctctcaaattcttgtctcatgatctgcttttgaaagaactcaaacaccacaatgttttagagagaaatgcaaatgcaaatgcacattgagaggttaatgtttttatattttcatatgaataatgctgtattttattccattgtattccattaggtatatttgaaagcattatgtaacacttctatttgtat

SEQ ID NO: 471241 - DNA, 2234 bp, Homo sapiens
acagtcactcctacgccacatcaaacttaattatgccaacaacctcaatgaggtttaaagtggattcttccccaaagcctccaggtctttatgtcactgtgacctcatcaaatagtgtgtccctgaccattgtactaaaactagtcaccattgccactgtcgccaaccacttcattattgtgttttcatttttatacaaaaagtcggtatctgcggaatctgaagaagttcctggatgtttcactgatgaatcaggccatacgcacaactctgagctaaagactatcagagacaaggtagaaaatatgagagtgaagagtgacctctatatggaccacaagatattgaaggctttccacttactggaggaggtggagtattcaggaagcaaagatgaaggaaagattgagttacagctgggaaaaatttcacaaagattaaatgtgtttgtataactcatatattatgtccccctccaccactgtcattttgaaaatgatatatttttggaactctcttatgctatacttacatttacactgatttatttctattttataacctgaaacattaatactaagtgccaaactaagctaatttgtaggaaagaatgacagataaatatggaaatattggcttcattctgtattttaaaatacccaatatctaatttattaaagtcttaataaatgcagtccattattattcttaaatttttggttatttcaagcatacttttacaaagtaattgaaatgctgcctttattcttgaatgtgaaaaccacaaaattacacagaaaatatttgtttagaattcaaccaggacttctgtgggttctggaatgagtaattaatgaagcattagtgtttgaaaattttctgaataaaagtcagcaaggtagaacacaggcaaatgaacctaaaggcagacatacacaaaaaatgcagtccataaaatttctggtccaaatatggattttagatttttgtactattttctccaaatttatagttctagtctaaacaatatatgctataatacttttaagaagtgggatatatcaccattaaatagtgggagtgatttttttaaaaaaggttggttggtattaaaaaggaattaggaaagattgaaaatatactgatcaggcatataaaagtgaataacaatgttccattacattataaaacattttaagtaactaaatcatagtcccaatattaacagatttctagtggatatttgagatctattactcttcattttgacaattattgcaagtgtcatatgaagacatagctaaattctccaagtattttgtgagctctccttgttcaggatattttgtacttctcacaacttccaatgtgacaggtaataaatgtaaataaatcaatacagatgaatgaaacatattttcattaagaaggaacaaatcttaatttctaaatgcctggtagttattttccaggtattcaatatcagcatcacatcaattatttcttatgacttaaagtttcatttcagggcataattacaactatagtaaaagtttacatcaatatctcttcaatattacaattacaaggatgcttgtgagaaacagctcctttttagcacgggggttgaagctagaactgtcacaattatcaattttgtgatttgttgattttctttatttctatgacaccaagtaaaatctggttgatcaagatattctattaataactgtgattttcaaatctgaccacgaattaaaatctcctggggatccaaacacaactatttcatttatttttttatgtgtataggaaattaccaacaacctagcatatttctgtattcccatttccaatcaaacattaactaccagcggcatccactattagttttgactgttactgaacttcatataacttgaatttcatcccatgcattgatttagagaataccaggcaaaaacagattttagatcccacttagatttggtcatgtttcaaaatcaggtcaacagctatcatgagagctttttcaatagaagttgcctaacctctaatctagattaattggcatcgattttcctgtatattcaaggattgtattaatatcttttttgagaaattgaccataaacctaaatcctcttcacttaggaacattttgtagaactggaaagaacacttgtgaaaaatatttgctgattcaaaagctctatacaaatatacaggactatt

SEQ ID NO: 471242 - DNA, 3737 bp, Homo sapiens
cggcagcacccgttccctagtcccctgacaattataaaaatgacgcaaaaatcacaaaatgattctattatagctgtgtccaggctcaccaaaatccaacaggaaaatatcttctcttctctaacaggaaattattcacatattggaaaaattatagaaccaccaagaggtcctaggggaagaaaaaaacccacagaatatgtgcagcagtcctggaaccagcctccatgtgcccctcaggagtacttcaccatttgggcactgcccttcttcagagtcctaaccctgcaaggtccttcctctgagctcctggagtaccagcaccagtctgagtcccaaaacctcaaaagtagggaagccaacagtgtagccttcagtctgtgggccaaggcccgagagcccctagcaaaccactggtgtttgctcaggagtccaaaagctgaagaacttggagtccgatgttcaagggcaggaagcatccagcacgggagaaagatggaggacagatttagccaagatccttgtttggatattcctcgttttaaatacatgttaaattccacctgttagtcaaactccagctagaaaatatagatcacactagtttttttaacagaaataaattgatataaagaggtttttttaactagatataaaactgttacctaggcttattttctttcaacattgagtgtattattaccttgaatgtttcagataggattcattaataaatttacttaaaatgtgaggggatataggcaaataaacatcatgtgaaacagaataattaaaattaaaaacacaacagaaacaaccaaaaaagtgctacgaaaaaaaagtgttatcagcatgtgggtcttagtttgctaatacatgtctcctggaaattaaggcagtattgagaaacacagagtaacaaaactagctaaatataataataatcatctgttcatttatatacaaagacaacgttgatcatggcacaagtctttgctgtgcatatatttgttattgttggatgaaatgccagtttcatgcttgagatcccaaacacaaggggtataatgtttttattcagttatcaattgctttcaatcagagattcgctcatgtgtgggttaacagagaggtttacatatagagttaataatttcttataaatacgttagtcttcttaatcacatggacaagccctaaattcctcaatactaaaaattgaaaaaattcttaacttgaaaatgtttatgaaatttataatgaactaaaatcctcgttatctttaggatatcagaataggtcccttccttttaatctaagaaggtcttgatgaacctacagggaattttaattaccataaataatcacctccaaacaatcaaatgccttgacatttgggaaagaggtatttgagaatattgaaatatattttaaataacacttctttaagatagagtcttttgtgggcataatttcaaaaaataatcaatggattcatccaaattttaatattactcctggtcctgggtagtacatctatacatatgtacattaagatggggaacacagaaagacagaaagtttttgtgtgtctacatattttgacaacttgcatggcaaagaatattgggaataaaatatactaaatgctccccaaattttagacgtaatcaccaccagctgaacaagcaaagacaatttagctaatttaagcaatggattgactcagtgtttgaacggagacatcctacatatattcagcactttgctttaaaatgatcatatttaaaacacagtttttaagaaattatgtcacttgtgaaagggagcaaatgcacaggaaagaaaacaactccttatttatgctgacttctctataaaaggattttaaattaatgggaaatttcaacatgaaaataagaaagatgagtaatttagatgagaatagagtttctaaatggttcaaagtgatttcctgatggcattttaatttaaattcccacaaacaagtcatttcaaaattacattcgtagcagttgaatccaatttctagtgaaattctaaactaattgaacctagttactcttaagagaaaattctcaattgcatatgcctgttttgtagaagtgaatgaaaaatgctattctcaaattaatagtatgtctcagaagattttgtttaaagcaaatcttcttactagtattaactcttataaatatatgtatatatatataaaattttaaaatatatatcacaagaaaatcctaggaatttgtccgtttcaaaaaggttatctaatttgttggcatagaattgttatagtactcatttaatttttgtttccttatggaggagaggtgttttcagaggtgattgatatgtgagtcagtggactggtagacctgccctcaatgagaaaaagcaggatccagtggactgccagtgtggctagaacaaagcaagcacaggaggaggattctgcttgctgagttcctcactctcttccttcccatatcagggactaatatgaatagtatgcaaacactttgttcatgtatagctctgttctactccttcctttatgctagtattttattataatatctctattcagtgtgtgcaaacttacatagatttgtaattgttgctttatgtagctgccctttgtatcagaaaaaataaagaggagtcataaacctaaagtatatttatgctattatttctacttatgtagttacctttactggtactcattaatttttatctggatttatgttattttctaatgtttttttcacttcagactataggacacactttagcatttgttttacattgatcttctagaaacagcactctcagaatttggtttatccttaaatatcataatttctgttgcattttttgaatgaaaattttgatacatatagaattattagtttacagttattttacttgcacattttaaatgagtcatctcactgctttttgggttacatagtttttgattaaaaaatgatgattaaccttattgaggattcttgtatgtgttgagttgattcattctggctattttcaaatatgtctcttttttgtttgtttttggccatttgattatgacatgtgtctacatgtacatacatatctttgaatttatctttattgaagcttgtcgagcttcttgaatgtgaagattaataattttcatgagatttacgaggtatttgttttatttctgcaaatagagatgctccttgacttacattagggttatgtctgattaaaccatttataaattctataaaatatgtattccttatttcgtgtggccactgaagtttctgcttggttgccttagtggtcagctgatgattggaaggaaaggtgtccttaaatgccccaactcaataaattctctatatttaaaaaaaatgtggtgtgcatgtcacggcatacccttaacactcagccttgccatttaccagtttgccttagccatcaatttcctgcttgtgcagagtttcaatgtcagctagaggtgagagctttgggccttttcaggtctttcctgagcatgcacatggccgcacaagtaatcatggaattctagattcccagaaatacgtcaatagttttcaaaagcactatagcatctgctataaactctattgtgtcatcctatccgcaaattcatatttaagccctgactcccagtatgaccgtattcagagagaggg

SEQ ID NO: 471243 - DNA, 1283 bp, Homo sapiens
tctcgcttgtcgcccaggctggaatgcagtggcccatcttggctcactgcaacctccgcctcgcaatttacaatgattccattaaaatggaagttaagattgcctcctggacactttggggtcctcctactaagaaaggagttatagtattggctggggtgattgacccaaactatcacgatgaaatctgtcaactactccataatggcggtaaggaaagagtatgcatggaatacaggagatccattaagacgtctcagtattaccatgaccttgacttagttcatttgtactattataacaaaatacctcagagcagaagatttataaaggacaaaaatttaattctcacagttctggagggtgggaagttcaagttcaaggcaccagcagttgagctacatcttttgacagagaaaattcactttgaaagtaggtcaaaaatgctggtaaacctcactggatttccctgtgaggaattaatgccattatgatttaaagctgtatttaaatttgccttatcatgagagaggaaatccactggaaataaatattaatcagtcttttcaaaaccaaatttaccaaaacttgaaaatacaagaaaataataatgaagatacattttctggaaatacgttgactagatactatttcacaggaaaatgaggaccttaatttttaaaacagagagccctggggggataaaacaagaaatgtctcgatcataccaacacttgtaatcttttgtctttgtgataatgtaacgcctaaggttcttgcctaaccacgccaaagaattggtgtggcggctgaccgtgttgagtgatagagacacgaccgagagagagagagagagagagagagagagagagagagagagagagagcagtaggttttactgagcagagcaagagtacaaagcttccaaggcgtggaaggggtcccgaacgggtagccagagttagcttatacgattgccttttaaactctttaaggcgggaaatacgtgcagcgggaagatgttaccagagcgagaaacaaaggcagtaaactattttgtgacatgtcctagattttgaggaagaccggaattgcagcttaggttttatctactttatgaccttgcagcggcatggcaaaggagacaggatcttacaggactttacaagttgtctggatgcgctagaaatttaggatcattttaaattaaattactggttaagattttttaaatgacacagtgtcttggttcattgtggcctgctattacaagttaccatata

SEQ ID NO: 471244 - DNA, 882 bp, Homo sapiens
taatcagcagctgaaattaatgaactagagctgcatgaatcaaatgtttaaaattatggaacgatgtgcagtggaaaataagcaagttgtagcagcaggaaatggacctgaatatcctcttagcagccatgactggatgccaaatgggacaaagaagaactttgaatatgacatcacactacctcctgcactgtggttcctgataagaaatcagccattcatcttactgagactccttttgctgggttccacggctctcttccatgacccgcggcttcaaatagagctagaacactcaccgcatggccgacggttccattccttggaatccatgaggccaagaaccccaggtcagagaccaaaggcttgccgccatcttgggagcagcctgccaccatcctgggagctccaagaacaaagatccacctgtaacaataagatttattgtccagaagaagaatgtcacaaggtcgattgatcagaaacttcaatagttaaaactattaaaaatattcatgaaaaatatcaagatgacatggaactctgaaaaatgcaaatgaataagttacgttcttacatgccatttccgtggagttgtgtttctctggactgaatacctatctgccagtgcaaatcaaagactagtgttattttaaatatttaaatggtgtctgttttccaaggatattcatgttttgttgaaatgaaaactctctgatcattgaacactataatgccaataccacttgcaaacctcttgaagagaaggaacatggcaacatgctttctttgtggtgctcaacaaaagacaactattggaggaaaacatgcattcggatgactttactatgatttttaactgtcaaactattttcaaactta

SEQ ID NO: 471245 - DNA, 622 bp, Homo sapiens
gcaagggtccgcggcttcattcttgaagtcacagcagtagtaaacccgggaagctgactcaaatgagcgaatgccaataatgctggtaaacaagtattcacacctgttaacagctgtgtggatttgctgcaccaggtgtaaatgtgtgagtgccaagaatatcacttgggatcctgctttgcatgaggattctagagccaattttcatgcagagatggatgggaaaggtttcaggaaagctattgaattttcatacgggagctcaaatgaaaccttgaagccattgctgcagttgagtgaagcacagaatgttgagactatgaagaaggagtctattagagttacagaactcagtcgctatcatgagaacaatgagaactcactcactatcctgagaacagcatggagcccattgactcttacagattcatctgtttatagaagcagtaatgtctgtggcccacacaccaaagatttacagtacctaacctggtttccaactccccacaaatctgattcatttaaattgtgattttaacagcttacctgataaatctgatgttatcaggaagtttagaattttatactcattttttttaaatctgcaaggaatgagatatga

SEQ ID NO: 471246 - DNA, 932 bp, Homo sapiens
ctgaagggtccctcaagtgccgccaaagtgggagcccaggcagaggaggcgccgagagggagcgaggtctaggactcaaggttcataaaatgagcagaaattcagcaggtagacatggccttcttgatagcccctgtcttttcatcattcatgatcagcagcacctcatatctgccgctgaagactctgcctaaatcaaggattcttctttgcaagacgttgatgactgtctggatcagggaagtggtcacaaccgggaagttgtttaaggcagatatctggattgattacaccggggaactgagagttggtgtaggactagaaactgtttcaagagtgactaagctttacttctggtataaaaaatcaatttctccaaacagagcaagtgaccagtcaccacagcagcctcaagccccaaatttcaaaattttctgtggaaaattaaggttgctatttgaaacaaagagattgaagccaagcaaagtaaataacaaaaaaatcacaggagaaaccaaagatgttttggcatcaactaaacttggattgtaacattgactctgccactttctagttgtaatgagcttcaatttttgtcttcttataaaatgaggataatattccacacttcacagagttattgtaagaatccatttaagtaaatgaagtaactgacatgaaaactgattatgtaacttgcctaagtcttccaactaggaatgatgctgcatatatttaaatctctgtctgtgacactaaggttaagaaatgattttctcttttaaatctacgttcccactagcctgttcaatgcttttctaacactgatattaatggaataatataactaccataatttcacattttcatttctttaagagaaaaaactctcagaatatctcttatggttcatgctttaataatgatgtcag

SEQ ID NO: 471247 - DNA, 1482 bp, Homo sapiens
ttgtcacggtgaccacagtctcagcaaccactaccctgatcagtcagcagccagtctgtcactggccttcttgatggctgacgcgctgacgttcactctggtgacatgcaacccatgatcttcatggggagagaacgacccagtgcaggtcccacctccccttgctgactgatttcatctcagctctcgctggcactgtatcacttcaagctactttacacttcccccacggggaatgtggatattgtggtttccttccacgcacataggaaccatcgtcctccttttgtgcctgcaggtactcagaaggaacaggttgaatcctggagaggggtatccagctagtaatttcctggagtttaacagcagtgggggtgctcaacaacattcaataagggcccttccattttggttgccaaaaaaggtgacaccaagattccccaaagggaatggggaaattcccctcaattctagagggaatgtcagtgctgaaaatcctggagcatccagcagggtggacaacagtaccactgtcaaaaaacccagagcaaccaaaacagtgagtcctccacaaggcagcagtagtgtggccacttgccctttagcttggctccaccacctgccaggaaagatgacagccctgaaaagagcctttgaaagcccactagacaaattataaaagagctataacactcaaaatttctttcaaattttcattgacctgtaaaagcaaatgaatgtatgctttttttctactatcacatgcatctttgttttaatagaacaattttcaaatacttttcaataattttttcacaatgaaatcctggaatgaaattctaatatgtataagtaatgaaagcaattcagaaactcaacagagaatttgatttactgagggaaaatacttctttatttgcagaaggcttggagtaaatatttaaaagtacaaaagttttaatagtaaaatcttttgctcctttggttcccctctcagatatcctctttattccctctcttaatattactatatttatacatctttttaagctttcactatatgtgaatctattttgtgtatttttaaaacttcgtgtaaaaataaaactctgcatcttgccttttatagtgattagcatgttttaagatgtatttttcttaatatatgtatactaaaatttcttcaattaatttgtttgttttgtggggtttttttttaaataatcaaaaaaggagcagttggaaaaacactggacaagctggctgaatgaagaatgaatgtgtgtgctgtatttaggagggttagagagtgtggagaacaaaagggagtgcagaaaaggatacatatatttcagcattattgactgtactctgaggagtttggaggtgaggaagtttgagcaatagggagatattagcaattgctgtcccatggaattaatatttgagaggctaagagccagcagttgccctgagaaagcc

SEQ ID NO: 471248 - DNA, 479 bp, Homo sapiens
aaggacacagtgagaagaaacatgattaacaactcgtgtattttaaatctgattgtaaaagttgagtcattcttttggagaacactgaagatagtcttcatcttttgctactcaacgtgtggttcatgcaccagttacattggcatcagctggcagcttgttggaaatgctgaatctcagatcccattctacatccaaagtttcaatgatataaagatagttatgtatcagttattggaaaatgagaaaattttaaatgggggaaaatatttcataaacaattcattcaatagacggttttggaatgaattaacacacctgacagtaattaaatgtgaggaagctgagaaaaaggcaacttcaggagaagtcaaaaggaccacaattatctggataatttggttgactattcacgtgagaaatcagcaaagttttataaaaaaaaaaaattgaccagttatttcctcacacttttattt

SEQ ID NO: 471249 - DNA, 869 bp, Homo sapiens
catgtaccctgggtatctgctgggaagagaaaggagccagcgattcctgcttccctttttctagatgggtagccattcatctttagtttgcacccctttcaaatgcattctgaaccctcaggactactttaaaaaatgtcttcgtatttttcctttcttttccttggttctctcttcactaagagtgggggtccctggaaaaactccaaccggcctgcacactggggtggaaccttgggaagttcacgtgccatttgcagcagaaaggagcctggctcctcctcttcttgtgtgggaccagggattcaaactgctgggtgggatgcaatctagcggagggactctggccttgcgagagtccctgtgtcacctttgcttccttttcatcgaaagaaatcctgtcttactcactattcaaattgtctgtgagcctgaattttcgcggtcatgggacaaagaaccccttagctgaactaaggaaaagtcctgcaacattaactttgttgaaataaataattttcacagataaattttaaataaaattctcataaattgtatggataagagaatatagagctatgtggtgattcaaatgataaagaaggaattgaacagttttctgtacctgccagtctttccatataatagctgtttgtaattttatcaataacggtatattctaaataaatatcaatgaaatgacctgcacaattgtcactgtctcttccctgaaatctaagattggctacaagccccaatataaaactcagctctcctctatgaagtttttcttaatgatctctcctttgaatttttatgtttgtttttgtaaagactttttggaacacagtcatacttgtttatgtatt

SEQ ID NO: 471250 - DNA, 2050 bp, Homo sapiens
aaaggcacatgcatgctgataggagccgaagcagcagcgcaggttgtccccgtttcctctcccccttcccttctccggttgccttcccgggccccttacactccacagtcccggtcccgccatgtcccagaagcaagaagaagagaaccctgcagaggaggccggcgaggagaagcaggacacgcaggagaaagaaggtattctccctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatcccaccccacaggatctgccccagagaaagtcctcgctcgtcaccagcaagcttgcggggtaacctgagaccccctctcctccccttcctcaaccattggacttttatatattataggcagggatgaaatgggcacctagtcagatcttctcagcttgctagccaaaaatgactgtgattctgctgggggctgctgagaagtattaattcattttcatcgtcttccttttctgcaaagtttattttttattagattcttcataagcttgatttttagccaggaagaaaacatgttcattggcatatttcatcattctccaacaccttgagttagtattaatgaaaatgtctgttttttaaaaaatatttagtttggtaagcaattcattttggttccatagcatccatatttggaatgtgtacctcacactaatcagaaagaatgatgccattatctgttatagtggcaacaagataattaatatctagtgatagacacactcaaaatttcattaattatattatttaagcttttaattacactccaatatacttccccatttacaaaacaaactgaaaggattccccagctcactgtctcttgctgctatttatttcccaggaagatttatcaaacgctatgaaagctatgaattgaaattaccttgagctttgttttcttaactgcttttcctttctctgttccaccaataaaatctaaataacaaaataattggatgcattatttccagctaccttttttcattttctggtcttgtattgagaccaggatgcaacccaaggaattaaaagcacacagctagctatcaccttcttcctgatctcttaaaaaaataaaggcaacctcattcacaagagttttcatttgatattataataatgaggatcaaattattgaggcactccttctgtcacttgggaaagaaaacagaaacactctttgctagttagatttacgtgacttcctttggaagcaagataataatttatatttaaatgaaatgatgattagcataagggtttatcatggcagccagcccacagcaagctttatttgtacttacctgatgcaacagagataagaaatgtaagtgcagtcctagctccttccccacaattaaagcattttgaggctttactccccaaatgacaggttaaccaaaatgattttaaaagaaatgttaatctacaatttttgtaatgttcttatagaaaataatgatgtcattaaaaacaacactagctcagagacttatggcagctgttaacccaagtttgtatcaattctggaaagacaatgtatgtttccggcttccaagtcctctttttataaaatggaaatttcagaatgttttcctaggtttcttccagatctaaaattctggatttctgtaaccacaaagaggtgagtttttatcatacctatttaactcactgtgaagaatttgtattctttcaagagatggtacaatttcattttacagaaaagtctcactttttattatctttctcagcttttcctattgacttgtaataggacaagttgtgtaagataggtgataggctggggtgattaaaaagccagattctatggccatatagcctgattttaaatctc

SEQ ID NO: 471251 - DNA, 2139 bp, Homo sapiens
gaggggcgcagacagcagtcagaatgccaaagccaatggcatataagatgctgaccagctgtttcctttctccgaacattgcctccttgatcaaagcagtgcttgacaacccaactatgctgactttctccagccagggccttcgtacctccctccctgtggccagacaaaagggagtatctcatcacccaaagaacactggcagtttagactctgagcctctgaagtacccatcctctctgctgcactttattgcctgtactggatcagagaaacagatttctttatttataagctatcagagatattttggggtgatactctgtcagcttgcaggggagtgtttcctcctacactcggggctaatttatgcgctggcatttgtgaccatattgttcttgagtaggaatggaaattggctcaatccatcagccagaagcaggtctccctttaacagctgattccatgacttgtcacattttcaaattcctctgggtgtcatgaagggggtggatgagcattttatttaaaaatatgaagaagagggctgttattcctgcagccttacaagattatagtttactggagggtaatatttacttctcctaattttgtgccaaacagaattgactaaatttatacatttagaggaatgaaatatctaagactgacacttaaaaggaataatttggcatgtgagtaggaatggcagtgaatcattttggacacacattgcagctattagcctcatgagaaatgactgtcaccacaatcacaaacacatttacgccattagtatgaggggggaaatgggacatttttcttcactaatgcttttaactctgattcataatgcccatcctttttcttcttccagatcactctccaaagaatgactgactacactgaatttccacttctagcaagtaacttcgttgttgaaatttatttttttagggtttgatttatctaagaaagtaaaataaatggcactgaattgtgttaatatttatcagtgaaaaataatattgaacttctccaaagacaaaataaaattaaataataaaacacaacttagtttcaggtattgagtgggaagataaaaatgggaaccatgaaataaactctttgttctctcaaatatcatgtaccttaaaatataaaagttacacaatagtttaggattagtaatacatccagaagtgaagattctgtttcttcttgaagccagaagacaatcttaaataactttaagttctaagaccaactaataattcagaagacacagctcatttgttccactataagaatttatagaaatgatgtgggaatttcgtgttatttcttatttttaaaagagcagactttctacctcagtggtttcaaggtgacatgaattagcacactgaacacttgaattcaaatcttacttcaatctctaaaacttatgactttggacaaatcatgtaatgtcttgaagaagcaaaatgatcaaagtccccttctatccatcaaatggtaaattattttaaagtcattaatataaatttactttgtagtcattgaagagatggagaattcattttaacaaatacattgaatactttgccaaggtgtttaatgtgcctatcttttgggaaaagtgcagagatacaacaagaaatatttttatatcattagcaatttcccatcctggttcccaagctaagacctttcattgtggtatcttaaacccaagatgtgggaatatataggaaaagtttctttcatcataatattaatattagctattaaagctaccatgaaacctatagctgaacacattgatactttattttttactctaaattttactatatgttcagttttactcattttatgttatgaatttattgacggtgggaagggttttatataaatacactcaggttttagaagacttctataaatgagagaaaagactatttcctgggattcaggataacaagcaagttgcaatgatactgttcctacaaaaggaattgggtatctgtcattattcacctaaactgaatttccttgaaaaattcaaatacttttaaaagggagaaaacatactaactgccaatcttctggatttgcattcatcaaatcaaatta

SEQ ID NO: 471252 - DNA, 877 bp, Homo sapiens
tttttctggggtgtataagtcagaatggaattgatgggtcatagatatgcttttatctatgttagtttcaaaatgggtcataaagcaatggagacaactcacaacatcaacagctcatttggccaaggaattgctaatgaatgtactgtgcagtggtgtttcaggaagttttgcaaaggagacaagagccttgaagatgagcgtagtgactggccatcagaagttgacaacgaccatggattttatacagcaactggagatgaccttctcagtggttggacagagaagaagctccgaaggccagacttgcaccaaaaaaaggtagtggtcagtgtttggtggtctgctgctggtctgatccactataactttctaaatcctggtgaaaccattacatctgagaagtatgttcagcaaatcaaggagatgtaccaaaaactgcatcatctgccaccaccattggtcaacagaaagggtccagttcttctccatgacaacaccccactgcacattgcacaaccaacacttaaaagttgaatgaattgggttatgaagttttgtttgatctgccatactcgcctcacctctcaccaactgactaccacttcttcaaatatctcaacaactttttgcagggaaaatgcttccacaaccagcaggatgcagaaaatactttcctagagttcatcaaatcccaaagcattaatttttactttacagagtgatattaaaaaatacttcacagagtgatattaaaaacaactttacagtatattatattctaaacattctgtgggatcactatttaacatgttgccatggaaatacaaaaagttatctacttgaaatatcagcatataaactttataactagggc

SEQ ID NO: 471253 - DNA, 1335 bp, Homo sapiens
taagtgggagctaagcaatgaggatgcaaaggcataagaatgatacaatgaactttgaggactcgggaaagggtccacacgggctggccttgcactgggaagacttggagcctgcttctgtggggatagacctgacactggggcttgcccagagcctggggctgcaggatcttgcttggcattcacatgggcatggaggcttagtccacagttgctggcctggagcctggggcctcaggtgcctggagtcagtatctgaagaggctaggaccacaggtgctggcctgatgactagggttgtgggggtttgcctcgtgctggggcagtatttacgcaaaactgtctcggatttgactgaccagaaagtgtatgagctacaggccagttgtgtctccagtgatgtcattgaccagaaggtgtataggatccaggacatctatgagaacagctggaccaagctgactgaaagattcttcaaaactacaccttggcccgaggctgaagccattgctccacaggatatcattgatgagttcatctaccagtttcagtcattcagtcagtactgctgtaagactgctaagaagtcggaggaggagattgacttcctttgttccaatcccaaaatctggaatgttcacagtgtcctcaatgtccttcattcctgggtagacaaatccaacatcaaccgacagttggaggacgccatccaggtcttcaccaatatcctcttctacatccagaggaccaagagcatgttccagaggaccacatgtaagtatgagatgattaacaagcagaatgatcagatgcatgcgctgctggccattgccctcatgatgtaccccatgcatatcgatgagagcattcacctccagctgcaggagaaatatggggacaagttgctgcgcaagcagaaaggtcacccacaagtctatgaagaacttttcagttactcctgccccaagttcctgtcgcctgtagtgcccagctatgataacgtgtaccccaactaccacagagagcccttcctgcagcagctggaggtgttttccgatgaagcatggcagcaggcccagctttcaagcatctgcagcttcctcaagctctacaccaccatgcctgtggccaagcttgctggctccctggaccttacagaacaggagttccggatccagcttctggtcttcaaacacaagatgaagaacctggtgtggaccagcagcatctcagccctggatgggaaacaaatagaataaaaaacttaaaaattgaattaaaaagaaagccgaatgtattactttcctagggctgtcgtaaaaagtaccacaaact

SEQ ID NO: 471254 - DNA, 1004 bp, Homo sapiens
aaaagtgccagatataagtcacgggtattggatacaccgagtcatagtgcagtcaccttcaaggactctcctggccattgggggctcagaagctgagaaagacctactctccaactcacacagcgtctacggcatctaccatataatagaggaattaagacacagcaaactgtaatccaagacactagtttaatcggaggcccgtcggaatagcgcagtattcgggtgggagtgacccgattttccaggtgccgtccgtcacccctttctttgactaggaaagggaactccctgaccccttgcgcttcccaacggcgctccctcgctctctctggctctctctctttctctctctctctcttcttttcctttccaaacccttgcggggcaggacctaaacatggaagcaactgcacgtttctggccatggccatctttgagcagctgtttcctagtagtcccttggaaattaagggcaattgggtggggtcactccctagtgctgcctgaaggcctaggaatgaatgggaataattgccctggcccgaagggtgaaggatcttttctacgcatggtccctaatccctacggtggcagcagagctcacagctgggagcaaattcgcacaggtttcagggaacttaaaacttaccttatgctaaattcttcctttattgatggccgccttgttcttcctgagtccttaaagattttattattaagagttctgcattccacgactcatcatggaaaagataaaatgatccaagttgaatacattggtgtagtgacttacaaattgtttaaaatggtttataaccaattcttgataccatattcctgggaaaacaattaaagcttcaggtacatttggtcacctgatgggccatttaaacattttataaagagatttcattctattgttattttcaatgcacgttttctggttgtataaaagctatcccatgcaagaggactgatgttataacagtagattaataata

SEQ ID NO: 471255 - DNA, 793 bp, Homo sapiens
ccagcacgttgtcacctttcacgtttacatggggggaatatagttcacaatgtggtaccctcctcaaatctccctccacaggggtaatatacccagtctccagctcctggaaatattggctgttagtggttcacaggttcattcctcactgagcattgccttaagccacagggaagtacctcacccgaggttatgtctcatccctggggtggcttgtggccaaagactgacagatgaaggattacagagaactgactcctgtgtctcattgtgggacaatccccaaagctcatctccattccagggctccccatatgattgcctgaggcctaaaaggcaagtgcatttcaggccggcttttccctctgctaaattctttttctccccaatttctcacaatgtatctctcaggagcaaccaccaatcaaccttttgcatgcaactcccatctcaaagtcaatttaagacaaggggatagcaactgttcagctccaccaactgttgccatgcacaatcatgtagacccattgatgtcagatcttgtttttcaagagaagctagaaatgcaagtataatcttttatatgtctgtaaatatacttcggtctggataaaagatgattttcttataatctttttacatcattaaccaataaaacttattcttctgttttctagtatctaaagttacagatggaaaattagtgttagtttctgtattagttttgtagggctgccatagtaaagtaccacagactgggtggcttatgtaatgaaaatttatcttttcacag

SEQ ID NO: 471256 - DNA, 840 bp, Homo sapiens
cggacacaatggtactagttttgggtagttttgttggcttatcgtttagtgtttttgttcattctcttcccactcaagaatcacatctggaactaataaaatatgatcacaaaatactaatctttgggccaacatcaagattgaatggaactttggagaaatctactttgggaaagggcaagggaatttctatctttctgggcaggcttggtgaccttgccagctccagcaggcttcttgtcccctgctttgatgacatccatagcaactgtctatcttatatcacaaacaacaaaacaacccagaggagtattgtgagagaagctctcaacacacataggcttgccaggaactataccaaaaatagcagcatcaccagacttcaagaatttaggatcatcttccagctccttaccaaaatggtgatccatcttttccttcagttcaacaaagttgcaagcaatgtgagttgtgtgttaatccattacaggggcataaccaacactgatttggcctggatggttcaggacagttacctgggcagtgaagccagcttcttccactggtgggtcatttttgctgttaccagcagtgttgccacaatgaacatctttgacaggcacctttttgacattgaagcttacattgtccctaggaagagcttcactcaaagcttcatggtacatttcaacacatctttagttgcaatgttgactggagcaaaggtgaccaccatgccgggtttgagaaacccaggctttgctcggcccacaaagatagtatcagtaccaccaactctgcccacaaagatagtatcagtaccaccaagtctgtagacat

SEQ ID NO: 471257 - DNA, 1052 bp, Homo sapiens
gactatgttttggtcgtgactcctttattcctctttttttgtcaaagaaagaatgccaacttgggggttgtggtgggtcaggagcccagggctgattaaaagggaggccacagtgtaggggtcatgggggtcagagcagcagcagcagaccctctaagaggctctctggagtggagaaaccagttccccaagtgggtcttctacaaccaccgttaatggccaaaggtctacagtgcaacaccaggctccagcaacagaaggctggaattctagtcttccggcttgaacaggtgccagccccagccatggatgtccctgtggttgggaaaggggagctcagggtaatggagtatcctcaagaacctgcagatattacctccctccagaaccgtggtctcagccctggctgcatattccttcaacgggagggctttagaaatgctgtgccagagctgcaccccagaccaacaaaatcagactctccaggatgcggccaaggcatcagtatgtggaaagctttcaggaaaactgagcaaaatgaaagccaattcaaagaagaaggaattaagtacataattgtgcagatgatacatggaaatggtaagaatggtgacaatgggacgtaagtgactgaaatttgggatacattggattagaagaaaataagcccccaagaaaccggtaagaaggatattgcaacagcacgagagattttaaactccttgatatcagaaagacttatcttctattaattttgttttcctctcaggaataagtctggagggcagcaagagtgactgtccagctaagaacctcatcagcaatacaaaacattgtcacagatgttgaaacagaccctgaggttaatgcattctttccaacattaggtcctaaaacttctcctgaaaagctaccttaaatctaacttttgaaagtgcacaataaaggtgaattaaataaaagcaacttgaaatttttacttatccttcaaattcctcaaatatcacttcctctgagaagccttccctgatttttctgtgtctccttggcag

SEQ ID NO: 471258 - DNA, 554 bp, Homo sapiens
cttctgcctcttttcagcttccaccagctccatagagtgcacaggatgtggccaaaattcacagtcagtccctggatccaagggcggatccacgttttagccaacattgttcctggtaggcggagcccattggatgggcaagcagccacagtactgctgccccatgtgggacctgccactcttactggcagtgcagatcttccaaagaaaggcattctgagtgaacggagaaaggatgcagaccttgggctaaagacggaagaaggtgggaatgatccatggagttgccgagctcaaggactcgatcccggcccccagtggttcctgaggaaggatcaaaccttcaaggacatcaaagaacataaaagcagaaagcccaatccaaggacagcaataagaaagattaaaggaacatccgtccacacgtatgagagagaacaggtgcaagaactctgacaactctaaaaggaactgtgtcttcctatttctaaacaaccacactagctacccagaatggttcagactgaaattgttgagataacagacatagaatt

SEQ ID NO: 471259 - DNA, 706 bp, Homo sapiens
atagtgaactgtcagcgacgactgatttataagaccgatttaccttctggagagtgtcatattctcatctttggcttctcagaaggcagaggagacagtcatcaccactgttcgctttctgtgcagccatagaactggctctctgctctgcatcttgccaagtgccatgcttgaagcccccaggcctcatcccaccacaaatgctataggggtctcaggaatagaggaagaaccagcattttatagaactcactgtgggaaaggcaggactaaaggaacattctccaggttcatgtgtttgtttactttgcttcgatgcatagaatcagacctgctcagagcacaggctgaaggtagctcaaagttcagggtcctgaggggaggagaggagcctggaagttggaatgaattagactactggatattttgtccagattggccagtgaggacaaacagttcagccaagaggaaaggcttaaagctttccattgtttttaaacctgctcctgagaatgacaatggagaacttgccagctatgtgaaagactgggccatttgctatgatgctaaaaatctagaaagaggtgaagtgactgctagaggtcagaatataagacagtttgttccatctttgatcaaatcagcctttgcaattgctaaacctcaaggtcaataagtagtgtgcaaacttagtgactcaattgag

SEQ ID NO: 471260 - DNA, 1792 bp, Homo sapiens
gtgttgagaaacaaggagtgtatgaatttaggaagctttgttcagtatgttagaagctaatgtcttaattaagtgggccttctcgggggtccaggtggtcctgctggtgttaaacaggatctgccaatgctcctggcaattgatggggagtctgctggagtttgctggaggtccactccagaccctgtttgcctgggtatcatcagcagaggctgcagaacagcaaacattgctgcctgttccttcttctgaaggctttgtcccagaggggcacctgccagatgccagctggagttctcctgtaggaggtgtctgtcgacccctgctgggaggtgtttcccagtcaggaggcatggggaaggaagatcttaaatgtgaagcagtaagatcacttgttaagacttcagaaaaatctaaggcagtatcttgtaaagtgactcagatggataaaaagtcctgtcatccttaaagctatgcttcttaaactccctcaactagatagaaaataacttttgagtatcttaagggcatgccttctaggctctcttggctagaaaaaggtcttctaagaattttaacaatgttatcttatagtaccttgacttttggcacaagtttatgtttttttttattattatactttaagttttagggtacatgtgcacattgtgcaggtgggaattgaacaatgagatcacatggacacagaaaggggaatatcacactctggggactgttgtggggtggggggaggagggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaatgcaaagtatgaaatcccataattcagtaaacattttggtgtgttttcttctagttctttgtctatacataggctaaattaaggagttctaactatataagcagctgtactttaccccttttattttacattatattgtcagtatgcttcatgttattaattataaaatttatttagcaataatgtattctttcatattaataatggaatacatttaacaatttttagatcacttattccctcactgggaaaatataaaaaaaatacccatcatagattaatcttaccaacacattaccagacaaactgattttacttggtagcaggcaagctgcctggcaaagaatctacttacagagaggaggcactacccttcccattcccttgcctctgtgctaggaatctttgatttagagcactgcagctgctgcagttcattactgtacattttagagtcaagcacgactgtatcagtgggttaccccctaaagtgctatactcattgtgataatagctaaggatattacagacaggaggagtgaatactgcctttggagcatcactactctctgcctaaagtgtgcttccaaataagagggagagtgctaccttacaagccagctgtcacctctaacagctgccccaccagttcagccttctaaaactccaggatacttgttttcactcatcaattccatatatgtatatggttctaaataagtaaactgatggccacacccctatcagagcagaaaacgcatttggttaaaaaattggtttttacagataaatttatataagttaaaaagatacctctttatatggtagtaaggaagtagtgaagaggatggtgaattggtagaaataaataaaatttagagaatcaaaatatat

SEQ ID NO: 471261 - DNA, 688 bp, Homo sapiens
taaacaacctgaaatgatgccctgcccagagaggaggactctagagaggcagtctggctacagtggcttcgctgagctgtggtggactctgcccagttcgaacttccgggtggctttgttcacactgtgaggggaaaaccacctattcaagcctcagtaatggcggacgcccctccccccaccaagcttgagtgtcccaggtcaacttcagactgctgtgctggcagtggagtgaatggttctgtctcattggcattccaggcgccactgggatatggaaaagaactcctgcagctagctcagtttcttctcaaatggccacccagttttgtgattgaaacccagggccctggtggtgtagccatccgagggaatctcctggtggaaggaaacagatgtatgtccgcggtctgttacgttgagcagcaggtggataaagatgaagacagggtaaaagttggtggcctagaagtaaagctgtgggaagtttcatacactgaattttcctatttatatctctatgaagataggaaaattcatgtcttctctgctccttttttggtgattgttgccccaggcttgctagtttcttcatttgcatttattgtgctgaatattcaaggagaagcctctaaagatctctagatctcttattacatagctctcttctctctagtactgtgccttg

SEQ ID NO: 471262 - DNA, 686 bp, Homo sapiens
atcgggaggctaagtcttagcagctaagaggaatgagttctttgatcctgaatatagaggcgatgcgtctggagttgtttgttccttctagtgagttagtggtcttgctggcctcaggagtgaagctgcaaaccttcccggtgagtgttacagctcataaaggcggcgtggaccgaaagagtgagcatcaagatttattgcgaagagctaaagaagaaagcttccacgatctggaaggggaccccagcggaagcccagctgccttcacctctcagtggcactttctgcgggactttgcggcacctagcccgggcactctggcagcccagagggagcttgacacccgatcaagcccagcaggcgtctgcctgctgcatcgagtgcagggccctcagagcccgcacccaccgggaacctgtgccggccctcctgaagcctaacagctaatgatgctgttgatgcatggcaatgctgcatttaatcaaggatttttttcattattgcacaatatccctcttacctcatcaaagataatttgtctttctattgcatttctttttggtatttaagaagtttggaatcgtagttcataggttcaagcccctaaaatgaccttatgcctaataggtgttttcacttctaattggtataattttatgactgacactactttattgaggaggcat

SEQ ID NO: 471263 - DNA, 691 bp, Homo sapiens
ttcagaggaaacaaggttcctaagaccattgtgctaaggaggagtcaaagtgttagcgatggcaattccgtatttgtacgggtctacagcatcctcaattcttgccccccacactccacagaagaaagaatttgagggacataaggcagaaggagagactgaggcaagttttagagcaggagagaaagttgaaatgttccttttcaaacttgctcttcagggacagggttattttcggaggtctctggcactgttgagagcctgctatggtctgaacgcatcccctgaagttgctgtgagtgacaggattaagcatatacaggaccatgggacatggggagtttttcctcctcagagggggaaacttgaagctgatggctgcctgaacttttcagtgtcactacctaaaagtggctacctaaaagtggctgcccgaacttttcagtgtcactgcaatggctgtttacagcttttaacaattgagtaaagtatattcctataaacaaaatttggagaatatttgtttctgtctacttaatttctccagaatttggaaacttttttatataattaaatttcatgaaataaatatggattcattcctctgaatgttaatatgctgaactctgctattagctctggccatttggggaatgttataaaagtcttttggaattttcccagaactaat

SEQ ID NO: 471264 - DNA, 1554 bp, Homo sapiens
agacccgaatccggaatactcttgagctgattcagctccagccatggctaaaaggggccaaggtacagctcaagctgtggcttcagaggatacaagccccaagccttggcagcttccctgtggtgttgagcctgtgggtgcacagaagtcacgatttgatgtttgggaacctctgcctagatttcagaggatgtatgaaaacacttgcatgtccaggcagaactttgctgcagaggaagagccctcatggagaacctctgctagggcagtgtggaaaggaaatgtggggttggaaccctcacacaaagtccccattgaggcactacctagtggaactgtgaaaagagggccactgtcctccagaccccagaatggtagatccactgacagcttgcaccaagtgcctggaaaagccacaaacactcaatgccagcccatgacaacatccacaatgggggctgtaccctgcaaagccaccaggacagagctacccaaggctgtgggagcccacctcttgcagcattgtgccctgggtgtgagatatggagtcaaaggtgatcattttggaactttaaggtttaatgagtgttttattggattttggacttgcatggggactatagtattaatttcttatcctgatgaggaagtccacagtagctgtaaaggtactattacctagtgattaaaggcatatattctggaagcagactcaggttcttatctgtccctaccaccttgtaggtggactgtgatagagttttcctctttgtaataatttcattggtattccatgaattatgatggattcaaaactctcagttggttaatttatattctatatcacaaaagtcagtggaaaatacaagacacttaccccactcagagattcttaagcatacaacctcagttaacccttgtatgtattccttaaactagttcacataatctcattttttgtcagttgcataattccttcccatattatctccagacttttataaggtagaatatctaaaccatgtatgatgccaactataactattatttatttcatttgcattttccttcacattatgatgtcataatgtgtatgcgactggtataccttgtcgtataccagtaatcaagagtgatgcatttgcactttggactcagctgtatcctttggtcaatctccaactgagttcttgtctgatctcacatttatggtactaagaacataaggactcagtagtctcatccttatttatactgttacctcacaaaatcttatcaacttgttcagtttttcataaattttatgacataactcaagttatttttcttacttatgtatcactgttttctttgatttaatggaattcccttctcaacagtattgtgtgctcaacggctaccatctgcctataataatatccattctattgcatgcttatttataatttttttattcttatgtaactacaaacttagagagaaatttgcaagcaccataaaaaacacttttccgaattatatgaaagtaaaatgctggtacaaacctacagattc

SEQ ID NO: 471265 - DNA, 657 bp, Homo sapiens
ttaatccaagaaagaagccattttatttctaatgtccccaaagggcagatgttcaacattctgtcaccatcttgcaaacctttgctttggaagatcacaattcttcacacacaagctactggagactggttggtatcaatgtgagcttccacctatttgttgtaatttctggctgtctaaaatgaagacaactctacgaacatcccattggacactggttttcaaatgtggaagaaaagtgtttctaatattaactaaggctgggagccacactttagaaagagaagaagatatagagagattcaaagaaggctgtgtggagatggaggcaaagattggagtgatgctgccacaagccaaggagtgccaggagccaccagaagctggaaaaagcatggaagagttcttctccacaagagctttgcggggaggatcttttaggattgaaaaatgggtgtcgggattcagtaagcacagtcgaaaggggtgtattagtccattttcacactgccataaagaactacgtgagactagataatttataaaggaaaaaggtttaattgactgacaattctgcatggctggagaggctttaagaaacttacaatcatgggggaaggtgaagaagaagcaagacacattggggtccaacatggc

SEQ ID NO: 471266 - DNA, 646 bp, Homo sapiens
atcacagatgctttggttcaaagcctccttcgcatcttccccttgtatctccctaccttaatccacaagtatgggatacctctactccctccttggcgatcatgcaccctttatcatcccattaaaacctaatcacccttgccccactcaatgccaatatcccatcccacagcaggctttaaaaaggttaaagcctgttatcacctgcctgttacaacatggcctcttaagggctacaaactctccttacaacctttctatcctacctttccaaaaccagacaagtcttacaggctggtccaggatattcgacttatcaaccaaattatcttgcctatccaccccatggtgccaaatccatatattctcccatcttcaatacttccctccacaacccattattctattctggatttcaaagatgctttctttactattcctttatacccttcatcccagcctctcgttcctttcacttggattgaccctgacacccatcagtctcagcaacttaacccgggctgtaccgctgcaaagcttcagggacagtccccattacttcagtcaagccctttctcataacttactttctttccatccatctgcttctcaccttattcaatattttaatgaccttctactttgt

SEQ ID NO: 471267 - DNA, 983 bp, Homo sapiens
ttccctgaccccttgcacttcctggaaaagtagccaagatcatggtgggaagtggtcagatattggatctgtctctaaaggtagattcaatagatgttgctgatgggttggatgtgtgctttgagagaaagagaggagtcaaggatggcaccaggacatccggagaaacagaattcagcttcctacggagggacttgcaggtgttagacatggcatctcagagaagcaggccagtctactgtgctaatgaggacctggatgctcagcagaacttccggatgcacaaacggaaccatcagcggtggaattcacagctcttgttagagtgctcccatggcctcttgccagtgtctgttcttacaacaatgaaatacaatcagtggatcccaccaagccccttgaccagcaggggtgtgatttcagacccagacttcaaaccagcaattcttacctcctctccatgactctgtgatttgacttctgccttatcatcctcacacaacttgcgtttcaaccacatgaatctatgtacagttttctaaaacacaatgttttctctaagattttttttcctggttttaatgactttcctaactcctctctttctggtaagctcttaattatgcttcaaaggtcagctcaaatatcatctcctttggaaagccttctcaggacctctcttagtaaaattaatcattttttcctctttccatgtaaaatagtataagcctacttttttttattaacacttatggcagtgctgtgattactatttgttagtgttgtctcctcacgtagaattcatctttccatttgtagcactgagtacagtttctgaaaaataggaaatactaatacaaccaacatatgaccaggtctccatggagaatctttgctcttgaagccaaactctgcattcatgaaatcttcagaaaacatatttaacttcagaaagcattagcagtaatatacattttataaac

SEQ ID NO: 471268 - DNA, 1797 bp, Homo sapiens
ctaaatcttaggtaaggttaaatccttctccccgatctagattttcagttttcataatgaagccagttcatggacttcaagtttcttacctgaagaaaagtttgaagaagcccttgaggaagggctgtggattcaaagcacaaaggtggtccaccagtcaaagtggtgatacctgtggtgatacaccagtaattggcgatacctggagttttaagctcaggctcttcttacattttcagtgtgccccatgtctccatgtgcagtccctgtggttgcatcccctgttcctgaataggcaaacaaagtgtatattgagattattagtgaggttaaatggagaaaaatctgtgataagaaacggagattttgccttagatattccaaatctactccctcatctaaaatatattctgtcgtgttgtgttgttttatatataaataatacatacaaagcatcaaagtcatgaagtcaagacttgaataatttggctaaaaagagtgtgcctatatcatcttggcatgtacatgcaatatttatgtaaatcaaaatattctaactgctcaatagtacatttttgaaacaatattaacattttcaatataataggtcaaacactaactttttataaattagttttattttacctctaaatggagtgctctaaaaataagacagagaaactgtccaaaccaaatttaaatatagtgtctaattaagggtagaaatttgagtgcctttatttaaaattcatatagatttatgcatgatttgccaaatatgtgctcaccttcaaaatattctgatgtatatatgtgtagtataatgtaaataattgttagtatttttttacttgaatttgatatttcaatcaaatacccatatacaaagctcagtttgccaaaagtaatggcctccagctccattcatgttcctgcaaaggacatgatctcatctttttttgtggcttcatagtattccatagtgtgcatgtaccatattttctttatccaatctattatttctaggcatttaggttgattccacattttttgctattataaatagtgctacaatgaacatatgtgtgcatgtgtctttataatataatgatttctattcctttgggtatatacccagggcaaaggacatgaacagacacttttcaaaagaagacttccacaaatttctaaaacaatctgcataggatcataatggcattgttgtgagaaccagtggtctaaagtatcttgcttatctgtgtgacccaaattcactgaaaaactgcctagaccatgtttttgattgagctgtgaagttcttgcaatgaatgtaatcaagattttgaaaataatctcccatatgtgctttacagttcatgataatttgtgtctcaagaaagggcataaaagcaaagttaaatttttgtgtttaagtatccttattagctcttatacaagtgagccaaaagtaaagcattaattaaaaacagcttctagtgaggcagttccttttatatctgaaccttactttgaaatacatttactaccctttttatcacctgaaggtactattccaatccacttgcttgcaatgttcaattgcatttcatggcacttttaagcttaattaaatttttgcaacagagtaggtctgttctttaaggcaaagcattgctttcaatccatctgattttcatatggaaaggagctagcaagatttttttcttctcatttttggaaagcaaatactctgccaataaataagtaaataaatgctagttttctatggctatgttt

SEQ ID NO: 471269 - DNA, 721 bp, Homo sapiens
cctgactgttagaaggaaaactaacaaacagaaatcaatagcatcaacatcaacaaaaaggatgaccacgcaaaatttccatctgaaggtcaccaacagcaaagaccaaaggaaaaaccagcacaaaaaggctgaaaattccaaaatccacaatgcctcttctccaaagggtcacaactcctcaccagcaagggaacaagactggatggagaatgagtatgacaaattgacagaagttggcttcagaaggtgggtaataacaaactcctccaagctaaaggagcatgttctaacccaatgcaaggaagctaagaaccttgacaaaagacagctgaggaagaagcacccttctagcctccacctgttcacttttgccacatcccttcttatactttctgagcccttctcccatcagatcattattaaaggctttaaactacaagttgagagccttgaaaacaaacaggaaggatttgacatcattacacatgcacactgagagcctgagcaataagggtgaatgactgggctgctctactgtcaggctgtgcatagtattaaattattcactgttagcatatagaaatgctactgattttcgtatgtggattttatatcctgcaactttactgaatttatttatcagttctaacagttttttgctgaaggctttaggtttttgcaaatataagatcataccctctgcaaacaaggcttattt

SEQ ID NO: 471270 - DNA, 692 bp, Homo sapiens
cacagaattaaggggcattagtttatctgtgaacaaagccttcgcttctagcatctgtgccatgctctctgctgttgacccaagctgttggtcatacaaggctgaactaacacttacttcctccctgaaggggagggcacctctaggcttcactggatcaaaggcaacaccaaaatttttatttaagcacatcaaagtctggaaaccaaatagagaatcagtggtgcttgaagcagtgcttgccagatgcccagagctgggccctcagctctcctctctgggtcccccgttcaaggcagagagagtcacagtgctgaagtccatgggcctaacaggatccctgaaatgggacagtagacctgaaattacatctttcccttggaatttaattcctaaagaagacaaattattatgttactttcacccaaatggaaattcagaaggccacaagacctatctggaaaacacttaaacacaataccgtgcacataatagcagcttagtaactattccaaacacgataattacaattctaaaaaactaaataaatttgaatcaacaatacctagcaacagtgcctgttcacatgcttgggatatgtatttggaggtcttttagcaggcatagatcttggagaaaacttcttgcaggtactccttcctttttacccatctctttgaaagtttcaactc

SEQ ID NO: 471271 - DNA, 1455 bp, Homo sapiens
ttatgctggacctggactctgtgaacattgcgcctgctgcttctgggctccttaaagatgctcagtcaacttggtgtagcccctgcgccagacctttaccattctcccgagcatcttttggcaaatcccttacttttggcaaacgatgtaattttctactttgctaagatcaggactatgccactcaaaataatttcactttcccctccttccttgtctaagttattttggatctctacatgcccaactgtaatagccgtccacagtgaggaggactcctcttctagaacctttcatccccttctcctcctgctgcttccagtaccttgttccatcaacaaaagcccccctttccttgtgcctttggtctatgcttgtctcctccattgtgaaatctttaacataccatcttctcatcaactctgcacaaaaaaacaccacgatagaatggtcctgactcccgagcccttacaagttggtgtccttcccaattacactgctgtgactgttctcttgggatgtcccagtcaaacatccagtggccagttccctgcagtagcaccagaagcttctaaactctagctctgtgtcttgccttcttcccaatccctaagagcacattttcccaataattccatcctgccccctcttctgtttttatatactttttccaagtcaatgaatttattccacaaactgagtttttaacttttatataacaatactgctctggccttgacctttctcctgaactccagaactgaatttctgactttcctgctggaaatttccatatagctcaatatgttcaaatctgaattcattttctcttgtcacaggactattttccgtctcttaacatactgcatcagcttaaacctaagctctctcccttgcctcaactataaagtgggaatagtagcacatatctcatgagattgtgtagggctaaaattttgttataaagtcattaggagagttatttctttcattaatatcaaccactcgagtagttgcaagcctgtcaattctatttcttagctacagccttttctacatgtgtcttttcatcatggtgaccgatctaactctaatctcaccaatgtttagctgaactactcaagttgctcaacttttatcaataatctactgtaagcaatgtgttttgcatgtattcttgtgagaatattccctggaaagagggatactaaagtcattcatcccagtctgaatattgctattttctactgtggtgggaatacaatgtaactaaaatgagaactgcaccagagattagagatttcaatagcattctcccgcctcccctatgcaaacctgcctgcaagtatatcaggtccaacttcagaaaaacagtctgataatttatgtcagagctcacaaattttatcccaacagagcccaaacagggtataaaatgaaataaaataggtttgt

SEQ ID NO: 471272 - DNA, 595 bp, Homo sapiens
gatgtcttgctggcatcgcagagcagcacatcagctaaaaaatgggtaaccttcatcttggcacacatttctcactcagcaaagccagcaggcaggaacatttaagtctgctgaagctgtgcccacagctgccccttccccaaggtgctctgtcccagggagatgggagttttatctataagcccctgactggggctgctgcctttctttcagagatgccttgcccagacaggaggattctgaagaggcagtctggctacagtggctttgccaagctgcagtgttccctgttcgaactttcaggtgtctttgtttacaccgtgaggagaaaaccacctactcaagcctcagtaatggtggacacccctcccccaaccaagctggagcatcccaggtcaacttcacactgctgtgctggcagcaagaatttcaagccaatgggtcttagttttctgggctccatggggatgggatccactgagcaaaactgcttggctccctggcttcagccccctttccaggggagtgaatggttctgcctcactggcattccaggcgtcactggggtatgaaaaaaaactcctgcagctagctc

SEQ ID NO: 471273 - DNA, 536 bp, Homo sapiens
gcatctgtcatgtaccagctggttttcaagatagtcttcagggatgtggcagccgccaggactgggttggtttttccatgtcaagggccatcctatccagctgcaggcatgctggctaggcacacaacattcaacggtttttaagtttgtcttgctggaaggtgaccgtggaggatctgcgccaagacaagctgctgaggcctcttctggtcctggactctccatctgggatctgtttgatgactctcggccaccccttttgaatccaatgctgtggcctgtccctggattcccaggcctttgtcctggaacttgctttcatacccccattgctctacatccacgggcacaggccaactctatgccttttcctcctgttttggttagctatgactacataacaaaccacctccaaatttcatggcccaagacaacagagccatttatttgtttacgattcggcggcttgaccaggtctcagggggcagagctcacctctgttcacgtacggtcagctgggacagcttgactggaat

SEQ ID NO: 471274 - DNA, 539 bp, Homo sapiens
tctgaagattctgagttgagctctgcctcttcccgttccatgtggagccttcagaggccctacctgcaaggccaggactgtgttctcaggcccctgggcagctggtgtaatgcgggtgatagcagtagcagtgatggagcactgaaacccaagtggtctatattggtgaaaatgctcccagacttgtccaagaccatcaaggcagtaactctacaagtctgcaagaaccccagtgttacagggcttaggatgccccctaaagcagatacagtttatatcacaacacgcaagtcctttcaagtatctggaaagacttcccaagaaggactgctaaaaatgagcccagacagtaaagactacaataaatacctaacccttgaatgcccagacactgaagaacatctaagcatcagcaccatccaggaaaaaatgacctcaccaaaaaactaagccaccagagatcaatcctgtcaaaacagagatatgtgacctttcagacagacaattcataacagctgtgttgagaaaactcaaagaaa

SEQ ID NO: 471275 - DNA, 705 bp, Homo sapiens
gtgggtcctgcataaagcccaaagcaaaatgtcctcctttaaaaaaaaaaaaaaagctgaaatgatgaagtttgagggaattagctcaacccagcatcccttcactctgttcgtggcgttaatttccgattccattaagcagcccatcggctcgcagcctcccctcctcccctccccgggcctgattcggatgcaagtcacagcgccggagttcaagctgctgcctcttaagaaggcctattttgacacagtaattacagtgcttgaacgatgctttacattagagtataaaacactcattaaattaaaattcttccatgaaatcatgaaaataaacagtctgtccaaactggcatcaacaaattcacagggtgcctctgcgttttctcagcccgggctagctaagggctgcatgtaaccacgaagtgtgaacggttcacattcctttgaaggccgcattctgcttctttttaagattattgctttaattgtttttacaacttgtaagattttaaagctattaagcttccaagttgggagtgggaaaacttgaaatggggaccatggtacccggcccagggtgggagtgggggtgggagacaggttaccattcccagcccccagacccttctgggacaattaaaatgcaagggacaagatgagatgggcaatttctccatggccccttgagggatggaaaataaa

SEQ ID NO: 471276 - DNA, 1478 bp, Homo sapiens
ggttgcaatggcttttgcccttgaacatgaaacaagcatgtgtcctggagagtggctggcattggcctgaaagctgcacagatggggcccatgactccattggtgcaaaggacgtgctttggttgaccagacccttcatgcagcaaagtgggtctgctaatccagaagaaagctttgttgaaggagaaaatccttttacaacgcaagttttctttcaatgctcaaggattctgttttctaaattccaatgtctccatttcactgtgttgggttttctacagctgggcctatctattaaatcggtgctgctaccaggccagtcggatagaaccacaggaattcagatgccttttggaactaggaacaaagacgagtcacccaacatgtttcatttttgtcatcgggtggcccctgattaatcgcatcaagggaaaaagtgttaaggtcctggggaaccattttggtaccctaagtcaatgctgccctctaaagccaatcagagctagtgtccagttagctcataccagcatctctgtgttgactggttaaagctgatgtccacctggtgcctttactttgcaccttctgccctctagtcttccaaacaacctgagaggggtttctcccttggatttggggatttggggtgaggagccgttgctgctaattggtgtcttcccaataatgctcggattaagccttggggggattacactaaagaggcgagaaggtaatacccaaaataaacacgagtgcccttcctgaatgcattcttgccagcaagttaaatcgtccagcccctagggcctgttcctaaaagatttaagtactaattcaggggagggggtgggtgggacacatagtagatttctgctgattctgacttcttctgacatcttttagaagcttcgtttctgcgctatttgattccctttgacgattgtcaagttaagtttactaaaaactggagaagactttgttccggggtgggagggggaagggggggctgctggattagaaacatgagccaatctgcagcttgtccatccgccctggcatcgttttatttctgcgtttctgaaaggattcaagtaatcaattccagaggacaagcttggggaaccttggcaaaggggcctccctcttggctattgctttgaatattttatgtagctaatagcgttctgatggggcccaaaatgtgggtacttggaaacctgcagggtcccctgtgaatttccactcagatggacgttcccagtcccccttgagagcagttctctggagtccctccagcgaggaattcacatcctggattccagctcaggagttttgcatgaattttcatgctttgaaggaagaaaatcttaacaactggccgataatcacagttcacatttattgagcatctactgtctctctgtgctaagtgcttgcactcgccctctcatttaaccctgataaggcccagtgaggac

SEQ ID NO: 471277 - DNA, 999 bp, Homo sapiens
taggtaaaatggggacagtaatacattgctcctgagtgaccgtggggagtcaggggcataatgtgtgatggtgtatccaacatagaacagccgcttcataaacatgtgtcaaatggaaaaccattagacaagtacacacaagggctttttaaacctcatttggtgaagacgacaacatggttcaccgagaatggcagacacctgtactacaaaagggtcctacacactgttagggagccgtctagcaagattccataccgcacaggggccaccggggctgctacacggatttctagtttcctcttcaccaaggcaccccagcctccagcttcctgtgctgtgtccaagggcagagacagggctgctgaccgaaacttagagtcctccatgcagcacagcaaggggtctggccagacttggggccgcctcggaggagtcgtgccatccattctggacactccattctcctgggaagcctttgacatgccccgctatcctgcttccaaggacagggcgcccgttctccgtggcaaggattcatgaattttgcttccagaaaattaaacgaacgtgaatccatttattaattcatccattttacaagcatatattgaacctctactgtgggcagatacttcctccactcccttttgtccactcccgtggcttaggtactagtaaaagcttaagtactagtaaaataattagaaaatgatgagttctgagtatttattacctttggggtttcttttaagtcactaagctattttttaaggaaagttttaggttcacagcaaaatttcacagaaagtagagatttcccatatacctgtcctccccacacatgtatagcctccccaagttccaggccagagtggaacatttgttaccattcctgaccctccactgatacatcataatcacccaaattccattctttaccatacagttcactcttggtggtttacattctatgggttttggcaaatgtttgataac

SEQ ID NO: 471278 - DNA, 635 bp, Homo sapiens
aggaatgctatgaaggagcggggcagggttgtgcagaggtggggatgtgtagcgactcaaatgcaggtaacctggttcaagaggagatgctcatgccagcgcctctgtggacagtctctggccagccctggggacatctgctacatctggggacatttttggttgtcacaaccagagagggggacaggggatggtgtgctcctggcaccttgtgggtagaggccagggggactgctaaacctcctacagtgcgcaggacagcccccccacaaattatgactcaggccaaaataccaactgtgcagagcttgagagccctggcgtacatgaatgttgactcggaggcccactctctgctgtatcagaaccaacccaggattgcctgtgtccggtgtaggccaccacagtccctttcgtggaagcaggttccagagatggggcttgggaagtatgaaccaaagaggctgaatttaagagacgaggatgggcagtgtctactaacatgaacacaggctgaccctctgacgcacaattccacccctgggtatagacccaagagaaaatgcgcacatgccccaaagacatgcagaagaatgtttataggagctttattcatcatcatcctatactagaaa

SEQ ID NO: 471279 - DNA, 673 bp, Homo sapiens
cagctccgggccttctggatggaaacaagaaaaagttcctatctcacatccctgcccacatttgcaaacggtaaatttgaagtgaaaaatagggaatggttacatagccaccatggaaatctttggcctgggagacatttggaataacggggtggcacaaagaaccctgagacatacttgcaccgatatttttaatccttgtcaccatcaagcgcctctggattttgtgtgctgcggcactatcaagctgctgaagttggaagacagaattaatagtgataataatagcggctgctattcactgatcatctactttgtgccagtcccccagagtggggtgggggtaggaggaggaggcgactgccaggcggaggggtggagagggggcactctgcaggcccagaatccttgtctggggagaaaaacctccagaaacgcctacttccacatgcttggtggggtttaccctcaggacaggcccgaggggcagcagcagctgcctgtggatccattcatgtgagtggtcctgaagaggagcacctgagtgtttcacaaccaaatgctcaacagatgtttctacatgtctggagaaatgcaatgaggggtgcactggggtaatgatgctgaaagctcccagagtcaatagcctttggggcttgattagcagagactc

SEQ ID NO: 471280 - DNA, 1361 bp, Homo sapiens
gctaattcagcttcttgaatgcctaagtctcagtgctccccattcccggcgtttccctaacaccgggagagccttctcggccgctgcctccttgtttggcgtgtgaactggtattgaatgttctcagaatccagatggctcataggggtttcgagcactgctcctgctggggctgaggcgacactgagaggggggccttggcctcccctgtggccgggcctgctccctgagacctgcgtcccaaggattgcattgccagcatgtgggagtgttagtgatgcctggggcagccgctcgccctgacccgccgtgtcccagtgactgagggagccaggttgctctctgggtctggatgtggcccccagacccagtttgtccacccctggcctaggtcgcgagcatctgtccttttccttcctagcatctccggttctgcttcttttgggcaaacaagtatccccctagggaactacccttcccctctttttaagtatacggagtccatgggcttcacttgcctgcttggctccagttgatcagcgtgctctgctctcctccacacccctctgctggtaattggtttagcaatggacacctgacccaatgggtgccagtgagagttgggaacttcgttcagtgcttggcagaaggaggcagtctttcttgccctgaggctgtaagatgtggaactcacgcagccatttgacttcctgagaggaaaccctggaactgccagattgagctttgccatgagtgttgggaagcctggatcctccagcctgtgagctctaaattctgcagcggaaacatctgggccctccgctggccccagggtgcacaccactacgtctgccataagtcacgacagcatgtcgagggacttgcctgtaccctccgccttcgggctctgtcagcctgtggtcctgggacattccatccctccaggtgcctctgtgcaaagtccctttccaagagaccccaagccagctcctctggtggaagctaagttagtgggggcacagcttcgtgcttccgaccactctcagtggaaagaccgctcaagccctgtccagcccttcttcctcctggacacttctgctgaggcaaacaccctagaggcagagagaggtgtttggctgctttgctcactgcggtatccccagctcctaggaaattcctgttttgcagtaggagctcatcaaagaccaaaaagtaaagaaatgtatgctattccaagccccatagattttcagctttcttgtgtcaccagcctcagtggccgcagaattccatcttctcccacgtgtctcctatctgatgtcccaggtgtagattctcggtgatgagcacctcctccctgt

SEQ ID NO: 471281 - DNA, 860 bp, Homo sapiens
tcttcaccaatctgacaggcacagggccatgggggacacggatgccaagcctggtttgaaaaagcatgcttcctgtttccgtgtggaaagtcatcaccaggaagggccgactgaactcagtgcccagagtgggtgggaagtcaaggtctgggcgaggcccaggggtgagctgaatgctggtggctgcagcagcttcagagcccctctcatccagctgaccttgggtgatagtgccctggagatgacagtgccctggggtgacaatgcttttgaggtgactgtgccctggggacactttacggtggctgagggagaaggcgaggcccggcctccccggggctctgctgtgtgcaggctacctggtcctgagcagactgtcccacttaatcagtgtttcaggcagcagggcatcttccagctgcctcatcttgcccctgttggggaagatgaagaaggtggtggtgttcccagcgtggtccatccgcagcacagagcattgcagctcacggtcgtgcaggaagcggtggctggccttctccttcatcatgggcacccacacagcgctgtgctcatctacaaagaactcctttgggctggtggcacagcaacacggacgtcatcctcgcagagaaccgagaacgggcttggggttacccttctagcagcttgtgggagtggggaaagcaccctggatgctggaatcttggagtccacactcaggaagccaaatcccactcactaactccctcctgagaggtcccttagtacctgcgtggccctgggggctgagcccggagcctccctgagcttctgtctcctcatttgaaaatgatcaatactattagaaactattacaatag

SEQ ID NO: 471282 - DNA, 818 bp, Homo sapiens
agcaaggctgctccgggcagccaatggcaagagcacaggtcctaagcaggaagaagcttgaccaaggaccccagaggatggaggcctctcggtggtggctgctggtcactgtgctcatggctggggctcattgtgtggccctggttgaccaagaagcttctgatctcatccattctggcccccaggacagcagccctgggcctgccctgccctgccacaaaatctctgtgagcaacatagactttgccttcaagctctacagacagttggctttgaacgcccccggggagaacattctcttctccccagtgagcatctccctggccttggccatgctttcttggggggccccagtggccagcaggacccaactcctggagggcctggggttcaccctcaccgtggtgcctgaggaggagatccaggaaggcttctgggatctgctgatcaggctccgtgggcagggtccccggctcctcctgaccatggaccagcgcaggttcagcggcctgggcgcgagggccaaccagagcctagaggaggcccaaaaacacattgacgaatatacagagcagcagacccaggggaagctcggggcctgggagaaggacctcggcagtgaaaccacagcggttctggtgaatcacatgctcctcagagaatcccagaacccaggctccaaccacagcctagccccacccatcacagcatctggaaagtgtcccctcctgacttggatatagatgacactcggtatctcgtacctatcctaagtgattctgatttcagtggagtaagtccaagacccatgactttgc

SEQ ID NO: 471283 - DNA, 644 bp, Homo sapiens
gggagctcagaggagagcctgctgtcggctccaggaggacggggatccctgaccgtgccactgccatgtatatcatccgtgcctggggctgtgtccacatggtgcagatgctccttgaatccttgttggagggcccgtgggtgctttatctccgacagttgtcgcccaaagcactgtggttgaaagacggcaaaagtcagtgcccatggtcccagggtaccttccttcttttccgggagctgctactctgccgttcaccaggtctcctttcactgactgcatcattgggtccttgccatgccctcaaccccaccaaggggaaccctcctgtatgtcctgagttccctccatggattcggcagcagctggcccaattcttccagggcagttctggctctgcgtgtgagctggtggtgctcctgctgagccccttccagtcccttcctttctcaggtccctgtgcagtcagcttctgtatctgtagcatcctgagtgtctttctttattccttgccagtcacatacgatgagaatcacaggatgccagccccagaacctccactttatagcaacgtagtgataatcaagtgaggtgataaaggagaagggcttcctgcaagacaaacacagggcacaggcaatgcc

SEQ ID NO: 471284 - DNA, 2759 bp, Homo sapiens
ggtttcagatgaagaaactggtttcttgtgctgctgttttgcttcttgccatgttcagtcccctcagatgccagccagacatccggcagggggctggagagggtgatggtgccagcagtggtggtaatattagttctggtggtgaaggtggtggtggtggtgagagtggtggtggttgtaatggtgatattagttctggtggtgatggtggtggtggtagtggtgagagtggtgatagttgcaatgatgataatagttctggtggtgatggtggtgctggtgttggtggtggtaatgaaggtggtggtgatggtgctgctcgtggtggtgatggtggaaataatagttgtgatggtgatggtggtggtgagagtggtggtggaggtggtgatgatggtgatgatggcactgtggtggtgatgaaggtggtggtggtgatggaagtagtagttgtggtgatggtgatgttggtggaggtggtggtggtggtgatggtgttggcgggggtggtggtgctggtaataatggaggtggtggtggttatggtgatgatggagctggaggtggtgatgcaggtggtggtgatggtagtggtggtggtaacggtggtgataataattggggaggtgatggtggtggtagtagtggtgacggtggtgattatagttatggtggttacagtgggtgatggagaggatggtggtggtggtgatggaggtagtggtggtgacagtggtgataatatttgtggtggtgatggaggtggtggtgatggtggtggtgctggtgatggtgttgatggagctggaggtggggatgatggagatgatggtggtgatggagatggtggtggtgatggtgatgataatagttgtgatggtggtggtgatggtagtgatggaggtggtggtggtgatggtgatgataatagttgtggtgatggaggtggtgatggaggtggtggtgatggtggtgatggagatggtggtggtgatggtgatgataatagttgtggtgatggaggtggtgatggtggtgacggaggtggtggtgatggtggtggtggtgatggtattgataataactggggcggtggtagtcatggtggtgattatagttatggtgatgacagtggtggcgatggagaggctggtgatggtggtgctggtgatggtgatgacagagctggtggtggtgacagtggtgataatagttgtggtggtgatggaggtagtggttatggaggtggtggtgatggtggtggtggtgatggtgttaataataactggggcagtggtagtgatggtggtaattatagttatggtgatgacagtggtggtgatggagaggctggtgatggtggtgctggtgatggtgatgatggaggcagtggtggtgacagtggtgataatagttgtggtggtgatggagttgatggtggtggtggttgtgatgatggtgcagtcactgaacaaatctttaccctaataatattaaataattattcataattaataattaagtaattattaaattatttcttttttgaaccatagttttcatgtggccccaaagagaaagttctttattgtattctctttcatcttctgaaaattcaaacacattttaaccttcaggacttccagttttgaactcttcttggtcgtctattctattcctgagtgagaaaaaaggctttgaaggtcgcctttgatagagaaagatacagcaggaggagataacaggtcattccgacagtgagacagggaatagaaaattgctctagatggctgctctagatggaatctcctctcttggcctgccactgccattcattaattcattcctccatgtacaggttcttactgactgccctctctgcacctggcactgtggcaggcgctgaggacacaaggctaacccaagttcccccaagctgccacacgtgcaggcctctcctgggggaagtgcaatggcctcaaccttgtacctggaatccagtgggagaaatgtctgttattcatctatggcttcactgtgccggttggctgatctatataattaggtccctgctatggtttaaatgttcattccctctgaaactcatgttaaaacaatccctaatgtaacagtattaagagttgggcctttaagaggtgattgggttatgagggctctgccctcatgagtggattagtccattcatggattaatgaattcatgagttattacaggagtgggcttttttatagaagcagtttggttttcagtgcaaccctctcgccctgtgatgtcttctgccaagttgtgacgcagcatgaggctgatcggatgcggctacctgatcttggacttcccagcctcaggctgtaagaaagaaaccttttttatttttaaattacatctcaggtatcctgaatagcagcagaaaatggactaagtccccaaacccagaaatttaataaaagaaaaaaatcaaaccatgcacataattcctcaatggaactcttaatctagtaaaagattaagtgacagtccacagggcccacagtctccagtatctttgatgtgtcaggcttaggcatgggaggagtgtttggttttgcagcacaaccattttttcaaaaataattttacatggagccccaataatacaagcacaaacaaactagaggcgctctctgattgcagggcaggctgtgaagggttggagggaacaccccactcatcctgccatggcacctgactggctggcctcc

SEQ ID NO: 471285 - DNA, 655 bp, Homo sapiens
tggagaaaggtgaaggaggagcaaaggcatgtcttacatggtggcaggcaagagagcatgtgcaggggaactgccctttataaaaccatcagatctcatgagacttattcacaatcatgagaatggcataggaaatacttgccctcatgattcaattacctcccactgggtccctcccatgacatgtagggattatgggagctacaattcaaaatgggatttgagtgaggacacagccaaaccatatcagggcggcacacaggccatgtacttggcattcatccttttagtggatgccaccgagtcctgggggcgtctgaaggcaccacgtcactgtctctgggcgcaagggcatgttgttgcagagagggcaacagatgtgcatgacaggaaagtaagctccgggatctccttacaactgatcttgtctcccaacagattcccttcgccgccgccagattttacttctgttattaattcctagtttcatttcattttaatcagaaaaagatactttgtatgatttaaatcttctaaaacatgcaaagacttgttttgtggcctaatatatggtgtatcctgcagaatgttccatgtgcacttcagaaaaatgtgtcttctgctgttttggggtagagtgttctgtatgtttatt

SEQ ID NO: 471286 - DNA, 658 bp, Homo sapiens
tctcccccgagtcattaaccaatgggaggctttgtcaggatagctgactctgctttcttctactttattctgtctgcattggggacaaatgtggccacagtagctctgggttatttagttctaactgaacacattttggcacctggaagtggaaagctgcatatgaaagccaaacatgtggcaatgactttgggatcaaatcagagtcggaaagtccttataaagattgtgagtggaaacgtgatgacccacaaggaggccattgagagaaactacacacttcaggaaggacgtttaaggacgctcctctgtaccgtgactgatttaacacgacattttcaagatgcaaccacattctacacgtggcccttgaacaacatgggggttaggggaaccaatcctccatgcagttgaagattcacaaataacttttgactccccaaaacttaagtactaatagcctactgttgaccggaagccttacttataacgtaaatagtcaattaatatgcattttgttgttatagcattatatagcatatgcttacaataagatatattttagaggtagggctgatggtatttgctgacagtgtttgctgacagatgcaatgtgtggtgtaagaaaaaaatgacaggtcaaggatgactccaaagg

SEQ ID NO: 471287 - DNA, 2663 bp, Homo sapiens
gcagattagaatagcttctgttcaagtgtttgtgatgtcgccgtgtaagccctcatcgtgatgctttaaaagtcatcgttaagtcgtgttacctgctcttcatccatgtccctgcaaaggacgtgaacttatcatttttatggttgcatactattccatgttgtatatgtgccacattttcttaatccagtctatcattgatgggcatttgggttggttccaagtctttgctattatgattagtgctgcaatgaacatatgtgtgcatgtgtctttatagtagaatgatttataatcctttgggtatatacccagtaatgagattgctgggtcaaatggtatttctggttctagatccttgaggaattgccacactatcttccacagtggttgaactaatttacactcccaccaacagtgtaaaagcattcctatttctccacatcctctccagcatctgttgtttcctgactttttaatgattgccattctaactggcatgaggtggtatctcattgtggttttgatttgcatttctctaaccaccagtgatgatgatcttttcttcataggttttttggccacataaatgtcttctttcgagaagtgtctgttcatatcctttgcccactttttgatggggttgtttttttcttgtaaatttgtttaagttccttgtagattctggatattagccctttgtcagatggatagattgcaaaaattttctcctattctgtaggatgccctgttcactctgatgatagtttcttttgctgtacagaagctctttagtttaattagatccaatttgtctattttggcttttgtggtcattgcttttggtgttttaatatgaagtctttgcccatgcctatgtcctgaatggtattgcctaggttttcttctagggtttttatggttttaggtcttacgtttaagtctttagtccatcttgagttaatatttgtataaggtgtaaggaagggatccagtttcagttttctgcatatggctagtcagttttcccaacactatttattaaatagggaatcctttccccattgtttttgtcaggattgtcaaaaatcagatggctgtagatgtgtgacgttatttctgaggcctctgttctgttccattggtctatatatctgttttggtaccagtaccatgctgatttggttactgtagccttgtagcatagtttgaattcaggtagcatgatgcctccagctttgttctttttgcttaggattgtcttggctatacgggctcttttttagttccatatgaaatttaaagtagtttttttctaattctgtgaagaaagtcaatggtagcttgatggggataacattgaatctataaattactttgggcaatatgaccattttcacaatattgattcttcctatccatgagcatggaatgtttttccatttgtttgtgtcctctcttatttccttgagcagtggtttttagttctccttgaagaggtctttcacatcccttgtaaggtgtgttcctaggtatttaattctgtttgtagcaattgtgaatgggagttcactcatgatttggcgctctgtttgtctattattggtgtataggagtacttgtgatttttcacaatgattttgtcttctgagactttgctgaagttgcttatcagcttaaggagattttgtgctgagatgatggggttttctaaacatacaatcatgtcatctgcaaacagagacaatttgacttcctctcttcctatttcaatacctttatttctttctctttcctgattgccctggccagaacttccaatactatgttgaataggtgtggtgagagagggcatccttgtcttgtgctggttttcaaagggaatgcttccagcttttgcccattcagcatgatactggctgtggatttgtcattaatagctcttattcttttgagatatgttccatcaatacctagtttattgagagtttttttttttctgcatctattgagacaatcatgtggttttgtcattggttctgtttatgtggtggattatgtttattgctttgtgtatgttgaaccagccttgcatcccagggatgaagtggacttgatcctggtagataagctttttgatgtgctgctggatttggtttgccagtattttattgaggattttcgcattgatgttcatcagagatatcggcctgaaattttcttttttcgttgtgtctctgccaggttttggtatcaggtttttccttcatttcaaccttggtgaatctgatgattatgtgtcttggggttgctcttctcaaagaatatctttgtggtgttctctatatttcctgaatttgaatgttggcctgacttgctaggttttggaagttctcctgggtaatattctgaagagtgttttccagcttggttccattctccccatcactttcagtggctagtgagaaaagagcatgggcagtgggggaatagtttcagcaaatgtatgcaggcaggagtgaacatagtttatagcacaaggcagaggaaactatcctggttagagcaggtgggctactttggggagggactttgcaataaaacctctgggggcaagactttggactggcttcagtaggacttaggcatcagctcaagttctt

SEQ ID NO: 471288 - DNA, 559 bp, Homo sapiens
atttgggtgctggctgtctctgattgtcaagctcctctcccgaaatggcaactccctctgtctgcctgaaacgtgtacaaacacactgcggtaccaagatgaagctggctgcagacaagccccatactaggcctgaggcccaaagattcctgcggcaaccctgcactggttcccagcttcaaccaaaccccaccctccacatggccctggacgaccttcttcgtgcatccttcacttgtgaagagcccctcaaggaggcggcatcaccttcaggatgtgatggacgcactcacaggcaggaggggaggcagaacactagtccaccatcttctctgtttgctggctctctgagtgaagtcgctttccttaccccaacaccttgtctctcaacttactggacttactggctgttgggcgatgactgggagctctacctgtaagggcctcaccctcatgccaggctccagcttgacattcaggtctcagctgaagtgtccccagggcctccccgacctgtccatggccctgttgaatcctctgcctggggcccatcgctgcc

SEQ ID NO: 471289 - DNA, 488 bp, Homo sapiens
tgattcctgaatctccagtcccagggaggctgctcccaacccaacatggccacacagcatactacagggcaggtcaccaaggggcccctccccaggagctgccctcagtggaaggaaactgacttatgctacatccgcctctatggcctgtcactgtggagggccaaaggtccaagcccctgcctcaatgtggagcgcccatctggcaatcccagctccagagccctagtgggatcagctgggctctctgtggcagctgcatcagagttcaacttcgctttctgcccaatcctgctgcaagacaatggaggtggaattatgaaggcgtctcctcagggagagctaaaacctgagcctgccgttcagaggcagaagctgcatttcatcctcatgtccaagaagcaagctgggggccagaaatggggccaggccaagagggttggaagccaaggaacgggttaaggatccagtcaacttggcttggctgt

SEQ ID NO: 471290 - DNA, 443 bp, Homo sapiens
tattaatgatgaagcagggacaacagggtaatggtggtggtgatggttcggttgacaatggtggtgatggtgatactcgtgatggaggtgatggtggtgttgaaggttaaaatgctggtggtgatagtgatggtggttatatggtggtggaggtgtggtggtgatggaggtgatgatggcggtgatgatggtgacagtggtaatgaagatggggtggcgatgatagtgatggtaatggcagcggtggtagcaatgatggtggtgaatatctacactaagaatgcaagaggcaaacccacaattcctcccacagtgcatcatgctttgtgcaaagcactctccgtcacagagatttccttgtcccttctctcagtggtcaccttaagaagctaggcctggagacgctcatctggtttgtggtggggcctggaccaccacccact

SEQ ID NO: 471291 - DNA, 2505 bp, Homo sapiens
cctgaacaattaggtgaagagaggcaggaatggcattccagacaaagggaatagcagcaggggggaacacagagagccaacacagctggagctgcaggcagaagggacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaaggaggaggatctccgctgctgctgctatgattatgaacttctgggcacctccgtgctgcacatgtgctccctcttccacgcgttcatctttgctcagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtggcctcaaagcctgaaaagagcctcacgttttcaagctggcttatagggacctatgctccccaatcttcaaatccagtactgttgaatgtagacggctaccaagaaaggggctgttccagagctcattggaaaatgtctgggatggtagaaatggtgtgtctccatgtgattagtttaatggaggcattgcaggaatgcaattcgaccatttttgtcaaggtaggaaaaccttatgatttttaaagaccatttcttactgctaaaaacaaatgtggatttatgttgaagataaatctgctatgaagagtcatgaagatgtctttgtgtacatatatgttttcatgtatgttgggcaaatacctaggagtagaatgtctgggccatgtgacagatgtatatttacctttaaaaaaattgttttccaaaccattttccaaagctgttgtgctctgttacatccagtatatgaacagtgtatgagcattcccagttcccccacatctttgtcaacacttggcatagtcaatctttaatattaattattctaagagttgtgtactggtatcttgttgtggttttaaatagcattttcctgtttgctaatgacattaagcatcttttcatgtacttatttgctgtccatatgtctgcttggtgaagtatctgttaaaattatttgcccattttttattgggttgggttttttcctgattactgaagtttgagatacaagtcctttatcagatcaaaatgttaatttccagtttggtttcttctttgccccttaagttgtttagaagtgtgttttttaattatcttttagctgtatgtctttgttgttgtgttagtggttgattcagagtttatagtatatatttttaatcacagtctgccttcaaggaatattataccacctcatatattgtataagaactgtacaataatatacctccatttcccacctcctgactttttgctattattgtcatacattttctatatattttataaagcaaatcatacattattatttttgctttaaacagttgactatctcttaaagagattttaaacaagttttatgttcagttatatttgctataattgccatatttatatttgccattttaatgctcttcatttcattctatagatctaaacattcatctttcatctttccttctgcccaaaggattttctgtaaagtctcctgtgcaggtcagctggtgattaattgttttaggttttgtatgttttagaagctttattttgctttcaattttgaaagacagtttcactgggtattgaattctagatggatggtttcggaggttttttttttttttcaatactttaaagatattgctcctccattgtctttttgcttatattgtttccaacaagaaatctgtcattcttatcttttttgtctgtatgtgatatgtcttttttcctctgttgtctttgccactatggttaagcaatttgatgatgctatgccttggtagagttttcttcatatttctggtgcttgggtttggtgagcttcttgaatctctggatttatagttttcattagatttggaaaaatatcagccattgtttcttcaaatattttattcagtgcctctactcaacatgcccaatctttcttctaccttcttgaccatattgaatataggtatcataactgttttaatgtccttgtctgttagttctgttatctgtgtcatttttgttttattttctgttaatggatttttctcctcattcgtgtgtttcttttgttgttgttgtttcttagcatgcctggtaattttttattgtattcttgacattgttaatttgactttcttgggtgatggatatttttatattcatataaaatattcttaagctgtattctgtgacatagttacataacttacaaatatctttatccttctgaggctaacatttaagctttgtt

SEQ ID NO: 471292 - DNA, 850 bp, Homo sapiens
tacaccgaagatttatgacagtggaatatacttggttaggaagatggaaatcagatcccatctccttacacctaaagaattcattgagtgtgtctcccatatccgactgttgtcctggctgctgctgggttccctcactcacaatgcagtgtgcccaaatgcctcctctccctgcctgcccattcctctggatgcaggctcccacgttgcagaccatcttattgttatcctgattggatttccagagcaatcaaagctgtggacagtttattgcgagcaaagtgccgtcgctacaaatctccaaaatcagaatgaattcagcttcacggcgatactgacagcactagaattttggagtagggtgacacccagcatccttcagctaatggcccataacaaagtgatctcagttgtaaggttatataaatggatcggggatatgttaccttataagctggatgttctgcttgcataagcattttgattaaaaataagcattttgattaaaaacaaaataatagttcaagagatctattgtacgccgtggtgactacagttaataacaatatattctatacttgaaaattgctacgaggagatttcaaatgttctcaccataaaaaataaatttggaaaaatatcagccattgtttcttcaaatattttattcagtgcctctactcaacatgcccaatctttcttctaccttcttgaccatattgaatataggtatcataactgttttaatgtccttgtctgttagttctgttatctgtgtcatttttgttttattttctgttaatggatttttctcctcattcgtgtgtttcttttgttgttgttgtttctt

SEQ ID NO: 471293 - DNA, 824 bp, Homo sapiens
gtaaggtcaccgctacatgagagaagaggaacgggtgtttttgaatgtccttctgcgatgggagtgggtctcacatgcagaagccctccccttgttactagcaattgaacaaagaaagggatctctgagataatcaagtccaaatcttctgcaccatcactcccaccattttactttattattattattattattattattattattattattattattattttgagatagagtctcattctgtcacccaggctacagtgaagtgggatgaagtcctcatcatggaattcagacacagaaggaagagaagtcttcttgggcaggtggatgaagatgaagacaccaggtcagtgcctggattgaactgggtccagcagcatatttcaagaatccagaacagagacaggaacacagcaggtgctcaagacatgttagttgaatgtctccccttcccagaccccaaacagctttgtgtgcgctatcaagtgtgcactgtcgataaagtgcgcactgtcaataaagtgtgtgctgtcaataaactgcgagctgtcaatatagtgcgtgctgtcaataaagtgtacgctgtcaataaagtgcacactgtcaataaagtgcacgctgtcaataaagtgtgctctgtcagtgaagtgtgcgctgtcaaagtgtgtgctgtcaaagtgcgcgctgtcgataaagtgtgcactgtcaatagtgtgtgctgtcaataaagtgtgtgatgtcaatagtgtgtgctgtcataaagtgtgcgctgtcaataaagtgtgcactgtcaataaaatgtgggctgtctaaatgaagtgtgc

SEQ ID NO: 471294 - DNA, 721 bp, Homo sapiens
agcagtccagagctaatggagaagctctttggtgttggagactcaggatcctacggaacatgttgcatcaccatcaaacatggtggagtatgtttcttagaaagatggaggaagaaattcctggcaggtcatggtggctgatgcctgcaatcccagcagttttggaagccaaggcaagagaattacttgagccagtacttccagaccagcctgagcaacacgctgcacaaatggagaaaaacattaatgattttttgtttgtgtcaagcaacactgaggacaatgaattccctatctttgctatgatgaacttccatataatatcttgcaagacaaatcaggatatattaatactaggaagacagggacaggccataggaactgtcagaggccacttccgtagatgcaaagcctgagatgtgttgcaaggttataatgtgaattgaaagaatgaatatgcgcaaagcctttagaccacagctgctatctgttaagagaataaaaataactcaaccacataaatatgacataagagaaataaatgtagaatatgatgtcagaagttaatgaaaaataaaaccaggtaagggaatagagaatgagagatgggagccctggggaatttatcatatagaatattcagggaagcctttctgagaaaatgacatttgagcagagaccgaaggaagggaagaaatacctcattcaacatacaaaaaaa

SEQ ID NO: 471295 - DNA, 680 bp, Homo sapiens
tctgtgacaatggaattcattcgtgtatacctccgttcatgagcgtgcttatctgctgatgattttgaatgtggcagtggcagcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccagcagccaacgacggggctctgctggcaggtggtccgtctgacgtggtgggccgtgtgccgagactccgtgtactacaccatctctgtcatcgtgctcatcgtgttcatatatgatgaacaaattgtgtggtaagtttttcaagtgtagttttcattgttcttttttgttgttgtttccagtatccttatttgttgggttccctgaatcgttttaaaaattatttttataaacttaagcttattaacttgtgaaagtg

SEQ ID NO: 471296 - DNA, 1068 bp, Homo sapiens
gcccaacatagggtaccctggacttcacctcgatgacgatgatgatgatgacgatgatgatgatgatgatgacgatgatgatgatgatgatgatggcagctaccacgggctccgggagtctacagaggcccacccctgagggcacctgcttggtgatctcatctcctcctagcccagccacagtgtcagctcccgtgcccagggtcccacccccaccagactctaccaccctctccccccgcaccccacaaccgcccttacactggcatgggaaagcctgtgaaggtggcgatgacaagcaggagcccatcctggaagatctggacagaaacagattaagaacagctcttctggccacaaaagaggtagccctcaagggtagacacccaacaatgaagctacacagaaggacaccgggccagcgcatcctcctctgtgcacctgcagtgcctcctgcggggctgctcactggggagccgctggagtccctcaatgtcacctagctttccctgtgttgagatcttgtcctctctactctagtataagctactcaatgacagcggcttgcatcttatactccccactacctgtccacaatagagctggacacacacgagcaggtgcttgctacacagacttgtgaaatgaaaagggggcagagattctcataggccagggaggaagatgctggaagggaaggctggccacagaccccacctggcctgagagccgggggctgtgcagtacaagggagaggcctggcacctggatccaggtgaccccagtatgtttccagctgcccaagagatcttaggaagccactaaacttctgaacttcgtgtatcttgtcttggcaaaaacgtgataaggattaaaatgtgagatacatcaaaatgcactttcattccatcattcgacccatatctatgcagtcctttctatgggccaggctgtattctggaaacagtcaatacaaagcataatgcaaaagttaactatttttaaagatattatcaagttccctccacttccctttccacaaaagggacaaggtgaggccttcctgtc

SEQ ID NO: 471297 - DNA, 1223 bp, Homo sapiens
cattttgtaaaccagcaaaggccgtgggacaaagcgaaaatgcgttgccgggtttatcctggtcctggcttcagtgcctttggattcggaatatctcctctgcaatttgaagctgatggctgctggtccaggggccacactttgaggagcactgggccaagggatgctatgatgacagtcacagcactaaagcagcagaaatttgtttccggctcgggcttctggtctaccaagagatgtacgagctcttgtccccaactggagaactcggtgtcctttggtcattacccagataacatcagaaactgcgagtcaagcaatcgggccattgcaaataggttcagtccctcagactcggttctgaaagcagattctctagcaaattcttactataggatgaagatatttcaggctaaaaccgtcctcctctgggtcatgcatgtgagcagtcatagggtcattcaagccgagagaattctaatccctcaggctgctggtaaataataatgtataaacttattattagtattctgtttcaaaggccagtgatcaaaagacggttagcagatggccagaacggtgagctttagaactcaaattgaactgcttttgaattcacacttcacaatggccctctgtggatctggacttcccatcttgcattcttggctctgcaaaaaccttctagaaccttctctcagtcctcttacaaatgcccccactgcctcgggacacatctgtacgtgcaggctgcgctttataatgggaggcaggaggagtttcctgcaaccatttctcagagtctcagccttgctctgccggaagagagcctgaagtggaaaccctggtgtctttgaacagaaagtgtctggccttgagacacatacatttgggacatttgtgcccttgagcaaaacttaatatgtggagccccagtgacctgtaagagaagaagcctttctgatacagcaataattttctccttgccacaaagcattaatattcagtagctgagttttataacgaagaaccatatgatgatttttagaagcattcacctggaaccaaggaagaaactgggggtgacatggcctgcccaagatggagctgctactggtccctctcattttcccattgtctgccctctttgccatagtttctgtcccacattcccctacctcctatcaagataccaaaatctcatctcatatagtttcacatcc

SEQ ID NO: 471298 - DNA, 1689 bp, Homo sapiens
acctctcacatgaggaaaggagtatgaacagccttgaaattaaattgcaaaaccctatggaaataggaagggctcctgtcagtgcagtaaatcatcttggagggattcgaatggggttgggagaggttccctgtactactgctttctttgacttgaactccaaatgcgtcctccaacttagtcccttctcaggagctggccttgacattcccatccaaataggacgctttggtcctcctgacatgccctccctcattgattttgcaccagagaaagtgctataccccaaggtctcccttagcaaacctagtttgtccatgcttgtctctctggccccctttggttcgcctgcccatgtggctacccaggtcttcctccctgaaggtgaagccttaggggaccagggggcaagaattgaacctgggcttaagaatctgggaaatataaagtttcctgtgagccgctccgtcacaacacatatccggttcttcggattctcaagacagaagcctggaagccaccccagttcctccatcttctgctgccctaagccctcttccaatcagccagtgactccagtcaattccatctcctacatttcctccagatttggacttcaactagtggagcccctgaaggagaatgagaagggtcacatttgtgttttgggcaagatctgttctggaagtcctgtgaagaatggattggaaaataatgagagtggaaagaagatggtcagggacctcaatggaaagcatcaaggtaaagggcctattaatgaaggtatgagtgcaataagggaagcaacaaggggtgctgaggcccccggggacccacagcagcaggaagccatcaccatcctgaggccagaggggcagggagagggagtggtgctcgtagaacccaggtggaagacaggatgtggcaaggacccagctgcaaccataccaaagaggatagcacagtagggcagtgtttctcaagcttgagctcatccgagtcacctagaaggcccagattcctgggcccaccccaatgtttctggagtgtggcccaagaattgcatttctgagaagttcctaggtgatgctgctgctgctggttggcaagccacaccttgagaacttctgcctcaagggatggggaagcagtacaatgaacctgggtccctgaatgactttgtggagctgggctggtctaccagtctagaccaaactcttaagtaagagagaaatactcctttgttttagggttgccagatctaggaaattgaaatgtagcattcccaattaaattagaatttcagataaaaaatgaatgaattcaaatattgcatagggcatatttaagctaaaagttgttatttatctgaaattcaaatgtaattgagtatcctatattttatctggcgatccaattctttgttctttaggtcagtatattttggggtctctttgtcacagcagattaaccttcctcatcaatacaacatcaagacccagggctaagtactgggtctcacacagggtcctgagcatcttgcctgctttggtgtccccatagtgatcatgaggatcctacctgctctttcctcttgtcttctctggactctagttctcttaactggatttgtgcttttctctctgtaccattgtcttgctccagtaactgcctggaagctcagtctcc

SEQ ID NO: 471299 - DNA, 917 bp, Homo sapiens
taatgatcctcctggcagggggccgtgatgattaagtaacataatgcggatgaagttctcagagcggtgcctggcagcatctgatagaatatgtcatcgtttcttcctgcataagcgggaaagaataaacgccagggactgcctgagccccggttacccacagcggtcatctgcttgccagtccaccctctggcgattcctccctttcctgtctcacatccccactccctgccaggccctcaatggattggatgatgcctcccacgttggtgagggagaatcttctttactcagtctactgattcaaataataatctcttctggaaacaccctcacagaaggtcacaggaagctagaagcagcatctgagtcagtagtttacaccaacttgaggagagctcccaagggcatgaaagagaggacggtggaattcccagataagaagaagaaaggcagaacaaacctgcaggtccctactgtggtggtcactggtgtggatgccagatacatccaactctctgccttctgtgacatcagtcctgttggattaggtcccaccagtatgacctcacttgaccttaattacctctttaaagactctatatccaaatacagtcacattgtgaggcctccatctgagaagtcccagacacaaagccatgctccttccttgcctacacactgcctcacccccacagcagccctgcagctcctatggagagcgtcctccatgatctgcggcagtgcttgtcaaaatgcagatttccaggtcctactcataaattctgggggtgcagccctggaatcagaattttgatataagctctgaagatgattctatagctttgggagcccctggctacagtataaagctcaaaagtctggatggcacctgtgacctactcagttgggttctc

SEQ ID NO: 471300 - DNA, 827 bp, Homo sapiens
ggagtccagtgatcctcctttcgcgtggggaaggatgacgggtgagcctctctgggcaggagcactgggctcgcccctgggcagcttgtcttttacagaaaactctaagcagctccgctctccagtctccagcccatggaagccagcggccggaagcaggcacactgacggtaacaagcaacatctggcagggacagagaaggcagaaagctgtgaaagccagcacaggaactcatcacatgcgagtgccccacccattctgaacgcgtgccttggagacctacgagggctcccctgtatcccagtcctgggcagtggcacctgggcgatttctgaggaggaccctgagtcattacagaaaggtcccctggggctcctggcgctctccctctgcagcaggaagtacccagtagagtctatccttgctgtcttctctactcacgagcaaccctgaagattgagcatgcagtgatttgcccattagttggggcaagaatttggatgccaggatgcccttgagtatacctgtcaatgaccagacctgccctttagtgtggcattgttgatttctgttattcccatgaccgttgatcatggcatctaacatttttgagcatctgctgtgttccagatgaaagctcaactgaggtcaagatctccatggtttggggaattatattccagaataacctgggtctcctgtacagtatgggaagaatttggatgcataaaaggaaaaaccttcagttgtctggaaaattcaacctgtggaacatttatcccaaaagcaggggaattttaaagaccctattaactgcaggatagag

SEQ ID NO: 471301 - DNA, 599 bp, Homo sapiens
ggcctgtaccaatagcttggactatggcctgcaaaatgctcaaagccaccaggctgccaggtctcctactcccatggcagagcgataagtctgtagagtttaaaatcctgctcaagaaggctatttggaggggccatgggatgttccggagactgtgtgaagtccgtgggcagcaggaaaaaggggaaaatgcattgcccacctcaagatgtttgcaactgcagggccgcagtgggagttgccaaagaacacgaggccgacatgggccagaaaccagaaacagaagtgagcaaaccagggaggaaaaaggagggagagaaggacactgtctgctgtccccaaggggggtgatcttcctgcaggtggctgtggcaagagcaggggcagaaggctcatctgtgagtcaagacttaagtgtggattggactggagatttgattttctgagtggagaccatgtttgcaaacaaagctagcttcaggatgatgtaaatgtcttggaactagacagagctggtggttgtatatcactgggaatgtcctaactgtccctgcattgtacccttgcaatcgtcaatgtttaattttatgtcatgtaaa

SEQ ID NO: 471302 - DNA, 705 bp, Homo sapiens
gcagtgaagacctaaccctgagctctggatggagtgagagacaaaagcagtgactggggaactgggtaatgggcagagactggaatagtttggagggctcagaagaagataggaagatgagagaaagtgtggaacttcctacagactggttaaatggttgtgaccaaaatactgatagtgatatggacagtgaagtccaggctgaggagatctcagatggaaatgaggaacttattgggaattggagcaaagatcacttttgctatgccttagcaaagaacttggctgccttgtgctcctgccctagggatctgtggaactttgaacatgagagtgatgatttagggtatctggcagaagaaatttctaagcagcaaaatgttcaagatgtggcctggctgcttctaacaacctatcacatatacatgaacaaagaaatggcctatagttggaacttgtatttaaaagggaagcaaagcgtaaatgtttggaaccatttgcagcctgctcatgtggtagaaaagaaggcccatttttccagggaaaaattcaagcaggctgaagaagtgtgcataagtaaaaaggagccaagtgctaatagacaagacaatggggagaagcccttgaaggcatttcagagaccttcacagcagcccctcctattataggcccagagtcctagaagggaagaatggttttgtggga

SEQ ID NO: 471303 - DNA, 951 bp, Homo sapiens
gtcagccccagtggaggaggaggagcccctggcctttgaggcctgaccttcccggccctttgccattgatgttggcaaaggtggtatcagctaaggaggccgcccaccctggggggcggtatccagtgccctgccatgtgtgcccacaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgaggtgcgtccgcggctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggtagggagccttgctgtgaggcccctggatggggctgctggaaattcctgagaagcacattcagactgacctgtccttgggggcttggaggagcgggagccacagctgtctcagcagatgcttccccggcacctcagcctgcctgggcttcccagggcccccttcttgctcctcttcatctcccagtcagcaggggaggggaaggagtgtaattgattgatgt

SEQ ID NO: 471304 - DNA, 574 bp, Homo sapiens
tctggggtatttttttttataggcaccggatgggggaaggacaggctggcataggagttttccctggtcgtctgctccctgttcctggggtgattgggtcagcatccacctgcccaagagttgagagcctgataaaacaatgttggggtgtgggttctggactgatgggtctgtatttgaaaagaaagctagtgggtgaattatttactatctctaggaattggctctccttgggatcggcagtccttctaagggcagaaggcctcagatgtcctagcactatagtaaagaaaataaaagacatggctaatacagggaggaaggaaaagagagctagagaaattaagaatttgagcatgacaagtatgggtcctatatttgaggacactgaacttactaaatcagtctgtgttactctgggcagagtggaaaataaagcaggtttggaattaaaagatctgagataggttctcagttctacctcttcttagctgtttgaaatcagacaactaactcttctgaatataaattactttatctatgagctaatgacaataatatctacttttcagga

SEQ ID NO: 471305 - DNA, 881 bp, Homo sapiens
taacaagcatctcatgtgatgcatggaagatattttaattattaactttaaaacatctatggttaaaattcaactgatgaaaacatcagaaagtgagcacaagcaagaatacattttaaatatttataattatcctttagggattaagattccccaatgttttacaagcataattttggaaggaggcttccattcagcttcccatttatcacaaacctttattgaaatcctaagaatgcagagagatgcatgtggttgcattaagcagctcgaaaacctggcaggagatattgaaggaaagactgaaaaagacataaaaatagacccttggaagttgtatgcccttacaagtgagatcaggttgaaaaaactaatcaaaggcagaaatccagagaaacaatcaaacaaacaaacaaacaaactcataagcgtatttactgggcctgagaagttgggctgcgttttgaaggactctcaaggtctagtggaaaaaagtatccaaggcctatgtaaggtgggaattgaacaatgagatcacatggacacaggaaggggaatatcacactctggggactgtggtggggagaggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaattaaacaatgtttataaataattacagttttgatttccttaaatatatagattgattttcattttaaaaatgttttaataagtttctaactagttcttataatctaataaaataaatttagaattataaaaaaaaata

SEQ ID NO: 471306 - DNA, 738 bp, Homo sapiens
gttcatctgtaaggtgacttatgtaaactccatgagaactcacactatttgcacaacaaagcttactttcttgacacttccctgcaagtcaatagaaggaaaactaacaaacagaaagcatatccacaccaaaaccccatctgtacgtcaccatcatcaaagaccaaaggtagataaaaccacaaagatggggaaagaacacagcagaaaagctgaaaactgtaaaaatcagcgtgcctttcctcctccagaggaatgcagctcctcgccagcaagggaacaaagctggatggagaatgactttgatgagttgagagaagaaggcttcagacgatcaaacttttcccagctaaaggaggaagttcaaacccatgacaaacaagctaaaaatctggaaaaaagattagacgaatggctaactagaataaccagtgtagagaagtccttacatgacctaatggagctgaaaaccatggcacgagatctacgtgacaaatgcataagcttcaaatttcatatccagccaaaataagcttcataagtgaaggagaaataaaatcctttagagacaagcaaatgctgagagattttgtcaccaccaggcctgccccacaagagctcctgaaggaagcactaaacatggaaaggaacaactagtaccagccactgcaaaaacatgccaaattgtaaagaccattgatgctaggtagaaactgcatcaactaatgggcaaaataa

SEQ ID NO: 471307 - DNA, 4237 bp, Homo sapiens
ttccctcatcccaagttgggtccttggcagagcagaagcaggattcacgagtgaggtgcagcagggcctcacttgatggatgattcggctgctctagagcgcagctgcgtcttctatgaggctggctatgaacccgaggccagggaaaactttgccaaccgggacgctgtgctgagcaggatacctgaacacaagagtgaccgcctcatcagtctgcagagtgcatctgtggtctatgacttactcaccattgctcttggaagaagaggccagtatgagatgctgtcagaggtacagctgctgagtctggttgacatccaggtggtgggtggcagttgcacggtgaccccagggaagcgctgggctctgattaaggccagggatacagccaggagcaaggtgtggcccctgctcacaagctgcccccagcctggagctgccaggcaattggagcgagcattcaccaactgtgttgtctcagatcatccgactaaaacggtcgatgttgtaggagaaagatgaaagctcacagcatctcaaggctgcctggcccatggttggatagctcagttactgaagataggggttaggtccaccctttgctgagtgtgggccctctctccctccctctgtccgaggccacatcctactctgggtgtcccacttgtcttacttcctcatttactggggtttttctgaatccacttttttttcctcctcatctgcctttccattttctcaggactttaatttaaaagagtaactggattttttttttaattgaagtacaattcacgtaacaaacctaaccattttaaagtgtagaattcagtggcatttagtacgttcataccactgtgcaaccatcacctcaaattgcaaaaccttttcctcaccctataagaaaccctatacccattaagcagccactctccattcctcactcccaccaagttcctgtcaactattaatctgctttttttttctatggatactgatttggggtatttcatataaatataaatagccaatatttgggctttggtgtctggcttctttcacatagcataatgttttcaaggttatccacattataacatggatcaatatttctttttatggctgaatagtattccgttgtacagatctaccacaatttgtttttccattcattagctgatggaaatgtgggttgtttctaccttttggctactatgaacagtgttgttgtgaggataactggattttaaacttcctatattacctttctctgagctccataaatgttagtaattatcatttttatcatttgtcttagagatatgttatatttccctgtcttcatttcctccactgtcagcagggcgatctttctgagacacaggaatagacatgccatccttctgttcagaaatattcgacagacccgcgctccttcttttttctctttttgttttgttttcctttccgcccataatgaaattgacttcactgtttatcttttcgccatatgcaatagtcctgcatgctccttggagaatcaaacaatacatgcaaaatatggaaaaggaaagaaaagtgccttagaatccagctctcctgagatagttgactaattgacattttagaggcaatctttacatctgtctttatgaataaattgtgcattatgtaagttttgttgaatgggacagtatcttgcacattttattgtggatattccctatctctcttctctcctccactggcacctcacccatctctgcctcctcaaccccaaactcaggtcatcaacatagtgtgtcacaggctctagagtcagagagctttggtttgagctctgggtctgctatgtaccagtcgtgtgagcctaggcacatcattaacctcctatgcatcagtttcttttcctgttaaataggggtaataattgtgtgcatgtatatctcagacagttgggagatgcatattcattaatccatgtaaagtactcagaacagagcccagcacttagagctcgttaagaggcaactgtatgctgctgcagttactaccactgtatatacaggagttactaggcacaggggaagcaacaaaggatacaaaaagatcttttgccttcaagaaatttccattctagttagggagaccacatagaaacaaacaaaaagataatcaaattagagaatacataatagtgcaaagcatgttaattggcaggtgaatggaataggccaattgcagcagagtttataggttgggagtgccagtaagagattatgaacaatggatatatgaattggctcttcaaggcctgataggcattaagtggtctaggaggagagagaccctcttcatccttaagcttgcggagctgtgaaggcactggacccaagggaacaggaacccagggcttgctctcatggagaagtgggaggagaggagcttggaaagaaagtgtggggcctgattgtcagcaccacaacctgttggcagactttacatgtgccccttgaagatgcgatctagacatatcaccgtgtggctcgtgtgtgagtaagtcctctttgcctcagaaaccttgctagatcttcttttacatgggtggaagcttttgtggacagaagagttcataaaaccatcagtcaattgtgagagagagaagaggtcttaactccttctcaccctgtccttgtgctttccttccttctcttgtccccaaccagcattaacacttacacgtcagggcacagcatgtcttcctgcttcttggctcctctccttggctgacctgggcccacgggcaccacagagggtgggggcgcctctgctgccactgccagcacatgttcctctctctcctgtccttggcacccttgtgcagtgggtgtgttgtgcagcgttgtgcagacccagccttttaataactgtgctcacaggggtaagtgggagcagagcctctctttctcaaggaagctggcctttctcttatgcttattcaagatggaaggctgctctcccatctcaagaccggccgcctctgtgtgcaccacatcatcgtgcctttctttccttatggacttttcagccagatgctggccaaagagcattgtacaaaggagacacagaccaaaggtttatcacatcctcattctgacaggtttaaatagaagcacaatgtttaccatatctccagtgctgtgagtttttgtgtttttaaagactaattgtgagccctgctgaaaggtttgtgtaggaaggaacacttctttttttcctcttcattttaaacagcagcactagttggcatgacaacctgcgctattaaaagtaaagcagcaagcaccgcttcctctgtttttcagaatgaacccaagctgctaaggaggtttgtctcttgaatttgactattaatggctccatttcgacaggatattatggggtccttttagaaggttgtgtgtgtcccccctccataggcaaggcagctttaaagacaggaatggtatttttatctttcctgttgaactcatattcatgtgtttgtggtaaatctcaacaacaccatagttctgtgggtagaactgtctgactagtgattgtaccaaaaggacatttacacctccctaacctaaatgcttatttaatcagggagcacagtgaaaagcattgcacatctaacaacgtctgcttgccaggcccaccatttgtttaaagttcagcattgcgtgcagtcctgcttgtactgtagaaacccagccttgagctacgtgccaaggtttctagaaggtatcagtgggcatgacacaaatggatccgtagacttctgagaaatcaaggcagggtgtttggctaatgctaggtggttcataacaacttgctgaatgcaccagtgcttcaaagccagtgtgcaccctcatcctgccccctttcctttggttttagaggtccctagatgtgcaaggagtgtatcttccccaggcaggcccaaaggttaaaggtcattgagtggaaaatgggcagcagagtaagggatgggcctggcttggggcagagcacctggacagttcccagctctggtccagctttgtgagtcggctcaataggaaccatctttaccattttttcatgacaccctgccccaaagaatgtcagcctctgacatggcccctgggatctccattctcaccattatggaaatgttcttttgaattaagcattgctttcttaacgtggt

SEQ ID NO: 471308 - DNA, 1349 bp, Homo sapiens
gggtttcctggtgaccactgggctgtgggtcacacagatctggctggaatcccagttctgcctggccgtgtcacctctgatggggaagcactctgtctcctcatctctatggtcggggagtaacttcccttacgggcttttggggatattaacagaggtcaacctggacagggcatggggcccccggggtgcaccataaagtctttccttctttcttctatcctcaggcgaggggtgagtggctgctgggacgtgctgaggggtccctgaagcagggcaggaagggcagagctagctgcagctgaggcagagtccgagtcccgctctgcatggaggaggaggtgaggggcctggtcagcatgggcatggctgggggcctctgtgaccgccaccactcttgtctttgcctccttgaccccacagggtcatcctcgggccctgggtccagccaaggcctgaggagggtcatgcatccctgtcccacttggtcacagcacaggaggctcccatccgccactgcctgaggcggtgcctgtggcccaagggctcgggttgtgggcctgctgggctggagcctgcatcgggacctggccacctactctcctaggagccttagagcctcctgattacattggtcttacctggataatccaagacactctccccatctgaagatccctcatcaaatggcatctgcacagccccttttgccagacggtgcccccatgaatgcaaaatgcagtcagatcccgctatcggaaagaggtaacaaagcgcagtcaggtcacgccatcagaaacaggtaacaaagcgcagtcaggtcacgccattggaaacagaaacaaccatcagaaacaggtaacaaagcgcagtcaggtcacaccatcggaaacaggtaacaaaacacagtcgggtcacaccatcagaaacaaccatcagaaacagaaacaaccatcaaaacaggtaacaaagtgcagtcgggtcatgccatcagaaacgggtaacgaagcgcactcgggtcacaccgtcggaaacagagagaaggatgtggaaataggaaaaatagtaacattaccacagagaaacctggcaggacatcaccttcaccagtcaatgaaggtcagcattcccagtgatgagtcgtgtgaataccaggtacccccagatatgatgggacaaacccaaaccgatgaactttctacaaaatacctgaccaatacccctcaaaactaccaagagcatgaaaaagaaaagtctaagaaactgacgaaaaccagagaagcccatgaagacatagctaaatattaggtggtacggggtcctggatgaaaggcaccgtattagtacgt

SEQ ID NO: 471309 - DNA, 618 bp, Homo sapiens
tgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattgtgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaacatgcaacagaatggtacatctttgctagaaatcatgcagataagagacttcacacagttgcaccaaaatgccacccttgaactcaaaaaaaaatcgttggtggccacccataccatgaactctaagacaggtcaatgttatgccagaataattgagcttagttatataaaaaagtatagttacattgaaacccacgatgtgaagtgacacagagatcacaaagcattctt

SEQ ID NO: 471310 - DNA, 1147 bp, Homo sapiens
ccaccagcgtgctgccagggagccaacttctgcctggtcagctaactccaccgtcccagagcctggggaatagcgaggagcggctggagactggcgcatgagatcacctctcatggcgcgacgctgcctgatcaggtttaggagccataggaggtgcgtccagtgatgggaccctccctggtggctgtgaaacaaacttcctctggccctgcagacatcgtggttgtgcctgagtctgtaacctcctttggagagaatgtcaaaggcttatgtttgaggcccttagtgtgcaagaaggctcctgtgacaggcccagcccaaggcagccggcagccaggtctcctgcgccccaggaagcatggggacaacataggggacagtgctgtgtctggagatgggcctggagcaactgtgtgtcccatccctggcagctgcctctcagaaggaagccgagagccccacgtggccatccatcggccacatgacatcaagcacaggcctgaagtggtcgtgatggtgggtgagttttcccaggtctcatggaggcagctgggaattaaagacaaaaccgtgcctcagtttccccctcttggtggtggaggtggcagcaggagcccagagtgggcaacagtttctaggacagccagtattgaggactggtgtattcggtggcactggttaaggcagggtaaggaggacttcgctcaggaccgtcatgatagcaagtcctgctggacagttccggagcctgagacttacagaggtgcagtggcctacacagggatgcgcagtcagcaggtggacagtcgggagcagccgccaaggcccctggggctgcagggccgggaagtggaactgagtggggactcttgatagccagaggaagctccgggctgtgcatgctgctgggtgactcagcaaatggcttttctgctgcagccccggactgaatgccgaagcaagaggggactgtgagggacccaaagggacagccaggtgtctgtggccgaagcttccactgcccttccggacgtggttgttctccctcttccggccggaacctgcctcctctctcctccccagtcccccagtcctgctgtctcctctgcttccggctgcagcttaggttccaaccacaccctcactc

SEQ ID NO: 471311 - DNA, 638 bp, Homo sapiens
cactagcaaactcagaccgtgccctgtatgagaagtttgggccaactacaaagcttacaggatgccgccccctggactgcccttactttagacaccaaatgcaagttggaggggttctcagcaatcattctccaatttgataattcactagaaaaactcacagaaagctgttatagagggattccagaagaaggcattattaccataggagatgacagctccatatctgttgctgcccctgaagagttttcagtgggagaaaaagtagaggtggaagaagacactgccttccaaagcttcaaggcacaagcaagagaccctcaagttaggaaaagaggctccagcagtgatacacatgagaatattaggacttcagcactgtctcctttacctctcaccatttgacaaatatcattccatgtattaccttctctttctgcatgggcatctgtcctgggccagaaatggttcaggctttcctctttgagcattaatcttctcctgttttaaattagtcattttatctctacctattagatatctgatgtttttcagcatagccttttgaattttacctagttttaaaaaaatgcttcattttttaattgtaataaaatacacatgaaatttactatcct

SEQ ID NO: 471312 - DNA, 662 bp, Homo sapiens
gtgttttttccaagccttctgtgtttcagttgcacagactgctctgacactgcaaccagcagggggaggcttggaacataatataaacagcggctgatatgaagtatgatttaggatcaaacatttgggatacatttacagtagggatatgtgcaagaaaagaggcgctccttcacacccagccaggaagcgtatcagtttatcccgtggaacttagcacaaacttctctcctagctctgtagactcggcgccccctagggtgtgcaatgggaacacagaagaggggtacaagccaagggatgctgaggatattcgagaaaatacttgtaagcacccaattagtcgaaagccacactgtgtttccagctcccagaatactaacacaaaattatcatttcgaaatggtcagggaattcttttacggcctgcttcaggggagaagggcaaggagaagaataacatttcctggctggatctggccaaatggccaaataggaatagctccagtctgcagctcccagcgagaccaatgcagaaggcgggtgatttctgcatttctaactgaggtaccctgttcatctcattgggactggttaggcagtgggtgcagcccacggagggtgagcagaagcagggtggggcgtcgcatcactcaggaagc

SEQ ID NO: 471313 - DNA, 898 bp, Homo sapiens
cttttggaatttttttctcaccatatggatgcagagatagggtttacaacatggggtcccactgtatgtatgcaccttcaacctggggtgcctcccttcagaatcagccaagttgctgttacagacacagaattccagcccctgccccagagagtcccacttggcaagttggatgcagcaagaccccagcgccccctccccggcaggagtgtcctgattgtgaataggagggctggggagaggtctgggactcgccaggagctgagggtcccagcctttgtggacagccctttcctgccgctctggctcaggcccacccttcgaccccttaagggcaggggctggtgcctgtctagccctggggtgcttcgacattctgtgttggacactggcagtgtgtcctgccaatttagtgacatacccacgaaactgtatttacgacatggtgcatcaggacgagagctgacagacaccattttggagaatgaggggaaggggccaaaagcagaaagcatcaccctggcctcgccctgttcagaaaggagatgcaatgatcatttcatactcgtttcctcctttggtccccacaacgaccctgagagagtgggggctcctcagtgcccctgaggagacttgccccacactccttacactgcagttgtgacccactagggtcgtcatcatgaaatcaattcagaggtcaccacctaaacagaataaaatgaaaaacgccagtgtgcatcgcacatggtaggggcctcagtttgccccgctgtaaaatgggacatgggaggctggactacaatggttccttttagtgtggacattctggattctgaacctagagaaaaaggacagcttcttttactcaaagtcacggttgtgacatttggctgtt

SEQ ID NO: 471314 - DNA, 629 bp, Homo sapiens
gcttaggagcagcagcagaggggcactttgctagtatttggaggaacttagcagatggtaaacaactggccttgtgtgctcattcaatcagtcattggctttgggctgtctccctctcctttccccttctcctcctgggtgaggtggctcctgatcataggcaattatctggagaagtgggcaatttccaattctccaagcagctggaatgggtatatcagcccagatgatctggagtctgggaagtccaagatcaagaatccagaagatgctgtgtctggtggtgagagagcccatgaggctgactggtcccttgtctttggggcaggcccaaccatcaccactccagacaggcaagaatcacatcgctcaaacagggccccaccttccaacactgttgtgttgaaggttaaacttccaacacatgaacttttgcgggacacattcaagccacaccagcccctgtgagcccagttctcagcagcggcagtagagctagagctcattgccctctcttccatcctagttcagtcacatgactggcatcagcaaatgggacatatagaggcctgaaaaagcatgtatgtgttttcattttctgtattgattctctcctttccctaccccct

SEQ ID NO: 471315 - DNA, 1043 bp, Homo sapiens
gttagttggagattggtgtataatatggtacacaggattgattcggacacattcatatgtcataccattacacaaagttttgccgtgggctccatttcccctcgagactttatcgacttagtgtacatcaagcgctacgaaggaaatatgaacattatcagttgtaagttgaaacattttgcccatatcttggaattactgcgagccattaataaatgttttccctttattcacagcttcaaagaaattatattttaattatttcctttttaaatttacttagtgggatcaacaattagacgtatcatgtagatatgcctagtgacactctgaaggtgccatttatataatggtcaatatttgcaacatctcttagacttttgcagcatatatcctgtagcactgagtatagatagatacttgtagcctaaaactttgggtatacattttttaaatcctaagaaacaaaattaattgtcagatataattttatatttgaattgcttataatgcacatatccagtaactgataaaactgttaaagaaatttccactagatggctctttacataaatgtgcttttatttcttttagaaactgccggttttgatgtatccctatccccactcccaaatatgtcattctgtaaaatgcaaatgtctaaaagtgtggattttccagaatatcctccatcttcaaattatatccgcggttataaccatccttgtggctttgtatgttcaccaatggaagaaaacccagcatattccaaactagtgatgtttgtccagacagaaatgagaggaaaattgtccccatcaataattgaaaaaaccatgccttccaacttagtaaacttcatcctcaatgcaaaagatggaataaaggcacacagaactccatcaagacgtggatttcatcataatagtcattcatgataccaaaagaagaaatgaggccgttctgctataaaatcatgtgtagtatgttattgctgtttacttctaagtcaacgcacataaataatactgttaaactattct

SEQ ID NO: 471316 - DNA, 762 bp, Homo sapiens
gccccgaaatgaacaaggacagcttggaggttagaagcaagatggagttggttaagtcagatctctttcactgtctcagttataattttgaaatagcggtttcagaaagaacaagatcaaggcactggcactggcaaatttgggaacaagaagaaggaggagaaggagaaggaggagaaagagaaggagaaggagaagaagaaggaggagaagaaggaggaggaggaggaggaggagaagaagaagaagaagaagaagaagaagaagaagaagaagaagaagaagaagaagaagaagaagaagaaaggagaagaagaagaaaggagaaggagaagatgcaaaaattctcaacaaaatttagcaacacaaatgaaatcagtaaggcaaagagatatgtgtactcccatgctcatcacagcactattcataatagacaaggaatggaattaacctaaatcatacagaaaaagctttcagtttttccccattaagtatcatacttgctgtgggtctgtggtaaatggtttttcttatgttgaggagtaattcctggtggcttatttagttcatttggtgatgtaatgtattcctggatggtgcttattttagtagatggtcgttggtgtctgggcattgaaaaattaagtatttattgtagtgttcactgtgtgggcttatttttagccatccttcttggaaaggctttccagttatttgaaaggaattgagtgttgtgatctaagctgtttccactttagggga

SEQ ID NO: 471317 - DNA, 741 bp, Homo sapiens
gctgaagtatctgggagagttggtgcatgaccatgggggccaccctactggagctctccactcatcaggcatggtacaacagtgcagaagctatgatgtgggccacagggcacctgaggctgtcctacaagcaggcatggccagactgcggccctgggagaggccagcagaccaagaggtgctcagaagaaaacctagggaaaactcttctggacattggcctaggcaacacattcacgactaagacgtcaaaagcacaagcaacaaaaacaaaaagagacaaatggcatttaattaaacttaaaagcttctgcactgcaaaagaaataatcaacagtgaacaatctgcagaatgggagaaaatattttcaaactatgcatccaacaagggactaatatccagaaactacaaagaactcaaacaacttaacaacaacgacaaatcctcatcccttaaaaactctctcttgactctaattcctccatcatctaccattccatttctcaacttccttttgtctcaaagtctcccagaggatttcctatacaggcttcctctgaaacttttcccagtcactcttaaattcattctaattaggtctttacttacccaccatcactactctgacaccataactttcaaagtaatctatgatgtctgcattactaaatcctatcatttctgtttttatcttactggaccaatcagttgcatctgacacagttgacattttctcccaa

SEQ ID NO: 471318 - DNA, 1781 bp, Homo sapiens
ggtccttaaggaacttggtgagtgtgtttttcttttatagaggaagaggaagccaaattggaggggtctagaagacagctgttcatactgacatgtagacagcatttgtccccaggactctgcaggacatccctgcctgctgggtatctgtaacaatgcagcctttcaacaggaaagtcagacttcgaaagcgaagtttgcaacgcattttcatctttgcctcaggatctgtctatggagatattggactaagaaaggaccctttgcatggagcaattagtgagatgtgggagatatgtttgaatcctacagacgtcctccaagtgtgtcctgagacaatgcattaccaattccagaatggactcaacaatgtcttgtttttcggccttcgaggtcccattaaggagcatctgcctacctcaacgactcacagtgctcatttggtcaatgattttctctgtggaggttttccaaaaaatctggctggaacgggacagaaaactgataaatcttttcagaggtgcccatctgaattaccaccggtcccttatctcttggggcataatcagtgcaacttatgagttcctgttaaagttatatggcaaaaaacatcagttaagtgccatttattaactgaatagaccttctaagaagaatgcagtctggcctctttcttaattggccaaatataagttggtgtcatgactccaggccacagtgagttatgggcaaagctgttttcctcaagcatcaacaaaacagaataaaagtttccaataggaaaaataaataaataaataaatggaattatacagtgttttgtctttatcttcttttctttcactttacataatgctattgagattcaaccattctgatgtgagagtcagtagtccattcttttttatagctgagaagctttccattgtataagtatacctctatttatttatcagtttagatgacccacagtttttggctcttatgcataaacctgttctgaatttcaagtgcaaatctttgtgtgaagctggatttctgaattgcattgtaagtatatatgaactctttaagaagctgcagaagtattttccaaagtgatattcccatcaacaatataaaattccaagatttccagtagcttcacatcctcacttacatttggatcccacaggacaccacattatatttaatcatcatatctatttagattttcttggctatgaaagtttctcggactttccttgtttttgatgacccggacacccagacagttttgaggagtactgatcaggaattttgtaggatgtttttctactggaatttgtcttttgtttttttctcatgatcagattggggttatgggtcttaggaggaagaagacagaggctggccttgcatcccttggagaaactccacttagtaataatatttatgcgctttatgctttattggattcaatttgctgaaattttgttaaggagttttatattaatgtttttgagaaatattagtgggtagtgttctttatggtaatgtattgttatgtttgtggtatcaagtcttcatagagcttgttcaagttcattgatcttttcaagaaccagcttttggtctcattgattttctttattgttttactgtgttctctttcacctacttctcctctctattattttcatttttctgcttgctttgggtttaatttgctgttttttttctagtttccttaggtagaagcttagattgattcaataactttcttcttttttgacaaaagc

SEQ ID NO: 471319 - DNA, 846 bp, Homo sapiens
ccgccccctgcagcaccacctctctgttgctggggacagcgtccaccatctcttgccttcagacttttccaggttccccaagccggaaatcctggaaccgttcattcttgcctcttttgtcccttgaaccacagctgcttcatctgtaaggcacagtgctgggactacgcagagtgcaatggtttacacagataattcaggaatcaagagtccttcaaacagaaatgataaaataaaagatttaaaaaactgcagctcagagatgttgggtgtaactgatagtaagtggcagggtggagatttgagcttgggccattcaaggcctgttctgggtccactttattgcctctattatgagaatatcccccaaataatccagcctgggaagccagagtaccagagcttcctggtgttctatcctgggatgcaaaccatgaaaccatggctgatatctgaaaggaggagaaagagggaagatgtagacagtggttcgtgcctcggtccttgtaacgaagccctccagccgccactgctacctaaagtcatcccacagtttacagttccaatagaactgcagcgagctcaggacatcgggaactaccagagcaagttctgcaaaactgtcaccttttaaagggttaaagtcctggactagctacctctggagctcttctgtgtgagaaaacaaacacttgtgtttttaagccatgattgtattgagttttcttttatatgcagttgaattttatatgaactgatataaaactgaacagagtcaatggcaaagaaaagagaggccagaaggatggttttggctgtaacagaaaatacaatggaaatctgttt

SEQ ID NO: 471320 - DNA, 1028 bp, Homo sapiens
cctttgggggcaggaacgtgcatcagctgaatatttcctcggttcagaaagcactggggagaagataacttcacctcgcactttggaatgttgcattgttttaaattgctggatcgtttggagccctgttttgtgccaagtggagctcctcagcgcctcactaacctggccctgaggggtggagccacgactgggacgcagacagcctggcccgctagtccaacagaccccaaagcccccgacaaagtagttcctgtggtttacttgggagaccttgggagggatgccgttcatagcagagggctccagaattgagcgttgtgattttgcatgcgctctccatgacagccctgtgaagcacacggaagagactgcaggcgggcagcgtttagcagaagtggcggctggccctggaatccagggctgcatgtgccacccttgggctccttgcatgggaagttgccgattccgaggaaagctacagtttccctcctgtgccccgaagggaatgttgcatctgctgcaatttgcctttgacaggaaaacactccctccttcagcaccccacacccacaccctctcccttgtcttccaacggtgcctggacaaggaagcctgggctctgcagctgggacttgtgctgctctcggtgtccttggcttctaagccacagtgactgtcaccctggtcattgatcactgctgccatctgctgccaccaccctcttaggtcagctggcccagtgtctccctgctggcctggccccacctccctctccaaagagcagaagccaactgtgactccatgcgctccccagccggggcagttgctctgctgtgtcggcctacggggcccaggtttttccctcatagcaaccactgtccccctcagctcatcctcccgcatgtgaatggccttctggaccctccatgtggcccacgccaggattagggacccgccgggcatcccaggagctgagggagaagtgggcagctgaagatgtgtccttccatgcccagcgatgctac

SEQ ID NO: 471321 - DNA, 510 bp, Homo sapiens
tttctgcatctgtcccatgaacatgaggagacctagcttccaaattgtgctgttaatgatgggaggtgcctttatgacatccagccattaccccagtggcactagcaggccactgcgcatgcggacagcccgccgcaaggcaacaaccagaggagaagggatgcaagactgcaagactccagaaggtcaaattctttcttccgaggaggcaagaactgaggttgctgcagaccaatatggattcaccaccactaacagtaaacaccagtcatactggagtaagggcccactctatgttggtattaatccacccaacttaactaattatgtctgcaatgacccaatttcaaataagaggattgatacaaggattgggtaagaaatggctggacagctcttggttcagagcctgtcacactgaaagtgctcgtcacatagaagctgtcataatcactgtcaccatcatctccactttgtagttgaggaaaccagatccagagagggaaagtt

SEQ ID NO: 471322 - DNA, 619 bp, Homo sapiens
caggtctaccttccagttcactaatttctcttcagctaagtcttgatcaccctgcagcatcaatgggcatgctgtgaatgctggaggactgaccagcatgccccgattgttctctattacttggagtattagatctatttgtcatggggtactgctaaaaccaggcttatgtcctgtcaagagtagcaaccccagaggaaagagccgctcactcctgcttcagtatagagaattcccagggccaattctcattggcccagcttgggtgacatttccctactttgacctgtcatcaggtgtgaggctggtgttaggattttgcagggcggttagtcgggtgttcaggaatatgattggaatccccaccacaaacccagaatcaacaggagctggggcaaatcaacaggagctggggcaaatcagcaggaactggggcaaggcagtcttccaaaggaagggactattgatgatgcagacaccaactgtctaccatgatggtttgttctgaagagtaacatatgatttgtgcagcagaattcctcataataatgaagaaaacaatgagagatcatgaatgtttgaccccatatatacacacacgtctgcacaactacctact

SEQ ID NO: 471323 - DNA, 1332 bp, Homo sapiens
gcaggtggctgccttctccctgtgtcttcacttggcctgattgccaaacccagcgccttctgagatactgggggttacaatttcagcatacgaaatttgagggcagggacctcctagtcacaagttggttctcaccctgacgcacactccctgcctgcaacagcctggcttttagcagctgagaggacacggtccctgcctgggaggtggcagaggagagtgactagaagggaaggtacaatgggggccaggcagtcaagggccagctccaaggataagggccccaagaggatgctgttcacggggaggagacagaagttttctccgtgggacgatgccctgctctcgggaagggacccgcggtccctgctgaagcggggcatgcaccacgtcagcttcagcctggtcacgagaggaatgacagacatccccgactttctgtggggcttgtccgaggtccagaaactcaatctgtctcacaaccagctccgggttctccctcccgaggtggggaaactgacccggatcgtggtcctgaacttgtgcgggaaccgcctgaagagcctgcccagagaagtgagcctcctacagtgcctcaaggtcctgtttgtcaacatgaactgcctgacagaggtgccggccgagctgagcttgtgccgaaagctggaggtcctgagcttgtcgcacaactgcctgtcccagctccctgcatgcttcgccgacctctctagactgaggaagctaaacctcagcaacaacttcttcgcgcacatccccatgtgtgtgttctccctgaaggaactgattttcttgcacgtgggctcgaatcgcctggaaaacatcgctgagagcatccagcacctggccagcctgcagatcttcatcgcagagggcaacaacatccactccttcccgaggtcgctttgcctggtcaccagcctggagctgctgaacctcaacaacaatgacatccagaccctcccgagcgaactccacctgctgtgtagactggtgaggatcgcctggaatcccatggacaaagggctccacatttcccacaaccctttatccaagcctctgccggagctggtggaggggggcctggagatgctcttcggctacctgaaggacaaaaaacacacctgacctgggtcccggaggcctggatgggaggcagctcatctggactctgtcaaccggggtacttctctcgtctcagctttctactctcatccttagtgtctgacaatacctttgttaatatttgctaagtcgctgttgaacatccacgttaaggaggtgattgtttttaactctgtatgttcttaataa

SEQ ID NO: 471324 - DNA, 613 bp, Homo sapiens
tatataataaatattcagatcaatatgttcaatggaatcaatttcagtttaacaggaactggacacattataggcaataggacaatgcctcagcattcatggagcttggaggtttatcagggagacgaacacacagatggttacggcagtgtgctgagggctgtttgggagcacagacgaaggcgctgtaggttgtccatccctgtccttcagcagattgatgggtggtgtcattttcctgcagaacaaatgggatttgatgggacagaggaagcactgaaagttgtccccagagagtctgaccatagggctatagtgttgaaagcagggactatgaacaaagacctggatccagtcgtagctctgatctgtatccatggccagccagaaagtgcccacagcggggctctgattgggtttgctgtggccccaatcccatccctgaatcaagcactggacagggctgtggcataatttaatgggcccaaattctcccatggaaggatgtgggggaggtgtggctgctccggttctatcccaatctggggagtgttaaatgtcctcttttaaaaatgcaaatcagattgaatcattccctggcatggcatcccct

SEQ ID NO: 471325 - DNA, 766 bp, Homo sapiens
tctgtaaaccctatggtcccttgccacatgctgccatgctgcagaacatcaacccactcccagaacccctgataccaggagaaacccgtggtatcacctgcattggcagcaatgggagtttatatactttacagacactattgttactacctgcttatggagctcagtggaaactccatgcttttaatattttgaccaggatgtccctgataaaggactgggccaatgggtcaacacagtcagccaaacttcaggcagtcatctcagcactggattcttcagaattcttacctaactgggaggatgtcaaagcttcgaaaagtgctcctaaatatgcagaaggtgagaagaattctctgatgtgctacttttcacagatgttaaagaaccaggtgaaatatgttggtatcaaagtaggagaaggatgtattaatttttcaggctctttctcacatcatcatttataaaagttttatgttttaaatataggcaaggtttgctaaattaagctttttttcagtggtctgtttaatttcttaagtttgtcataaatcatgtaaatttagatatgcttcttctccagtacatctgctatatttaaactgactcttaaaaaataatgacgagttaatgggtgcagcacaccagcatggcacatgtatacatatgtaactaacctacacattgtgcacatgtaccctaaaacttcaagtataataataataataaaataaaatttaaaaaaagcggaaaaaaaatacttttt

SEQ ID NO: 471326 - DNA, 985 bp, Homo sapiens
ctatatagttcactgtctaaactaggacacttgtaagtgtaaaagtaggtgttcaacttcccagtttattgcatctcatcttcaaatgcacccttcattgcctgctctgctacaatacagatgagccctgctttgtcagcgtgtggtttctctggcacttgcttctgaacgtacatgagggctggcaatgcccagaagccagcagcttctcccaggacccccttgagcagctttgccactgagagcaccaaggagacacctttctgtgaatggcttttcctggatgcccacttgtggctttacagcaaagttctgaggctcagtacctccttgtggacagcttcctccacctgcacagcactacaacaaaggatttctgtgccatctgcgggagagcagggcacagacgtgtccaccagcaaacagcattgtcttacagtgcaccagacacagctgcacctcccaggtcccctcaggaaagagcttgcagagagccatcttaccagggtctcacccttcctgggcaacttgcagtcagttacccagcaaggagagggtataaaggcccagccatttggccattttggccccacccaggataacactgagggtgatttgtgctccagaccccccctgctggcttggtgcccatctgcaaagcccatcctgtcctccaaactccaaagtagcttctactttcagagaacccgaccgccatctagcagaggggcaagcaaggacaacgaggtgtctgagtggaggcaggcactcagggagccgctcggagcccgttctagtgacttggttatttctgccagtactgctattgcctgggagtgcctgcagacctgagtttggtttcctccacaggaaacaagagcttgtgcacgggtagtttatttgttagggttgtcttgtttggctgagtgagctctgggggcgttgaagaaagacctggggctaaaaggagtaaaagatgcagagg

SEQ ID NO: 471327 - DNA, 493 bp, Homo sapiens
tacaagtgacctgtcacccagccatgaactcccacatcctcatgaaaatcacagagccttttccagtgacggcatcgcttgctgccattctcagcctgcagaggacagacaccagaatttctcaaagaaaatctcacaatgtattgctgaattacttagtcgaggacatgtcctcttgccagactgctcagccacatagttttcctgaatgggagagagaggcctcagactctgtgtttatgaagaacacctgccagactagatggtattgtgctgggagtcccttgacagtgtcctctgcctgctatgctatgcccttgatgggagtgtgggggacttggggtctcagccctggtggagaagtggtgctttccctggcagatggctgccacatactactcattggcttctcttgccagttcttccagactcacctggtggtgatggcaagattcctattcaatcaggaaaagaatgagcctgcctaggcagc

SEQ ID NO: 471328 - DNA, 471 bp, Homo sapiens
tctctctggctcatctgctgcatgtatggaaatgcgtgcgcatggaaacagaacatatattatccaagcagattgtgctaaaactaagtgatattcggggacctgtgctcaggcaggaagggagtagaacgcccttcatggggttgaggcagttaccacctcgccccttgagtgagagaagaccagcagagaagaccaccaagatacgagtgggtgaaggagcacttgagggtgccctcctgggaagaaagttcaaaggaagcatgtgttctaaccatttacctgtaactccactcacaaccttggaaagagtgacaaatccttccttctccctttggcagcaggatgcttgcttgcacaagtccttagcgggggtagaaatcacgggacaggcgcagtcctatctagaaatcaggaaactgagctctcatcctgctctgctactgttttaagttaatgtttaaaattagc

SEQ ID NO: 471329 - DNA, 623 bp, Homo sapiens
aagcatctggaagctatattgcaacatgattggtgtccactctaagatgaaaattaaaaaaatattctcatctcatgaagaacaagaagggaggaagaggaggaggagaataggaggaggaagaagaggagaaaggaggaggagaaggaagaggaggaggaagaggagaaaggaggaagaggaggaggaggagaaagaagaggaggaagaggaagaggagaaggaggaagaggaggaggaggagaaagaagaggaggaagaggagaagaaggaagagagggaggaggaagaggaagaagaacaggaggaagaggaagaggagaagaaggaagaggagaaggaggaagggggaggaggaagaggaggagagggaggaagaggaggaagagggggaggaagaggaggagaaggggatgatggtggtataagtcagatttcctaaatctcctccatgcttctacatgttcttataatccttatgttcctcaagtgaaaggttaaaatatgacaatgatattattaatagtaagaatattcaaaaacacacattcaaaaacgcagtattttcccctgggaaattttttgccttgttttcgtatttaaaatattaatcaagagacgtc

SEQ ID NO: 471330 - DNA, 579 bp, Homo sapiens
aaaggaaggcataactggaaatagatgcagaaggctgtgtatgctgtgtatcagtgtcccatatgtggtactgtttctcccatagccaggattcatgggtccgggaatcaaggggtggaagtggaagtggcaccacttaccatcacccctagtgacccactagcaaaatttttgcttcccgttcctgtgacattacattctgctggcctagaggtcttagtttcagagggagggatgctgccaccaggagacataacaatgattccattaaactggcagaccaagcctcatcagcaagcagctagggggaagatgagacaagctgatgtcctctttctgggaagaaaatccacctacggggagctggagggaaagagaaccctgtgttcttggctgcagcgatgtggagtggagtttccacattactgagcagggaggagggaagagagaacggccttggcgcacataccacagactcacctttcttaccaaattttcatagatttctcttaaatagatgtttctctacttgctctttttcttcagaactttttcagagactttaaatggttgtctttt

SEQ ID NO: 471331 - DNA, 618 bp, Homo sapiens
tctctctctctttaaaagttttctcatggtgaacccttgatggatttgttagttgcttgagaaatggctatgatgatcttttggtgtaattggcctgaagcgaaaaccgcagcctatgatggtgaacaggccacgtgtgagcctgtgctcaaagccatgtttttggctgacacccacttgcttagggaattcctaggtcactggctggacaaattacgaagggaatggcaggtggagagagccttccagacagctctgtggttgctgcagccggaagtcgtcttcatcctggaggatgtctttgatgaagggaagtggagcacctctgaggcctgggtggatgatgtggagcagtttcggaaaatgttcagacacccaagtcatgtgcagctgaaggtagttgctggaaaccatgacactggcttccactatgagacgaacacatacgaagtagaacggtttgagaaagtgttcatctctgaaagcctgttttcttggaaaggattaacttcatgatggtcaacagcatggcactgaagggggacagctgtggcatctgttctgaagcagaagcagagctcactgaagtttcttacagactgaactgctcccaagagc

SEQ ID NO: 471332 - DNA, 2016 bp, Homo sapiens
tccctgcaaaggacataaactcatccttttttatggctgcatagtattctatggtgtatatgtgccacattttctttatccagtctatcattgatgggcatttgggttggttccaagtctttgctattgtgaacagtgctgcaataaacatatgtgttcatgtgtctttacagtagaatgatttataatcctttgggtatatacccactaatgggattgctgggtcaaatggtatttctagttctagatccttgaagaatggccacactgtcttccacaatggttgaactcatttacactcccaccaacagtgtaaaagcgttgctatttctccacatcctacccagcatctgtcgtttcctgattttttaatgattgccattctaactggtgtgagatggtatctcatcgtggttttgatttgtatttctctaatgaccagtgatgatgagctttttttcatatgtttcttggctgcataaatttcttttgagaagtgtctgttcatatccttcacccactttttgatgggattgtttgtttgttcttcttgtaaatttgtttaagttctttgtagtttctgaatattaccctttgtcagatggatagattgcaaaaatgttctcccattctgtaggttgcctgttcactctgatcatagtttcttttgctatgcagaagctttttagtttaattagatcacatttgtcaattttggcttttgttgccattgcttttggtgttttagtcatgaagtctttgcccatgcctatgtcctgaatggtattgcctaggttttcttctagagtttttatggttttaggtcttacatttaagtctttaatccatcttgagttaatttttgtataaggtgtaaggatggggtccagtttcagttttctgcatatggctagccagttttcccaacatcatttattaaataaggaatcctttccccattgcttgtttttgtcaggtttgtcaaagatcagatggttgcagatgtgtggcgttatttctgaggcctctgttctgttccattggtctatatctctgttttggtagcagtgccatgctgttttggttactgtagccttgcagtatagtttgaagtcaggtagcgtgatgcctccagctttgttctttttgcttagggttgtcttggctatatgagcgctttttggttccatatgaaatttaaagtaatttgttctaattctgtgaagaaagtcaatggtagcttgatggggatagcattgaatctataaattactttgggcagtatggccattttcatcatattgattcttcctatctatgagcatggaatgttttttcatttttttgtgtcctctcttatttccttgagcagtggtttgcagttctccttgaagaggtccttcgtgtcccttgtaagttgtattcgtaggtattttatcctcttcatagcaattgtgaatgggaattcactcatgatttggctctctgtttatctattattggtgtataggaatgcttgtgatttttgcacattgattttgtatcctgagactttgctgaagttgcttatcagcttaaggagatttaggctgaggtgatgggaggagcttgttattacccaccttctgaagactacttctgtcaattcatcaaactcattctccgtccagttttgttcccttgctggcaaggagttgtgatcctttggaggagaagaggcattctggtttttggaattttcagcgtttttgcactagtttttcctcatcttcgtggatgtatctatctttggtctttgatgttggtgacctttggatggggtttctgtgtggacgtcctttttgttgatgttgatgctattcctttctgtttcatgttgtcacatacagattttaagaacacttttggtagatgtgatccaagagtaactcagaagagcatctgtggcatccattcttccctttggtaatttttaagaaaaataatgctgctgcttctctctttgtaaatggtgac

SEQ ID NO: 471333 - DNA, 2467 bp, Homo sapiens
gtccaggctggagtgctggagtgtagtgataatcatccttaacatgttggtgaccctctccccccgtcgggttatagacagatttatacgatataaatggaggtggttctccagagttgggaaggggagaggggattcgaaggacagcatcagtgtcttgcagagttggcactctagtgatctacgtggcaagcccatcctcaaaagactcttgtggaagttctggagccagctccagctattctggcaagttggcctttggaagaccaattccaacgatccagagaagagcgtgaaaaacattgatccctcgagggcctggaccagcagaaatgagatttccagggccctggtctctgaaatgctgttaggatgccgtgcccagcaatttgaagatacggagacacagacacagacaaggagagggacacaaaacgaccgaggcggaaactggagtgatgcagccacgaaccaaggaatgccaaggattgataacaaccaccagaagtaacgaacgagatttcccattactccacgtcttcgccagcatttggtgttgtcagtgttctggatttcagtcgtgctaggtacatagtgatatctcattgttgttttaatttgcattttcctgctgtggagcaactttttatatgcttatttgccatctgtatattttctttggcaaggtgtctgttaaagtcttggcccattttttaattgggttgtttgttttcttattgttgagttttaagagttctttgcaaattttggctagcagtccattattggatatgtcttttgcaaatattttctcacagtctgtgacttgtctttttattctcttgacagtgtcttttgcagagcagaaagttttaattttaataaagtccagctcatcaattatttctttcatggattgtaactttggttttttctttatctttaattttctgtagttggaaaattatgtacctaggtttagagttttgttttgtttgggcgtttatcctgcattgtgttctctcagcttcctgaatctgtggtaaccattttgtatatactttaaaaatattcacctgggacaatgtggttattaaatagtaagtagctccttgtcttaaactaccttttctcaatgtactgaggttgaccattttttcaaatgtttattggtcattgtatggtctttcccagaagaccatacaatgttgtcctttaaaagattgaattgtctgtcttttctttattgatttgtagacttcagatattccagatactaatcctttgttaagtagatgaagcagatctcttctctctgtttgtgacatatcttttagtttctttatagtattatatattttgatagaaaaagcttataattttaatgtaatcaaatttatcactctattcatttatggcttcctcttttgccttgtttaggaaatctttctgtatatgctgaggtcatatgaatattcttctataatacaattttttctgtaatatgatttttaaaccattttaatgccgtggaccctttgtcatgttggtaaaggtaaaaaatgaaactcatagaattacaaagaaaaccaattatgctgaaatatagttattaaaatatttaaagtgatgatatataacacatgtgctccttcttaatgcattaaatatcaagatttagcagaatatctaataactgctgtaaatttccaagtactgagtgcataaataatattatgagatacctgcaataactataatacgacataaacctatctgtatttttattagtggcaaagtcacagatactgcaaggctactatggtctgttgtccatgatcataattgaatctttaatttttcagtttgggatttgtgaaaataaacattaatttttttcctatccatgatcatgaatgtactgaattatgctcaacaaaccagtggatgtctgtggaacccaggttaaaatcctttatataatatattctaaatttttaaactgttcatctttctctttttttattttatcaataagaatttgtttctttatagtgtatatatttatttttccccctctttttgactaatttatcctttcccctttggatctgcaatattagtgctggcttacatcacacttctatatgtgtttctgggctctttattccattctgatttagattttgatctatgtaaataccacattgtcttaattactattgactgtgaagtaagtctgacatctaatagacaagactccctactttctttgttggctcttcttcgtcctttgcttttttatgctaattttttaaaaagcttgtcaaattccatgaagaaaagcctatttgaatgttgattgaactgaactgaatttataaaccatttatttataccttttgatgaaattttatgtatttttttccatgaaagacttgtacctctttccccccaccaccacccc

SEQ ID NO: 471334 - DNA, 704 bp, Homo sapiens
cctccagcaagctccagcagatatgcagcagaggggcctgtcaccaacatcaaagaccaaaagtagataaatccacgaagatgaggaaaaaccagtgcaaaaaggctgaaaactccaaaaacctgaacgcctcttctcctccaaaggatcacaactccttgccagcaagggaacaaaactggacgaagaatgagtttgacgaattgacagaagtacgcttcagaaggtgggtaataacaaactcctccgatctaaaagagcactttctaacccaatgcaaggaagctaagaaccttgaaaaaaggttagatgaattgctaactggaataaccagtttagagaagaacataaatgatatgatagagctgaaaaacacagcacgagaacttcatgaagcatacacaagtatcagtagccaaatcgatcaagcggaagaaaggatgtcagagattaaagatcagcttaatgaaataaagcatgaaaacaagattagagaaaaaaagaatgaaaaggaacgaacaaagcctccaagaaatacgggactatgtgaaaagaccaaacctatgtttgattggtgcatctgaaaagtcgggggagaatggaaccaagttgggaaacactcttcaggatattacccatgtttaataaagtgattaaacatgtatgctaggcttttaaggacaatcttggttttaagggaagcc

SEQ ID NO: 471335 - DNA, 665 bp, Homo sapiens
tgtgttcttgtcattcagctcccactaataaaactctgagtacgactttttatagaggctctgtttatctctctctctctctctctctctctctctctctctctctctctctctctcgctctcatctatctggatatgctactgtttcaaatgtatgtaaatttctctggaggtggagttggtgctttccttttccttttctgtttttctaaaacttttggtgaatcttggccacctactggtccagattactctggctggaatggactcctcagatcctgtgggaatccctgtgcgtttgactgggcatgcaggtgctgggtagaagaacctggctctactgcccgtgtgggccaagggagaggtgtatgtgaggggtttgtgttgcgaacatcagctaaatcagaatccctgagggcggagctccacatcagtatttttacaaagcttcccagtggttctaacgtgcagccaggatgcattcttgggagtaaacttgtcggttcaaatgaaaggtttatcttacagcttctggtacagctaagttgcctgctgaaattcccactggtaacataaagataatcatccttaacatgttggtgaccctctccccccgtcgggttatagacagatttatacgatataaatggaggtggtgagttgga

SEQ ID NO: 471336 - DNA, 943 bp, Homo sapiens
ggtgatatttgaacaaggacctgaacaccaagtgggtggcacacgggccagacggagacagccctaggccaacagctgcagtgggttgccctggcactgttgccccagcaggcactaagaggggtagacaagatggcccatgtggataactgccccctacactgccccaggcacacaagtgcccaagggatgctctttgagtctgcgtggagtggaggcctgtgtagaggaagtggggatatttgcccatgcctgctgggtctgtctgttttctgaccccagaccagaagaggctactgcagagctcggaaggttctctattttgctttgggaaacagcccctcagaaggaagctggagatggaagaccaccattgccagcaccctctggcaccctcttgcatcctctttctgctcagcggtacccttatcatccctggagagcatcccaaatagctgatgctgggaaagttaccagatgtcccagagcctcacgttactcatctgcaaaaagagataatgatacccatttgatgtggtttggctgtgtccccacccaaatcttgccttgaattgtagctcccacaattcccatgtgtcatgggaggggcctggtgggaggaaatctttctgtatatgctgaggtcatatgaatattcttctataatacaattttttctgtaatatgatttttaaaccattttaatgccgtggaccctttgtcatgttggtaaaggtaaaaaatgaaactcatagaattacaaagaaaaccaattatgctgaaatatagttattaaaatatttaaagtgatgatatataacacatgtgctccttcttaatgcattaaatatcaagatttagcagaatatctaataactgctgtaaatttccaagtactgagtgcataaataatattatgagatacctgcaataactataatac

SEQ ID NO: 471337 - DNA, 2663 bp, Homo sapiens
tcctttcatcccagagttaattgaaaatcttaagcggcagggaggatgctctgaaggagattttctgagggaggatgctgtgaaggagaagcaaaacatggtgctggttgtgctcttcctccttgtgcggttcctttcctcacctaagagggactggcactctgctccctttgcctaccttggaagccctggtggtgtatacctagggagttggaaagaagagaaggagcaaggaaaacagatgaagaagaaacatttagtgaggttggaatgtgttgtccccaggagcagaatgaaaaagattgcaaatatactaaacactgctgagaaatcaagaaagtttgcagtcaaggcaacaggagccagaaaagataaaagacttggtcaaaagtgcagctcgttttgggcagaccaggaatactttgaactgaatgataaagacgaggaacagcataagaaaattagatggaataaaagcttattagaaacattcttgtgcaagtgcaacaagagacatgtaaataacaggatgattgtgtagagaagaaaaaatcaaagaaagatagattataattatgtttctgtagaattcaaggacagtctcaataaatgttgattaatatacataattcttaagttacatgcttattaccaagcaatgaaaataaaagaaaacgtgaagaaaagaaagaaaatgattaccaaaaaaagacaagaaaatggttacctgtggggtggagggaaggaatataaaaaggttaatcacttacaaattcaaacatatattcccatgacctcacaaaaaagacttgtacgtcatatctcaaatctgtaaatgaccaaaatgttcattaacatggccataaataaacagatgcttgtatacttatacaataatgtaaataaaaagaatgaactactggcacacacaatattgacaaatcgtgacatgctatgctgagtgaaagaacaaacacataaaagacatgcaatacaattttattgtttttctttctaattcaagaccggataaaactactctatcaagatagaaatcaaaacagtggatacctgtgaaaaggtgggaattaactgcaagggaccatgagggaaccttctggggagatggaaatattctatatcttaagtgggtggttgttatgcaaatatatatgctatggtctcaatatgtccaccaaaatttatgttttgaaaacttaatccacaattcaatagtgtttgaaggtggggtctttgggagatgtttaggtcataaaggctctgccttcatgagtggattaatgctgcttaaaaagggctttcaggattgggtgtgcactctcttgcctttcttccacataaaaacacagcaagaagaacctcacaagatagataccagtgccctgatcttggacttcccagccaccagaactgtgagaaatacacttctattatttacatattacccagtctcaaatattctgttatagcagcacggaacagactaagacagtatatgtttgtaaaataccattgaattgtgtgcttatgaattattcattttccatatgtaaattttaccttcattaagaaaaaatacaatgaaatctccctttttatattagttgtaaacctactatgaattaggctttagaatatttttatattctaataaattcaatgaattttcagggcaacaaaaacagtaaaattgctattactatattctctagaacttaaagaaatttaaagaaaatgtattatttttaaataaacattcttattctctaatatagatttaagtcttgaaattggaagtaaaactctacaaactgtgaaacataaaagcaatataatctgaagctattaaatctgtttatcaattaaaaatcacattgaaataacttaattatcaatttacagattaaactatagagtcactattaaaaattaatcatttctacaagcttaaaagaatttagtcatcatatttagtaattttttggaatacaaaggcgacagtattaattttcacatcactgataaaagcaatttaaattacactagcattgaaatttcagttttaagttgtaacgttagtgattattaatcataatcaatgtaaatttgttaatgccaattgagtaggttgatgacgatgctcatttatgaatgatatacaatacttttcagatgtaataaaatatattaaggttttttttactttcacggtttttaaacaatatgaattatttttcaagctttattaggcttaatatgctatgatatataatcattgatatgaccaagatttgctgataaataattccaaattaatatttcattttaatgcctatttcttaggccttaactccaggttctaaatttagtactaagtagcaataagctaggaaatatgcattcatcaaaaccattttaaaatatccaatgcctcaatatattagaaagcgagtattctttagcctgcagaaagttaagtataaaaattaggttttgaatttttatatatgaacttaatttcagcagacacttttaaggacccctcaatgcactatatgtaactaccagtagtccaattgtcattgtggtttaaataatcagtagtaaagacaagaagcctaactagccatctggagatagaa

SEQ ID NO: 471338 - DNA, 650 bp, Homo sapiens
gttgcttagcaatggaaaatgaactgttcctgtctgttaccactggaggtggaggtaggacaatgagctttattggacagaataggtatgaaattagtttattctttttcacttggagaaggcaattggcagccaagagagtcactcggaaaaggggtattttagaggttgagggtgactttccttctcattacttcgatggagagactatcctggattatctgatgggcttaatcattgacaaaggttcttatataaggaaaagtcaatgtgataatggaagcagatttgaagatgctgtgcaactggctttgaagatggaggacggggccacaagccaaggattgttggcagcctctaagctggaagagaacaataaaccaagaaaaagaaacaaaagatataacacttggaatcaaagaagaaaaacagatattcactgaaggtgctaaatgacgagtgaagcacaccaacatagcacatgtatacatatgtaacaaacctgcacgttgtgcacatgtaccctaaaacttaaagtataataataatttaaaaataaaaaaagattattttcataaaaaaactcaaggaatctacagctaaattattagcattaataagtgagtttagtaagtttaagggataaaaga

SEQ ID NO: 471339 - DNA, 485 bp, Homo sapiens
tggggatagtgttcatgattaaatccacttaatctggtgcaagttacttccaactttctgaatcagctctcttccgctatgctgctgatgaagacaagacacccagagcctctctccaggttttctggagtgcagagagaacaaagatgcaccctcaaggagacaccatttttgcaaccgttgtatcatagtcctcaatttgtagaactaggagattttcttcatactgttcaagagaaagaaaaaaggaacttaaaaaatccatttgaacgtcaccccatttgggaatctctcctgccagtccctccatcaggggtccacaccacatggcacataagggtgtttgctctcctgccttctcctccgctgcaagtagatgactgctcagaggcagagcctagccaatgttcatttgtattcccagcacctggaatagcaccggatgagttagggacatctaatcttttcagaaatgaatcttgatt

SEQ ID NO: 471340 - DNA, 667 bp, Homo sapiens
tcacccattagctttgcctggaatgccactctatggcctcttcctcctctctggttgtcaaaatcctacttattcttcaagagacttgttgaaaggctttgacctaaaagctgataatgatatggacaatgaagtccaggctaaggtggtcttggatggaaatgaagaacttgttgggaactggaacaaaggtcactcttgctatgctttagcaaagaggctggcagcattctacccctgccctagagacctgtggaactttgaacttgagagaggtgatttagggtatctggtggaagaaatttctaagcagcaaagcattcaagaggaggcagagcataaaagtttagaaaatttgcagcctgacaatgtgatagaaaacaaaaacccatattctgaggagaaattcaagcctgctgcagaaattggcataaagggtgcaagccccaatccttggcagcttccacatggtgttggtttgcaggtgtgcagaagacaaaaattgaggtttcggaacctccacctagatttcagaggatgtatggaaaagtgtggcagacttgtaacagttactacttgagagcatcactatgaccattactactgttactacttgagaccgtcattacaaccgttattactgttcctacttgagactgtcattaca

SEQ ID NO: 471341 - DNA, 1014 bp, Homo sapiens
gaaacgggtttccccttataaaaccatcaggtctcatgagagttattcactaccataagaagagtacaacagtatgggggaaactgccctcgtgattcaattatctcccaccagctccctcccacaacacatgggaattatgggagctacaattcaagatgagatgtgggcccactgctgtttgatagaactcagagctcctaattccctgatcaatattcttcctattgcctttgatgtttctttagagcagaagttggcaaactttttctctgaagaaattcaggctgaaatcacaaagctggtaaatggaattgggacagaaactgaagactttaaatctcaaattatgtgttctttctcctgcagtctagaagatgcaaataaaagaggcataatagcagaagttaacctgcagcacagttgtagtaaacagacaaaggcttgcgatgtctccacactgcccaggatggcctgcatacttgagctgatctactagccctttgcaattcacaatgatgtgcaaaatattgcctcaatctggtattcctcactctttgttaattctgtctttcaaaatacattctgaaaatacatctcaaagagaatctcacagtcctcaaaatctcttaaaatttcctgtttccctgatatgtggtattcctctcattcttatttcatgagagggattccaattatgcatattttagttacttttcctatttggatatctgtatattttttccatatcttttctaagtttttgacattctgacagaaggtgtttgctttcattatgtctgcagttgcttgtttgagagtatttaatgcagacatgagtatgatgttacagtttgcctctgatttctggttattttagggaaaaaaattaccagttattatgtattctctttttaaaatttcttgttagtacattgatttttattcatttttaaatactgtgtttttcaaaatcttaaaggtaaattcagggatatagagtttgaggggctc

SEQ ID NO: 471342 - DNA, 1314 bp, Homo sapiens
catctgcaaaatggggataacaacaagccctccttctcatggcgactgtcaggattaaatggaaaagcgcttaggaaagacttagcacaggagctaaggaagcctgtatcaaagtgaatgtgcgtttttaaacagtcatcaccagatgctttccccaaaggaagtacagttcttcctgcctgcagcaatgttaggcgtgccctttcctcacatcttgcccagcagtggatgctcagatcttttaatgtttttctaatctatcagggaaaactggaaaaagaaaaagaaaaagatgtgcccagatacttactggttttcggcttcctggtgaaagtactttatgaacatagtgaaatgtggaagtggagcctgattaatgtcggggctgttacacgggccatcaagttctctcctcatgatgatgtttttagcatcaaagaagcagctgagattatatgttggtctcaagactgcacagctagtaagttgcagagctgggattccagttcagttggtcagattctttaaccagttcttaacctgcaggctagattttagccttatcctggttcacatgtatttaaatattctggccggaggataccccactaagtataaaatagctttgaaataaagctatttcaagggaatgtctaagaaggaggttaaggaggtgggaggatggctagatcccaggaggttaaggaggtgggaggatggctagatcccaggaggttaaggaggtgggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggctataaaatatgcaaaagccaatgacaagacataaacaggaacatatggtaaattggtaaccagtaacatatgcctaatatttgaaaacttttaag

SEQ ID NO: 471343 - DNA, 609 bp, Homo sapiens
agctagcaaaaaagtctgtgggaggtgttgctgtttttctcctgatggtaaagctttagccgtaggtctcaacgatggaagcttcttaatggcaaatgcggatactctagaggatcttgtgtcttttcatcacagaaaagatatgatttcagatattcgattttcacctggaaagcttttacaggtcaacactggtgctaaggaacaattattctttgaagctcccagagggaaaaaacaaaccatccccagcgtggaggggaaatttggaaagtttaagaggtatgtggcccatagtacacatgtcacaaatgttcgctggacttatgatgacagcatgttggttaccctaggcggtacagatatgtctttaatggtgtggacaaatgagatggaaggctatcgagaaaaaaggccttgtgatagtgaagaatccgacattgattctgaagaagatgggggctatgacagtgatgttacaagggagaatgaaatcagttacaccatcagagccttatcaacaaatattcgcccaatgttaggaatcaagcctcatttacaacaaaaagaaccctcaattgatgaaaggtaataatttagtttagtatt

SEQ ID NO: 471344 - DNA, 848 bp, Homo sapiens
tttgataccagatggtaaatcgaccctagaaagatgacacagagaggagaatgccacaggatgaagcaggtagagactggactgacgcgtctacaggccagggctaccggcaaccacgagaagctaggagagaagcagccaggaagcagtccctcaccagacaccagatcttcaggggccttgatcttggacctcccagactccagaactgttctccacacttctactccagagactgttcagcttttgagtttctcagttagacctcaaatggcctggagctcagaggaaaggccctatgaggacggaagtaagaaggcagctgtctgcaaaccacaaaaagagacctcaccagaaaccagccctggcaccttgatctgggacttccagcttccagatctgtgtgaaaatggatgtccagccaccagtctgacccagggctgtttcctggaccctggcattgtaattgctgggcttgaaggggaggaaagggacaagaagacaaaaatgatgcctggatatccagcacctggagaccttgggctttccagtcttcagcaaactcttcaacaaagcagtcaggctgaggaggtgagcctctccctagagggtgactcaggctggcgaagctcctgcccaggtaaccacaccctgcaggaggcgggtctcatcctgggcgatggggagcaggaggtgatggtggtggtggtatttgaagtggtgcttcattccactccaggtgtgacagtgacagtgatggtgacagtgaagcaagggtagaagcgtgttttataatcagggctgccaggtgatcagggaacggggagggagtcagggctgtacagggc

SEQ ID NO: 471345 - DNA, 670 bp, Homo sapiens
ttcatttggaattcatcccagtgttaaatgaaagaatattgtgcaaatttccaggaaaatgtcaatgatgactggctaaattggaacaaatatcgaaagactccaaaatgtttacatcccagctggaggcaagtgtttcattcccagtcagggacgggacaaaaagaaattttgctgtactcttcgaaaagcaaattaggaaagcattcccgctggcaaattgaatgtgtcttcctgccattgccagcagtgccagggaaaaagaattggggaagaaaatcagggtttttccccacaacctcacctatgcttgagtgttggtatccacctagaaagaagacaattcctactgctacaaagagggcaccactcattgcctaccagaccctcatccaagtgctttcattaattcatctcatcctccagtccaccctatgacgtcagtactttgtaatcatcctcattttccggtaaggtgactgaggctcaaggttaatgtcaaccggagatacttacacctggaacatgaagggagagagaaacagaaataaatagagatctgaagataacagaaaagcaaggaaataccagtaactagtgtcatattacctccctgccaactgaagggaagtccattcggatgattaaaacatcttaggtattcaatagc

SEQ ID NO: 471346 - DNA, 639 bp, Homo sapiens
tattataccaaggtgtaggactgaccacaaacatcgggagatccacagggtaacccagacaagaacgagaggccaaggaaatcctggagggtggcgattatgctgatggggcagttcataccaggagtgacgactccttatgccaacagcagtgcaggttggcaggatgaccctcagcatgacatggacacacgctgcattactcggtgggctgggcaggcagcagttgccgtcaagaaggcatctgccagatgtggggaggaagagcgttccagccatgacctgacaagaagaaacgtgggaggccacgcacagccaagtgcccacggggtgctgcacacggagcccaggaatcgactctggcttcttccggatcacatggttcacggactgactggagacctggaacaaggtcccctatatcaggggtccccaagtcccgggccacagaccggtaccggtccatgggccgttagaacaggctgcacagcaggaggtgagcaacgggtgagtgagcattaccacccgagctccatctcccgtcagatcagcgatggcactagactctcacagcagtgcgaaccctattgtgaactggacatgcgagggatctaggctgggtgctccttatgagagtct

SEQ ID NO: 471347 - DNA, 987 bp, Homo sapiens
ctctacttgctccaccggagcacagggcgccatcatgtggtcggaaggggaccttcatcttatgtccaatttgctgagcttcctagggctggggcagttcttaatgctgtggagctatgctggagagatccttctcttagcaaccagaatcccaggttctcggccaacacaagttacggggaggatgcaaggtgaatcatcaaataatgtggctacaggcaaaaaggatgaagaatggaagaagaagaagaaagaagaaagaaaaaagaaagaagaaagaagaaagaagaaggaagaaggaagaaagaagaaggaagaaggaagaagaagatggaagaagaagaagaaggaagaagaaggaagaaggaagaagatggaagaagaagaggaagaagaagaaaaagaggaagaaggagaagaaactaaacatgcaagctccagaggtgctgaatgctcaatcaagggcaaaatacatcagaaaccagcaaggatgctacctaagaccatcatcatcaacaagaacaacatggcagaaatgcagaagaaagaggctaaatgtgctcacctgagaaaaagtcccagtctttttcgaagtttccagatctgagtcaattttcagatctagaaccatttgaccatgggtacattggattatagatctgtcatgaatttccagttgacctgtataatttccagttgcactgactgtcagagagttggctgctcctgcaaatgaactcgtttaaagttctcagggctaatttagttgagcatttcataaggtttcttatggattctgttatgacacttatagtattggagaggacccagaagtttcactgttccatgaccagtttgatgttaatttccctgtttgatatttctgaaccatgtatctaaagtgaatttgaatcccacacttgtcatagtacaagctgggtggtatgatttttctcatagaagacattatccccctcccagaactag

SEQ ID NO: 471348 - DNA, 1693 bp, Homo sapiens
cagcagcctcaggttatgggaaagcgaaagtatctgcacgtctgtgtgtgcaataattacatttcctcgagtcaaatgtgtgagtgtcctaaccctgaatcctcccgtttgagtccgatgtcgttagacaaatccctgatcggtgaggtcttccaagaacaatctctcttcacacacagacctattccttctgtaaggaaatctgcagcagctgcaaagagggagcatgtttcttcatattgtcacctatctgttggtgttatctgcagtataggggcagagtttcctgaaattgaggagagaagaggacaccgaactcaacttttcccgcagtctactcaacataaggaccgtgaggataaagatctttatgatgatccacttccgcttaatgactacaagaaccggccttctttggatacctgcttatctagagagagccagtacctgtgggattcaggactctttgcaaattctcatttaattttctctaaggtatttgtcttcaaagaaagatttgctttcgacgggctgctgatattgcggtgctaagctccatgggttatttgtttttgagactgtgcataaagtactaacattattatgacacaattaccacccttatgtgattcataaccttaagactattataggcaccacgggatatatttctttgttttggactgtgcatgtgtgtctgtgtcagtgtgtttgtgcttatataccttctcttctcaatcagactttggaaatcctgttttatttatttcagtattgcccttacaatgattcatcaaaaaacccagtgattttcttatacaaagtacatgctaaagtgatttttgattgactttaaacttcagagtgaactgggaggtgagggattaacattttaactctagcatatctttaaatataactatctacactagatcacgctcacctgataggaaaaaaggactagatcaactactcgtaagagtcttttccaactcttattctgtttctagaaattatactgtatcaaactgagaatattctattttaattcttcatttcacatccctgtgccaagcatcatccaattatagtacaagttctatgtggcaaaaaaatataagcacaatgaccaaggcaaatggcacacccctcatatcttttgccacccctttataccctatatatgccttttgtatttggaaacaaattactgctaccaggaaaataactaaaaagacccacaataacatgatgctgtaatcagctgatgtacctatatttcagaataaatatttgctaatacaggacaccataatcttcaggagctgtggagaaagatacagtcaccttcctttccttcaatttgacattttcttgatcagatctgacattgcaggatctcagatccaacatattataggaagggtttggcaccctcaactagaataggcagaagaagggagctggcatctgaaatatctttctatgattatacaaggtatggcaggatctgagcttctgtatgcaagccaaatgaaattattaaggctaaccttctcactcagcacttaataggtaatcaattttcactaacaacagtggagggtagaaatcaagaagggaatgataatgctcttccttacatttgcaaagggctttagagtgtgtaaaatgattttacatgaaataattc

SEQ ID NO: 471349 - DNA, 956 bp, Homo sapiens
tgccagttactcaaagcaaatactctagaggggcagatgtgtctctggaatggcgggaggctacatcattttcccagctggctccttcctctgcacttgcctgcttctcggagtacatgggaaaacaatgatggcagatggaaggctgagtgctggaggacaacagtgtactgctaagaggtcagcggtaaccttcagggacagcaacccaatgggaaaatcaggtgacaagtggaatttactacaccggaggacagtattgatggcatattctcaggtggcaaagtgtggtcacctcaatgtcacatccacaactggcattttcttcatgaagccacctgtattcctagactcatgccccctttctccatcttcaaggagcgtcgctgcaatttctgcttcttacgtcacgtctcctctgcctctgtcccacctggctccctcttataaaaacccttgtgattacattgtgtccactcagataatccaggataatctctctgcatctagtttcttagtttaatcacatctacaatgtcccttttgctattaagcactttaaatatgtcatgctattctctcctgggctgtaaggtttccactgaaaaatctgctgccagacatattggagctccagtgtacattattttcttttctatttgttttaggattctttccttatccttgacctttgggaatttgattattaaatgtcttcaggattggtccctgttgcattacttatttcatttggtgaggtaatgttttcctgcatggtcttgatgcttatggttgttcattgatgtctgggcattgaagagttaggtatttgttgtaatcttctcagtctgggcttttttttgtacccatctttcttgggaaggctttctaggtatttgaagggacttgatccataagcccattaatgctgtggttcttgcaaactcgtagaggta

SEQ ID NO: 471350 - DNA, 3272 bp, Homo sapiens
cctttcagagggtgaagggtgagaggagggacaagatcaggaaaagacttccgatatgaccgtctttgtggatcaggctgcctttacattcaaggtcggaagcagagttttaaatgggaaacagcataaaagtttggaaaatttgcagcctgacaatgtgatagaaaataaaattccattttctgaggagaaattcaggccggctgcagaaatttgcgtaagtcatgaggagctgaatgttaatcacccagacaatagggaaaatgtctccaggtctaggaatttggtgccctgcatgtcacctgctccagccgtgactaaaagggtccagggtacagctcagtctgttgctttagagggtacaagcctcaagccttggcaggttccatgtggtgttgagcctgccagtaagcagaagtcaagaattggggtttgggcacctccacctagatttcacaggatgtatggaaaagcctagatgtccaggcagaagtttgctgcaggggaaaagatgtaatgattaagtagaaatggaaaagcaataataaaaagttaagtgtaaaaggcaacttaatttccttgttactctgaatgttaatagtcgtgtgtgggtctcacccagaccatttcaaaatatggcaaagaaacatgttttggggtaaaataatttcaactttcttctttgtcacgtgatgttatgctagagtcagactggaaaacgagcctaaactcgtactggtaaatgagtgattggtttgctgaggttttgtgattcagtgccagccaaggaaatattggtcaagttggctgcagaggcttctgggaaatgttttctcattgagctaaagaaacccacagaaatgcaagatatttttatttttgaattgtgtgcctggaaatgcaatattcacttgctctccagaggagagcttgccttcagataagccaacagggtagcaaaaatgtggaaataatctgggttcttgatgctacctttaagttgttcaaatgatccagactggaggtaccctaccatggaatatctgttatggtgcatgataaatatcctgatattcaagccagctattgattgattgctttcttactaatgcagaggcatacagataaaaagtacatttaccgcaacagtaaggcagagtatgggaagcaaaaaaaagggaggtataaagtactatgagaattcaggagagggagggaatacggtctactggggtgaggagaggtaatcagaaaatcagactgacagcataagccacacacagacaacacatttagaccataggaactttttggtatgtgtatggattacagaatgtttaaaatttaagccaggtatcaaaaactcatgatccttcctgtaaaagttaatatttattttttcatgctttatttcagtgctcacctagcaacactggctgtggctgaggagtggtgttcctctacacagagcctgggctttcctccagacttgctgccctcttgcaagccccctgcctgatgtcacctgcctgatgctggtgcttttcgactgctgtatctatgaagggagaagcatttgctgctgaaacacttgagagtaaagtttagcagagtaagagagacataaatctagaggtttgggatagttttttttttaaaggatgtatcattcgtttattttaaaaagtctaagaagaaaagaggagagcagtgggtacattcgagagcatttgagggttagaaaagatttacatcttaggaatgaggatccttgagcttgtttccaagttcatggtgttttgagtgtggcaagactttttaataatatgaatgatgcccatggaatcttctgtaacattcaatcgacgggaatcccgaagtactatatatcccagatctttattttcccaaacacattggagtatgaaggacatgttgtgaatgacagaattctgtcattatatttaatttactatcaaatttacctactaaagtggaggactgattaagataaatacagacaatgatctcatcctggaaggaattactatggaaaaataatttgacaagaagatccactttttatctgaacaataaaacatatcaatttctcaaaacctcttatgtttggccagttcatctggtgagagaatggaaaaagggagacattcatcaattttacaacctgcagtccatcctcagaccaaatcaggaagaagagtgcatggagaaaacatttgggaagaaaaggtattttcaaaacatctggagcaagagacaaatcccatcagctcagttccaacaatatatgcaggtaagattttgttcttgaaaaatcttcaattgcccccattacctctaaaccttttacctctggccagcagtagcaaattagaattaataatgtggcttttgaaaaagcaacagtgatgtaattattgtatcagcataaggttaatgatttttaaaatggaaaggctagtgatgtgcttagaattttttaaaaatcgaagaaattatctcaattgaatttgcctccttctgcttgttcttcaggtaataaggttgagtgaagagttaacattgctgcaagtaggattatctgcaaaaacattaagccagtcttgacttgcttaacagataaaattcagccagaaaatgaaaatagggggtgaatgtttgtgtgggaaacacaggagcctagtttagcactctacccaaatgcgttgaagatgctgctgaatgtttcatttgggataccaatctagctacaagtatctggaagaatcaaaaaatgttttccaaagttaatacataggcgtgaaaaccaaagagcagacccaatgcacaactcagtcccgctaaaggcctgtgagacctctcatggttgaatactcagaaatttttaagtaactggtattctccataaacaaaaataaagatggtaatataatacaccatttttctaacaagattctactggttagaaaaatggtgtaaatgtataggctagtctaggcattgatggactgcagcaggtattcagaacactggtgatgtttgagaggcatattggggaacatggcagcagatttctggacatgtctcccatttttatctcttattaaatgtatgaccatgagtactttacttaacgttttggtggctcagtgttctcattggtaaaatatggctataaatagtactttgtgggttatttggagggacaaaggtgataacatatttaaaatgcttagtcctgtgcatcaccc

SEQ ID NO: 471351 - DNA, 1517 bp, Homo sapiens
gggctccttgctacttatttggctggaagcaggacgatttatgagtgagcctgatcctattgttttgatttatggcacctttatggagacttggtcatttcagttgattgtccaacctccagtgactgctaagggccttggaaagtgggaaataaaaccagatatagaaaagcataaagaagaaaatacacatccaatgaaatgggagagtttcctcacccccccagcaggacgtgcaacagaggtgtggcttgtcttgtttggccgccatgtgcgctcaaaccccttatgtgacagggagtatgcagacgggcaggtgcaggagctggggcaatatccaggggtgggtgtctgcaacttccaaagcctaaatgggtgtatgttacaatgtgctcttttagccttgccatccatggatgtcttaagtgttagacagttcagtggaccctctgccttttcacaagggcagagggccagtatgacagctttctgtattctgagctcttgtccagctcactggggacaattgtacaacctcatcagcccagagatggcaccagaggaatctacagaacaaacttgactaactagctttattttctattcattcttccatgtacttaccttcctattatttgttgctctaaaaactcagttttcttcctttgtgttgtcacttctctaaatatttattttcttttgttaaggtgatatataaccaccagttctaaccaccacttctagtttcttatctctgagtgttttcatgtatgtgttgctagaggaatcttttataataatgatgtgggctaatgacacagcctttcatttttggatactaagccctatatcagatgatcctagattggatctgaaatgagaaacagcagggtaaaagatgaatttgaaataaaaagtctatggataatactatggcattaacgttaatttcctgatgttgaaaattatactctggttatgttgttaacatttggagaaatctggagaaaaacacaatgcaatgctttacactacttgtgcaactgttttagcagtttgcagcatgtgattggctgaaaccttggctgcttggatgagacctggttacttgctgcaagaatataccctcaagttagaatgcaatttgtttacatattcagttaggttacaattcactgtgtatggagggagctttgggccaaattttatttatcagatagttcacagttttaatattagatcatgatatatctctgtttataatatcacctttttcccaaactccttttttggtgatggtcatgataataaacaagtactgtgtaaaagtaatacgggcaaaaaatgagggtagcagtgtccaatttgatctcaatgtttgagaatttgtgctgtgttcaactggcatatacattttattaataaatatgaataaaataaaaatgttatattttctttcatttaattatttttcaaatggctaagttgttatgatataaatatggtatttaataagc

SEQ ID NO: 471352 - DNA, 588 bp, Homo sapiens
agacatgactttctctctctctcttttttttttttttgaaacaagtttacggggtgtagctggtatctggttacatggataagttatttagcggtgatttctgtgattttagtgtgcctgtcacccgagcagtgtacgctgtacccaaaaggaaccctttgcttcttggaaaactgaaggagattttggattcccttatgctacagcagactgacagggcagcccccagagggatggaactggtgattcctggagaagaatctcagtatgaactcctgggctggtgggatcgaagagttacaggacgggaaaatgggacctcagttcaaaccattccagctcctctcacactggcagcagttccagcaaagacccaatttatgcacctctatagatccactcaatctcttctttcctgtggtagtaaattcccagatcctcctgtctcatcctcagataccagcaattgcagaaacctactcagagggtaaaggctaggctaactgagccctaatagctgcatttccccagtggctgccacaagggacttggaaacactactcagaatcatgagaaagttacacccta

SEQ ID NO: 471353 - DNA, 668 bp, Homo sapiens
taaagaatttctacagacacagtgtaatggttaatattgagtgtcaacttgattggattgaaggatgcaaagtattattcctggatttgtctgctggcttcacaggagaggtaggatttagactgaatcctagaagttttccagatgaagtcattgagaatggcaaccatggctccattgagaatggagcaaaatcaatattcaagacagtgagttatgaaaggagcagaggggcaatatctctcccggatacacccaaagccccttggcaatgtcgggagacatttgtggttgtcacaagggtcggaggtgttactggcatcctgcaggtagaagccatgggtgctgctagggctttaaaccagtattttctgtaccgcaatagtgaaaatgagaggtatgggaaaacaggagaatggctaaaatccaaaacagtgaccgcagccaatgctggcaaggatgtggaacaacagaaacactcatatgttgctggtggaaatgcaaaatgatgcatgatacagccaccttcaaagacagtttcttacaaaaccaaacatatttttatcatacactccttggtatttacccaaaggaattgaaaacttatgttcatacagaaacttagacttgcatttttatagcaactttatttataattgccaaaactt

SEQ ID NO: 471354 - DNA, 894 bp, Homo sapiens
aaaccagtggtttattagatttcagagggagtatggaaacgcctggatgtccagagagaagtctgctgtagtggcagaaccctcatggggaacctctgctagggcagtgcagaagggaaatgtgaggttggagcccccacacgaagtccccactggggtactacctagaagagctgtgagaacagggccaccatcctccagtccccagaatgatgttccctcagtggttggtgggggcggggacaagctgctgtacttatcacagagattggaagaaaacaaaacaactgcaggagcagagaagtttctgggcttttatgatggagaaatggagaatgggcagaagaaggagcagtcagtagagggggagttgaagggcttagcaagatgtgtgttaaatcagcttaagcaggagagagcagaaggaagaaccaaaagtttctcagccaaagttggagggtcaaactggggagaatgtgatgaagaacaagagggcctggtggaaggaagagaagcttaagcctcctgacattcatcttggcaaagccgtgtgccttcagtgacactgtgtttgtaacacattggctataattgcattgtgagtgtaaaataattcaatggcccaccatttttcccaaaccataattagtacccaataaatgcttatggaataagaggtatttttttattcacctctgatttttaatagttcttaacagatttttaaaatgccaaatctcatgttttaatgatatcatcattatgttttaacttaaagcaggaatagcaaactttggaatctcagaaaacatactggaaattcatttttttttaatagcatgtaatttatttaaagaacatttattacacatggtatccttgagctaaatgtcc

SEQ ID NO: 471355 - DNA, 2227 bp, Homo sapiens
gaaaatccacaggccatgttaatggaggattctgagcacatcccatgggagaaggcaacttttaagtcctcccccatccctgaatctggagttgtgtttggactgacaagctcaaatcccaaccatgaccccagctctcccaatactaaaggctcaagaaatgaaaagatggctttgttgacacttcaacttctagcccctcctcggcagctggttcaagaaggaaatgagggatactctctccttttcaaccatgctggcttctttgttgcccttgtacatgctaaatgcaaactaaagaagtacctttcagctcatcacctggcaaagaaagcagaacaagattttcttcacagtgataatttaataggaaggttcccagagagacacagtgacttcagcagaggcataagcacagcaacacggcaccggccaccagcatgcttcaccagtgattttcgtgacaatgacagagtagtttccagtttagccacagttggtcctaagtccctgaaggcaggaaccccaggacgacagcaaggtcctggattggctgctcagcctgtgaattcagtttccttgagtgtccaagtgggagtcaggccccctgaaaatagtgcctataacaactgtttcgggcttgatgatacagactgtagaagaacaacacaagcagcccctcccactcataggctgagaatctttcatctagcacagggatgcctacttatacacgaccttggagaaaaaagcatccagcacggcaggtacaagtatgggatgcatttcagctaaattattttccctggaaaaggggaatctttatatctgtccctggacctctgtgtgtgtgtctgtgtgtaatcctttaaatgcttggaggacatcttacctcctccatgaaaccctactcatttcctgagccatggttttattttgtttttaattgacacataatagttgtacttatttatggggtacagtgtgatttttaaaggcaaaataagatgaaaaattgaaaaagttatctgaataattcaaacccaatactaatgtcatttgcatcattctgtgttagcagacaactttcaacttccaaattaacatcagcatatttttttgtaattcaatctttcagtaattaactatagtaacttatctgcattgttcgctatgtttttcttaccaggtgagtaaattttaaagatattttacatctctttaatcttatgatttcatttagtatagatctattttcctaaaaagttgaaatcattttattactttacttgtaccctttttttgttctttaaaaagttttaaggtataagtgattaaaaacaaacaagccaacaaaaactaatattctctccatatatgataatagtaattattaaataagactaataaaggaaaaatgccatatatgataatagtaattattaaataagactaataaaggaaaaatgccatatcaacattaaataatagtattaaaacgtcaagagctttcaaataaattatttaatagtattacacaatctgcaaaacaaaaaaatatttttaaaaagcattaggacttttatatatacagggaaactgaggcttagtgaagttaagtgtcttactcactccatatttcataattggaagaactgggactaggcttatatcctctgacttctgggccagtgatctttctacagcagaatcgtgtagagagatctaagatctctctaagagagagagatatatatatatattggatttatatatataatttatatatgtataaaattatataattaaataaaaatcaaataaaattataattaaataaattaatttattataaattcaattataaataaatttataattaaataaaaattatatatcatatataatttatatatgtatatactttatctatataatttatctatataatttatatatgtatataatttatctatataatttatctatataatttatatatgtatataatttatctatataatttatatatgtatataatttatatatgtaatttatatgtatataatttatatatgtaatttatatatgtatataatttatatatgtaatttatatatgtatataatttatatatgtaatttatatatgtatataatttatatatgtaatttatatacgtatataatttatatacgtatataatttatatatataatttatatac

SEQ ID NO: 471356 - DNA, 805 bp, Homo sapiens
ataaacaagactcttcaattgttctcagaaataagaccccaggcccctggacagcatgtgtagtgtgggcaatggcaatagcagtggtgggataatctgttctcaaacagtccacactgatgttggtggtggctgtgatgggctgggtggggagcttacaggcctgcaggtggtacatgtgcgagtactgtgcaaggactttagaagcactgtttcattaattcttacaataagcccgagagaccaaggaatagccacccctctaattggagagtccaacgcagtgtttacaacagaatcatctgcattgcctaatacagtcccggttcacattaaaacaattgatattttcaagcatgtagaacatgagcttttaaataagcctcctttgttgtttgttattggaggctgctttaggaatggctatgaagaaaaagaagtgtctttgtttcctgtcagtgctggagcaaattactacaaatttagtggcttaaaaaattattgtcttaagtttctagaggtcagaagtctaaaattggtttcgtgggacaaaagtcaaggtgtcagcaggtaacagtcattctgactggtgtgagatggtatctcattgtggttttaatttgcctttctctgatgattagtgatgttaagcattttttcatgttttttggccacttgtatgttttcttttgagaagtgtccattgaccacatgctcagtcataaagtatgtctcaataaatttttaaaaaatcatgtcaagtacacttttataccacagttcaataaatatgtaaatcaatatt

SEQ ID NO: 471357 - DNA, 584 bp, Homo sapiens
taaatcatctctagattatttataatgcctaagataatgttgtttgtgtattgtttatgccaaagtacctggacttcattgttcacatcactatcagcattttggtcaaaatcattcaacaagtatctaggaagctccaaacattcccacatcttcctgtcttcttctgaactctccaagctgttccaatctctgcctgttacccagttccaatgttgcttccacattttcaagtgtctttatagcagtgccctactctctgtggtgaaatttctcaagattgaattactgaattcatatgaggcaatttgccacagggatctgtcccgatgtaattgtgtgagctggttaagcagtcttggtagggctattgtcctcatgtctgatgctggagcttggagtctgaaggacaagcaatcaggaagggaaaatgtatatgacgcaaatggtgttacataggccctatactataccttagattcgtaaaatacagtagttcacaagtagatccatgtataaattcaaacttaggttataactgagggagaattttaaatcaatgacagaatgatcacttattcgct

SEQ ID NO: 471358 - DNA, 656 bp, Homo sapiens
tcatcagttaaggcaggaacaggccattttcacttcttttgtggtggaatgtcatcagttaagggcaggaaccggccatctggatgtgagaatgagtattgacctacaagtagtcatggccttagaaaaaatgctgttgtggaagccttgctgtccatggaaggatgtgttaaccagctcagcagcgagtcagggtgacagtcttttacatcctgccctcttggtacctgggttcttgtccggcgtccggaaagaatcaggtcacgcagacgtgaaggatgggaatgcagatgtgaataaggacaggaagaatatttataccagagaaaataacccctacaaagatcctatgctgaaagactgcacagaaaaaattagcatggagagtaacgggaacaagagaggaggagccaaatgtggttggagacacaggcggaatcacacagcaaaagcctttgggccaagtgaagttttgctttatggcaaatgcagcagggcatcagtaaagggccagtctcactatcactgctgcttcggccctaagccagccctgacttctctcacctgattgttattattactctttcctcctcactgttctttcctccttgagcctcccaaagtctattctcagcaacagtcagtgtgattaattt

SEQ ID NO: 471359 - DNA, 865 bp, Homo sapiens
gataaaaataatttactacttaagccatgatagccaaccatggttgcctaagtcttttaaatctcttggagggcatcccgggcctgatacagcagtcagtgcagcaacagtgcaacagtgaggtttctaatggggctgtcctgcaatataatttggatgttatttctgttgtccagcctagaaattctgtgagtgtccttatgtctttgaaaatcccttccatcctactagagttctgtgagtactcaaaaattgcaaaccaggagggagatggcctaaaagttactgccctatatgaggtcctccaggtgaggcagataaccaatggggttcctggaactgccagattgcctctccctgatgtccttgcctgctgtttccaggtatgctcatccagtgaaaagcaccagaagcacacaggaggattcaaaaatgtccgtgcatacatcaaaccaagcaacttagaagtgcaatgggaaaattgatggagaaagggacggtgtttctaatagactgtgattcgtgtagctaacagattttgcagattttacataaatatgtgaacacctttgtcatgttcctttccagtgccttgaaaggagcccatgaaagttattattctattttgtggtttagaaatcatcaatttaagatttttgtttcattgagcaaaaggccatattgttcccagctctgtattaaaaaaattcactggtgtaaattttattattgtttgcaatgattttatttaccacccttccaaggatcttacactcaaagtactgctgtataactttcagaacttttctgtgggaaaagcactcttccttgtcccagtaatgtcagcactgtccatgtaacatgc

SEQ ID NO: 471360 - DNA, 848 bp, Homo sapiens
aatgtttctctccacttcaaatgtgagacgacacaaagaaagtcaaatacgctcccctgaccaagcacgtagggtgcctacttctaaagacaatagatgacaaattccgggcaggcaagccagttgcaacaaggaatcgatggttcagttgtcacaggacgtcctgatcctaggtttagtttctgatccagctgaaggctcctacacactttctgctgatcctagaaggggcattttgaaaacgaatagtgcaagtcctgaagttgaagagctgggaccagggtccgcaactgccatgcaccagctgtgtgacttggagaagattaagggctttgagtctcagctgtccagtttacaaaattgggataataatatattatatacatacatggtatattcgaagggctctcagcagagaaaggcagcacaggcttcacattcctggacctgtgaccacaggagaaaggaccaagggcagtgctcaggaggattatttaggagttctactgaaatagaatttgagctgtggaggtcatctacactgaagatgaaaaagacaaaacggcaaggaacaattgttgagcacctactgaaaggagagcactgtgctttacatacacaacttcatttaatcctcagtataacactagaaggtgatattttgatgctgagggagctgaagtcctgagtgtttgaataacttcctcatcctcaaacagcgagtaaatagcagtactagattctgacttctaaggcctcacctttctgggacattacaccagggaaattcaagaacagcccttctctaaccttgtgattgaaaaaggtcaagtttaaagatgggaacc

SEQ ID NO: 471361 - DNA, 690 bp, Homo sapiens
tagagcaggggtccctgacccctgggccgtggttaggaaccaggcagtacagtaaaagagagaagctatcggaatgatttgctggggtcacagtcacctggttactgcattcagtaagcgttggacagaggtgaaaaccaagttaggggacgtgaagagtcagagccagaatattcaggaaccaaagcaggtggaatcttgcaccaagaaacagaatccaaaaaaagtcacaagagatgtttctggtacttcacgagtgggcaagttgaagagaaactaccagagacattttgagagcaaacaccagaccattggtttaagaacccatcccctcctatgtgtacagcagctgcatggattgggaggcccaacaaaaaagcttcccgtggcctctaatgggattatgtgcttcccatggggagaaaaaccattgagaccatggaggagtggaaaccttgattgtcataagcccctgggaatggggatgagagcccactcaagtcgcatggatgagcctgaagaagagttgatctgcacctccaaagtgagctctggatgcaatcatcaagaatgaatactagaaggcaagacagcccatgtttgtatcatcagtttttgtccatatttgctctggaataatttggcactgattattattacggtttcacaattaatgacccagcggattgc

SEQ ID NO: 471362 - DNA, 763 bp, Homo sapiens
cctccctccctgcctgcctgcatgggtcagaagttctgtttccagcggtgctgctgctgctggcctgactgaacttgcataagtcacttacagatcttcaccccaatgtcttcatatgcaaatgcagactgcttttgggtgcttttgacatctactcttctccttgtaccccacatcctgaatgtatggagtcatttggactccgtgcatgtcgtgacaaagggatacatctgggaaatgaagagttcctgctcacagacgagcaggtctcgaaagtcacgggctctgatatgggccttgtctgaacaggaaaaccaggacatctcatctgtcagaaatagaattgaagaagaagaagaaagaaaggactgtgaagaagaaagaaagaaggactgcgaagaagaagaagaaagaagaaagaagaagaagaagaagaagaagaagaagaagaagaagaagaagaagaagaagaagaagaagaagaagaagaggaaagaaagacggactgccaagcctaagagttggtgtcctcatctcttcgaattcactttctgaatgctttgtttcattgtttgcaaaggtaggtgctaaaacttatccatgtttggtgaagtggaaatcaatgcagccgttttggaaagccatttgataatatttaaaaacaaaaatgcatatctatttgtctatgaaaagaacctataaatgcacttccacatgtactgaaaatatattgtaaaacgattttcactgcagattttttttt

SEQ ID NO: 471363 - DNA, 738 bp, Homo sapiens
aagcttagttttatgaattctggacccaaagtgggttcagtgccaagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcatggaggctgtagaactgtagtacattgtgaatctattgtctataacatgagatgccttatgctaagcctctttgatcatcttcttgaaacttctgaaatgctgaggacttggagtcagggtctggagattggatgtagtgctgtagctccattcttcttccagtttttgcccctgctcttgtaagtttaggaaaaaagactggggagagaaactcagaccttgcctaggtcccatcagatgcttggtgtgaataagctgatggatactgggttctattacatgaaattagcaatatctatcatttgactcgaagttcagactaatatatctgtgtttacctacagtttc

SEQ ID NO: 471364 - DNA, 1190 bp, Homo sapiens
gtaagctgagatttcacgctgtctgttcatcccatagaatggaggaatgagcctgggacagaactcatcagctctccttcccctggagccggcgttcctgcagacggagactttagagagatcccgggatctatagaggctacagattcccagggctccagggctcagcactttttgtcaggagaggctgcgcttgtgagagaggggaagtctttgaagaagaggtgaacaattcagacaaggtggtgtgggagaaggctatcccggcagaggtaccctggtgagtcagggcagagataggaaacagagaaacagtgtggcccttgcaagaaaccgcagatcaatagcatcctgcaaaccacacgctctaagagggatgtggagggaggggagaagaagtgaaggagaagtggaggtagagaggctaccggggtgtttagggccgctggcagggccgctggcaaaaatctgcttgggctttcagtctgggtgagggagcgagggttggatggaggactgagccaggggcctaccctgaagtctggatgagctgttgtcatgagcagatgggatgtcacctgtcaagattgcagtgtcaggatgcgaggtccagcagtttggggttctgacaacgtcccacatacacaaaagtgtggatgattgaagggcgtgtgaatgaagacgtagtagtcaagaaactaggatttgctggaggctcagttttgggcccgtcatctgcaaagacatggatgaggctcctccatgaggatccccatgtgagaagttcccgtattccgttcaccactgtatcctcagagcctaggcaggcctctgatgggaagaaaagctgttctaggaggcctctggacacctggtcccacttgatcacctttggcagtggccaagcatcagacctttactttctgtgcatgctggagacctgtgagggggaagcagccctgatgatccttacacaccactcactagaggaggaggaaagagaggccctgaggcctgatccctaccttttctctggagctccagcatatcatgctgtgaagaaatgttccagagaatgcaacatgtactcatggaattaaaatctttcaaacccatatatattcagacaatggagagggtatttacagagcttataaaaatgagctacgtgtggtgcacctctagggttc

SEQ ID NO: 471365 - DNA, 1256 bp, Homo sapiens
ctggaggattgctgggccccactcttacagtttgattcaatagatctggggctgtcagcaccactctgatggccagatcccaaacgatctccggtggcagtgagtgggagtgacggccatgctgggctgccccctggagccagagcccacccacgacccacatgactccacaggcacaggtccctcagctgctctgggcacctgcaaggagtgggtcagtgcatggggccaaagcacaggccccttcaagtggggagccctgcaggggacccttgctgggccaaagggccttgctgcccctcacttcccaatatgtcaggagaaaagattggatgcctcagcgcagctgcagagttcttgggcattctgccactgccttctttctggccacatccccccaaccactcacgatggggtccctgaggatgtccacgtgcaaatccctgacactcgtgatgaggattatgacagggacctaaattctgctaagagcagaagccgcctggacagcaaccggaagtgcggtggctctggtgggcgtggtgggcgagtaccagcagaagccgcctggacagcaaccggaagtgcggtggctctggtgggcgtggtggctgagtaccagcagaagccgcgtggacagcaaccggaagtgccgtggctctggactctgggctgtcgtagccaaacacgccttcttggccgagtggtggcattctgcctgccccctgtgggcatcattgagattctgctccccagcttccgcagtgctccgttttgtgatggaaaggaagggcaccacttctaccaccaggagatacctgctgtgggacacagtgctgctccagccatgcagaagctcacacaggcctgcagcagttattcatccgtgcacagctgccactggccagcagagcctgtgacggggccttcacaggaatgcgataccgccaagcctgaacacagagaggacacgacgttggcacaggcctgttgggtcttgacttcagcctgcagaggagctggaggaggctggcagactctgctcacaaatgggaaggcccagctgccaatggcttttcctctctgcccatgtaacactttttgtggggaatgtgtggacacagcttgaggctttgtatccaccctgtcagttgaaatgaagtgttttccaataattagaatggtggaaaaaaaaaagtggctccaggtgagaacacccagagttcaaattccaggtttgtgactgaccacctctg

SEQ ID NO: 471366 - DNA, 655 bp, Homo sapiens
tgctcgtctccaccaagttgaaatggaagaaggtttgtccttgccagttcccttgattggaagttggtctctgttgctgtggcatgcgagttactgcagtatacatttaataatcacattcacaagctccctcattgccagtcctcaacacacaaaagtactcacttggctaactttgaacaatgcacattttccttacttgcactttggatcacaggataagaaggcggaaatggtaaaaacaaaaactcacaaaagaaatgaaacatttatttctgggatcaaggacccttcacggaagggggacctggtggtctgcagcctggcagtcctgctgtggtggttgcagccttcactgctggccacgtgctctgaatcaacagcccccatgggctcattcacactgagctgtgtctgggtcgctgtatggggtcctcctggcagccctggtgcactttcctactgacagatctcagtaaagatctgtgaatgctgcaattctaaaggaaggtattggaggactcttaatactcatcttagtattaatgaaaattaatgaagacattgtgataatggtgaaggatggtcataacgatgcatggaacagaacaggttcagggatagactatacatctattgattatttgataatggt

SEQ ID NO: 471367 - DNA, 933 bp, Homo sapiens
ccaggtctatctgagtctgatatggtttggatctctgaagcccatgttagagagctcagtgcaggtgggaataggtgcccttatcccatctgcttctcgaggacgtgggagccacaggccaaaagtgagcatcttcacatcattgctacttcatcatttacaaggttcactgtttctcaccagatgctagaaatacaaggaactaggagtgacatgggaggactgagcaaggccctagctcttttcaattctgtgaaagctgagaaaggtgagcaagatgcagaagaaaagttggaaactagcagaggtttgttcataacaaaagtgcaagataaggcagcaagtgctgatgtagaagctgcagcaagttatccagatctaactaagatccttgatgaagttggccacactaaaccacagattttcagtatggaatctactggtgaagatgctgtgaatgttgttgaaatgacaaaaaagaatttagaatattacatcaacttacttgataaagcagcagcagggttgagaggattgaccccaatttcaaaagaagttccgctggggataaaatgccatcaaatagcatcacatgctacagagaaatctttcatgaaaggaagagtcaatcgatgcttagcagccatcaacatcaagacaagatcctccactggcaaagactacaacttgcttaaggctcagatgatcattagtattttttagcaataaagtattttaaaattaagggtacatgtgcacattgtgcaggttagttacatatgtatacatgtgccatgttggtgtgctgcacccattaactcgtcatttagcattaggtatatctcctaatgctatccctccccctaccccctaccccacaacagtccccagagtgtgatgttccccttcctgtgtccatgtgttctcattgtt

SEQ ID NO: 471368 - DNA, 1008 bp, Homo sapiens
ggtgtaaaattagtggaagactgtctcgcccctatttccatgaacatcgaggacttcagatggaaactgggcttcataccagttgtgcagcgcaccacggctgtccttctagaaaacgcaggcacaggccatcagcttaggtacaagtttagaaaaagagacttccaagaaaacccaagctactccacagaagtgcatatttcgaacatgaccccacaggaatgtctgccaaggacagggcagcagtgcagtgtgtgcgcgtgtgtgcgcgtgtgtgtatgcgtgcctgtgtgcgcatgcatcacacttaaaaaagactatggtctttttatgacaccaggcatctcgtccttcccagagaattcagtttggttgactctggcagatgtttttgtcctaagagccaggcttgattgttgtgcagttcgccttgggtctgcaagcagcattgaggtctgcctgcatgttatgggttgaagtgtgtccccccagaattcagatgttgaggtctgaaggtttgtcctttcctgctgccttcttttttggcttcgtttctacttttgcaggagcagggttaggggacaactgtgcccatctcctcctgggcttttccttcacagccctcttgactgagctgaccttcctcctgggcatgttggtggtggggagggggcctgccgggtgcctacgggcaatggcgaaaccagagccttctggaagctgggctcaccagctgctgccgctcctcccaccacccaagctgccgagacctgtggcagatttttttccctcaagtttatagagctatctgtagtagctcactcatgtattctgtaatgaataccccaccttccccacccctccatctgccactttcttatctaccgaatttgatcttaactcctcaaaaagctagccaagtctgggagaaagttggaaagcttaggatggtaaaagtaatgctgttccaaatgcaaccttgtattatttttacactggaaacaaatc

SEQ ID NO: 471369 - DNA, 1096 bp, Homo sapiens
ctcctctcttttgtctgccaaatcccaacctacccagggtgttacccccagctcaagttcctcttcctacaccctggttctcagtcatcttcctcccaactttgctgagctcttgccatggttctgctctacaccacatccctcaaccctgattccacagggtctgtgatgcgggtcaaactaagctcaggccacagcccttcagtgggcacgattggctttgatgccttctatgaaggtgtagaattcttggtttccccagcaagtagaatggggctggagaaggaacaagaagtgggaaacagagaactggagaggagagaagggaagagctgccatattggggagcgagtgaaaaaggaggagaaaacctatgttttgattaagaggaagaatagccatgagtatgttaggactgtggagcgtagttgtttcctggatgtttggtttagacatttaatcttcagagagatgactttactagcaaatattaactttagatatgaagcttttatttgatcatctttatagctgttctcggtgggcaaatacacttaatgtaccttgacatcgcaaagttatttttaaactgcaatgacaacatgaagtcaatgatatcacttaccctctgactagggaatgcaataaaacacattaaagagaaatattgtcattgtacagtgcaataaatttgtatatcatgctgttaagtgttgccgtttatagcaaaatatgaagccctgtaaggacaaagccttgatttgaatccagggatggttgtagctgctgccgaggtttctgatagcatcagaacatctcagcaaaaggacttggcagtgtggaagagttactggccagggcagaaaacaactttttaaatttagactttgctttcacttttacatgttaataaaatagttttggaatcttagccatttgttgaatgctttccttcaaataatcttgtctgagaggactttaaaaaaattttatagttttagctttatagtttagctctctaaatgtaaaatttagagatcttaaatccattttgagttaatttttgcatatagtatgaggtggggatcctactaga

SEQ ID NO: 471370 - DNA, 828 bp, Homo sapiens
cctggagaggaacccgaggttactcagagggtgttgcctctgtggagccctgcatgtttgaaaacatgtcttaattccaagatgtcaaatgtttgtttgattttcattcaaaggggtattgccaatgcaagcttcatgttgaaggtcctacttgtagccgctgcaaactgttatattggaatctggacaaagaaaaccccagtggatgttacagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaaggtataactgctgctgtttcctggctttcagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacaggtttgcctatttccatctttcacaagttactcggtgctcgttgactgagtgtgagtgtgtatgtgtgtgtatgtgtgtacattacaagtccagtagtgacacttgaatagaataaagtcactgtttggctagcatgtcttttaaccatttttttctatgctttatggc

SEQ ID NO: 471371 - DNA, 462 bp, Homo sapiens
ctggaatattcctaactcaggatggaggcatgtctataccacacagaaggagctcagggttctcacctgcacgacctctgtcgtccttcgtctcctgtaatactggcatcttcttctaacctctctgatgatgcttctctggccatttcactggcttcatttttctccttctgcctccagaccaagaagatgtgtggtgtgagttgcgtcctgtctctgccgctcactctctgggtgacctcaggtcctgtgtccgcagtgaaacatgtccacatcaagactgacttattctactttgtcccctccctcccatgtcccctaacaaaggaatgtgatgcagctcaccccaacacatctgggcctgattctctgagacatggcaagcacccacccatgcccagatgttgttacaaaacgtttggccaggagccccattgccatggagataaattctcttgacct

SEQ ID NO: 471372 - DNA, 567 bp, Homo sapiens
ttctgtgtaggttgtcatcatttccacttatgggccatctgcgggagccctccaggctcgggggccatgtcccttcttgcgccctcaacacctagtgctaagcctgacccatctacgacggtcatccatgaccatccacaatggccattggtcaatgacctacattctggcggcagtgtgaccgatgtgcttccgggttttaccgctttcctgagtgtgttccctgcaattgcaacagagatgggactgagccaggagtgtgtgacccagggaccggggcttgcctctgcaagatgccagttgcaagtcccaggcctccagtacttctccagtgctttgctacaagttgggggttcccacagcccactcctcatgtttataatctgctataatggctcccagaattcaggacacactttccttcctattgctgtttattataaagaatatgataaaggatacagagcaacagccaggtgaataggtgcatagggagcttgccattaaatgcgccatggtcctagtttttattcatacacttatttctttattattcaaacactcatt

SEQ ID NO: 471373 - DNA, 3427 bp, Homo sapiens
cagccacatctcccctgctgctgccagcatctttgcagcagccactccagatgggccactgctgaggatggaccctgtgatggttaatactgagtgtcaacttgattggattgaaggacgcaaactattaacccggggtgtttctgcacgtagaaagagagagagagagagcatgagagatacagcagaaacccgccccgagtgtttgacacgtgcaacaaaagtggggaaggcaggtggtcgccggtttccactctggcatatatttaatgatttagccaaataccacgttgttccaaaagaggccgcctcacacaagtttgcaaatcccttccctgggaagtcagcatccaatgactggtctctggataaattcaaaggccctgacatctctgtaggggaattcagaaagactatccctctgcagagctccagacaggttgcctttgtgaccactgtgattgtacttactggttccatacagtaaaggaaatagctttttgaactaatgtcctgggcatatagtaaggtagaatacacatgaaggggaaatggccacttgtggccacaaccacaaaatagtctctacaagatgattgaaatgcaaaccatcaatcattcttagttctcatcctctttaatcaatgaagtatttgacacaactgatgaactgctcttaaacatactttcttctatatactgaattatgtacatgttaggtaatttgctagtagttccttagatatttactttttgtttttccatatacaattttaagaagagtttattaatatagttgcctttttgcctacatacacactcagaaacatagtagtttatgtacataaatattaaatatgtatttatcagacggctgtattatgtcaaaagttacatatacttgaattgttataatttcatattatcaataaataattggtatgagaaagtaagttatatagttggttcgaatagaaggagaaagtataaagaaaaattggattatttacattatttatgagctagattaatagttaatttacaaaacagaaattgaagaggtatttgacaatagtgaaacatgaagacaaaatgacgtgatatcccataagagaaagctaaggagatacacaagcaaaattcttacgctcagggtaattatcatcaagctatttcttattccttttacaagacagagtgttagccattgataggaaaaaacacattggaaagattaatgaatgtaccttattgttaagataaacaatattcagaaaaagtcattgaaagaaatgaaagatttctaaacgtttcatttatcaactttgaaatatatttttttctactgaatttctcattgtttttatttatatatcttacatatacatataaaatatatctctatccttgtctttatgttcccccattgacaattggggtcatgtttggtagcaaaaaaaaatgactgttatgtactattcaggaaaaaaataattttcttataattctttgtcagtataaaaacaaagggatcagtaggaaacttctcagcagcaattagtgagatgcattttgaataacacgtttctggggagcaccttttggggctactctcaatctccatgtccctcaagatgaattatagcatcagcatttgtgtaatggagtgtgaacacaacatatcacaaagcaatcaacacacaactagaacaagctggtttggaataaaattgtaaagttagattgcagttgaaacaaaagtactacaatttattctgtgtgcagtttgatgacctaatgatgtgaatccagctcagcatttggacaatcttggaaactgacagaggcaaacattctattattgagaggaaattacagaaacaatacgcaagatcaacagcaacgggaccggaagtgtgtactgaagctttagctgcatccattggaataaagaaacaaaggaaacaccaaaaggcctagacttggaaggagattcaactctggagataatagagttagcatactttaaagaaataatgatgggtgataagttttcattaaaaaatatacttcatgtcatcgatcatgattaggcaggtgtctgtgactgcataagcaatgctgcattatttcacatgtgtgccatggattcagcaacagaatagctccttctcttctcctgggaccttgttgttgacatgacttggccctttagagaattaactaactcatattggctgcatttttgtatttgaataacagggtatcatagttacatacatatcaggaacctcaggactgctgatgttgtaatagttttttgtttgtttgtttttaaagaattttttcacctaagactatcactctacttctttgaaagctgtataaacagagtaaaccaaaaacagaaaaatgtcattcttaaataaagtaagatatttccctcattatttttgcataggcacagctgaaatggttttataaaagggtgaacaagtttgcctgaaaaacacacagactaagtggtttcaaatattggagtattgtagaatgaggcttattttggggaaataattcatagaataactagaaattatatatatatacgtttcatttgttgattcccaattgctttaaaaaacatttatgttttgcaatattcatatttagaggtttaagtaacaaaacatgttgttttgttgtatgtacttggctaaaattttggagataaatatgtggatttttgaacatttaccgtcacctgttttaatgggggttttggcatattgagtagtatactgaatcattattaaattatgttcaagtttaatgatagaatgtagattatatacttgtttaacatgttctttaattgcaacaaaagaacgccaattctaaatcatagtaactcctaaattagagtaatagtctatgaactggcaatagctatccatactttatcatgaacacttttgaagtaaacaggtacgacgtgacccacttaaaattgggtctggctctttttgttccttattcttttatcttttggggaataatgctcatacaaaatagcagttcagagctaataataaatggacagaaatgattctagattccttaatcttaattgatacatttttaaaaaatcataatttctataaattttataatcaaagaacatcctttgatttttcactatttatatatcccgacaactgtgatattcaactgtttcatccatatctattgattccctacggtgtgcaaagcattgtgctatactttgataattgctgcattggtaagtgaaagcctcgtctagtttccttcaatctgataccttcaattgtccttttgatcctatcactaaagttcattccttcatttttatgatataatgcatttttcctttactttataaagtatg

SEQ ID NO: 471374 - DNA, 639 bp, Homo sapiens
ccctttcaagatggttcgtgttgaccccgataggtcttgtgttggaggggcaggcactgggggttgctggtcgacccgcatgttgccccaccacagagcatccagggctaagagcgaggcaagagcctcctccgagcttaagctgcaggtccaagctcccacgaacagatggggagcgaatgctctgccagcaggcggaacaatcctgctaacgctagggacatcctggaactcgacccggtgcacagcggccacttctctctctcacgggagctccagagaacaagtgcaatacataacatccgccgccaggtggagcccgacaaccggcgcaaacggctgcagtccacgtcggatcgcttttcagacatgggtgggtggagagcactctccctacgtgactcccagtctggcccgtggaaaagctaaccgcgagcctgcgggccgggcgccctgccaggccgggctttccagagcctcgcaagtggacttagaaaataccgcgccctcaggagggaagagttagaaatattttgttattataaaatacttgcactactcataaagcaatatagtattacttgaaagtagacttgtactaatggtaaatgtacattgcaaaatctagggcaaccaaat

SEQ ID NO: 471375 - DNA, 840 bp, Homo sapiens
cttctctcattccctgcactgttttaggagcctggtgcatgagccgtgaagtcctcacgggacatgaggccaggtccacagcccaagagggtgagcgtccactcagggacaagaaccaggtccacaacccctagagggtgagcgtccactcagggacacggggccaggtccacagcccgagaggtagtttgaacattctctttgaaacatgaatactatgcacaggattcagaactggtgacatctgaaaagacgcgagcttgaagggaaagaggaaagtggatgctgttagttcctgacagctggggcttgtcctctcggtcagagccacctggcaacacggagagggagcccacttcccctgagccgggatgtagatgggacctgttgatgtcaactgccaatagcatggaagagagcgtgcaggaacaggagagagaacgcacaggttttcctcccttttcctgtgcagacctgctccagggtcatacaacatcgagtgccaatcagacaaggttcaccccgtggatgaaaaaagagctacagtttgaaaacctagtgggaaatctaactgactcatccctgccttcccaagtatgttctgggcctgttgtacccgcaaatacctctgccgtcctgcagatgggcctgagtgctgtaaattcccatggggtggggagacatgactggtgctcccgcagtggtaatgccactgtaggcaactgagagtgacacacagttaattcctcagctcattcacttcaggtcccgaaacagtcaccaggtgacccttctgcaaattggagcagcttcataagcagaggagagaagaagcttgac

SEQ ID NO: 471376 - DNA, 937 bp, Homo sapiens
agcccagcagtgtgacgcttgcggcaaaactcacgactcgagcttccaatggcaggagtgaagcacaggaaactgggctgaagctcctgaacgttgttcctgcccgggaggacgcctgcagccgcgctctgctcccacagcagctccgcatgggctctgtgaccaccgtcctctccccggcacgggtaaggggcagcctgcagaatcgcctgggtagcaccaagcgccacgcaacccgcagggcgctcgcagatggaggccacgcggcctgcagagaagcccctctggctcggttgttgattgaaccctgggccccagggaagcatgatcttcaccttgatggcaccggccagacttttatgtgcagagctggggatggcaaatgtgacttccctcacacacatttgccccctgcctatctgccaggggtcagtttggctgtttacccaggaggaaaacaaaatgggtttggggagcaggttgaatcaacacttcacttgaaaataaagttccaggttgaaatcatgtcttttcagaatttggaagacattgtttcatcgttctctagcatctaatttgtttctgtaaagtccaacgtcattctgactgctgaacttgttaaagtaacctgtgtttttcctctttctctttctttctgggaaaccctaggaccttacgtttaccatcaccattcttaaatgacacagcagcgtaccctatgtctgtctattcaacaggaggatgctgaagtaacacgtgtctgcgatctaccatgtttaaccaaaactctgatttgggaacctgtgatgttttaaaaaacggatgagagtcacagggaatgaaatgagaaggaaaatttttaagagaaaagaaaatgggaaagaaagacagaatggaaggcaggaagtaaaataacatttagattttaagtttttcc

SEQ ID NO: 471377 - DNA, 899 bp, Homo sapiens
acctgtctgctgcgaccatgagggcatcctgggtccttagcacagaataagctcaactactctatgaaccacagcagtcacggccacagcctcattcacttagagcctgggtaaacgatgctgcctgaggatgggctggctttcacaagagcctcaccgacacagctgccgtggtctccatattggtgtccccccagaattcccatggtgggctcgctggaatcacacgagtccttcaaagtggagactccttcccagatgcggttgagggagctgtgcccacagaactgtcaggagatgcagcgtggctggctgtgcagatggaggaaggggctgcaggcggaagcaggtggtggcctctggaagcctgaaaaggaaaggaacggattctctcttagagactttaattgctggtaccgagagaggcatagcttcccagcccgtcattgttccttgggccacgaggaacaatcaacacagtggggagagttcagattcctctgcatgtggagagcagctattcgcatgtcacctgtcagttgcatggtcctccccctgcctactaacggctgagagccagcggaatctttcatatccttccccttgtggcgaaatgtcaggcatatcctgcgactttgcagagttttctatgtagcaattttctgtgtctcaaaggtaagcctcaaatatcatggaatcatcaaactgacagaactagagagaacattggcaatcacttactctaaatagaataataaattgggcctcagaaaagttaagcaacttagcatgcaacaactacataataactaaccgtaagagccctgggctcctggctctagacttccctgaattctcattctttggtgtcattctgaagaacagctcctgaagaatcc

SEQ ID NO: 471378 - DNA, 1169 bp, Homo sapiens
gcctgaccttttcgctcctaagctaaaatattatgatggcttgtcaattcctgcactaaggatttaaacatagaacatgtgatacttaagatgtgcaaaatgggagaagtcttgctatggacacctgcggcgggagagcctggggtgtctaaactgcgcattgatggatcccatgagaaagccccgtcgggaccgtggggagcgccaaccgcaagcgtggctggggagggaacacggggcactgcaggggcagctctgggcgctgagaggcaggtccgggcctggaggggcacgtgggtggctgggttcccaggtgtgctggcagccctggcagccctcgctcactctcggtgcctcctctgcctgggctcccactttggcggcacttgaggagcccttcagcccgctgctgcactgtgggagccccttcctgggctggccgaggccacagccagctgtctcagcttgcggggaggtgtggagggagaggtgcgggcaggaaccggggctgcgaacagcgcttgtgggccagcgcgagttccgagtgggcgtgggctcggtgggccccgtactcagagcagccagccagccccgctgtccctggacagacctgcagcccaccatgcctgagcctccccctccccgccatgggctcctgcgtggccagagcttccccgacgagtgccaccccctggtccatggcccccagtcccatgaccccccaagggctgaggagtatgggtgcatggtgtgggactggcaggcagctccacctgtggccctggtgcgggatccactgcggctgctgcagggagggcgcactttccccaaggcggaagaaacgggagagcgcaggtctaggctgattgccggcgctgcccttgcgcgcttgctcacgggcctccaagatccttgggttggctctcgccttcgccatcctggaggggcgggacccggggatgaacgggtgatgaggaaagggaacaagaaaaagatgtgaagggaattggaaaaacgagagacagcgcctgtggcggaggccgcccagttgtaacgggccttccctgtcctgggacagcgcagccttttcaggttggcttcttccactctgcactgtgcattgaagtttcctccgcgtctttgtgtggctcaatagctcatttatcttt

SEQ ID NO: 471379 - DNA, 634 bp, Homo sapiens
tgggagtggggaatacaaacgtcttattttcttttaaagtactcctgtgtctagaccaagggccgttaatgaggtgtgatttgcccctacgggacatctgccaatgcctgcagacggtctggttgtcaacgcagggtgcagctgggccaggggaagctgctgaaaaactgccctactgggctcccctctccatgtggcctcagagcctccccaggtggactcccctgtggggcactcaaacggcccacctgttgactcaagaggccacggtggaagtggctggtcctcatcaagtgctctttgatttattcgaatcaaagtttgagattgcgaaggttcatgataaatgtaatcgaatccctccatatgcattaaggtatgatattcagatcagcattttatgcccgttgcctccagaggccaacagtcccctgagaccagcaagggcctaatagtaatgttcaccccacaatttgcagcctaatagtataatgcctagtttcatttccactcttagcctaatctcttccattggattttaatattgttttatatggaagtccccattagtgcggtgtgcacatttttatggctgactggctcctgtgcattgaaaagcacctgttctgaggac

SEQ ID NO: 471380 - DNA, 815 bp, Homo sapiens
ttagttttgacaagagcccagtggtatgctaatcgctgcttctgaaaagaatgtccgtattggagagatgatgagtctgaaacccaaaggggtgcctctgagtagaacctgcctagtttcctccaaagctgaggcagaacaaatagttcagttaggcccctctgctgcaggtatgctggagtttgctggaggtccacttcacaccctgtttgcctgggtaacaccagcggaggctgcagaacggcaaagattgctgcctgtttcttcctctggaagcttcgtcccagaggggcacccgccagatgccaagatgccctgccaagagaggaggaatctagagagggagtctggccacagcggcattgctgagctgtggtgggctctgcccagtttgaacttcctggcggcttttacactggacatggatgaaattggaaatcatcattctcagtaaactgttgcaagaacaaaaaaccaaacaccgcatattctcactcataggtgggaattgaacaatgagaacacatggacacaggaaggggagcatcacactctggggactgttgtggggtgcagggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaaaaaaaaaaattcagaccaagtcattaaacttttttgcttatggaaagtaaaaaaaaaaaaaaaaaaaaaaaaaaaaaagtctgttgctagac

SEQ ID NO: 471381 - DNA, 1296 bp, Homo sapiens
gcacctggagaaagccttgccatctgctccctttggacagcctcaagtttgcctctgctggaagcaaaggcagcacatacatgggcgggaggccggagggtgcctgaccaattcaaggcactgcatgtgaaccagtgccctgaagcagtgggagtgatggacaaggatgtggccggcggggtatgaaggtcaggcagggactcaatgatgacttaggccttactctgaggaacaaaggaagccattcggataagagaaatcctcatgcagtaaagtcttcaaaaatgttacagactccaacgagtcaatatcctgaaggaactgaaagtatggcagaggcgtcttcctccgtgtctgccaccaccacaggcctgcaggttgtattgccaggctactgccagtgttcactcaaggcccaagggctcttcagtcagcttatggcaaatgtggtcaggcctgaaactcacccttcagggatgtgggttcccatatggcccagggcaggtctagaaatgctgtccaagagcttagcctggtactccaagattcaaaaatgggcacgggctctgcctcatggagtttatgagagaaggaaatgagagaaaacaaaataaacaccagaaacaagcatggtttagggcaaatggttaagcattatgtttggggcatattgaatatcactttaaggcatgtaagcagagacataaagtaggcaattggatatatgtgtcagaaattcagagaagtttggactgaaagcatatgtttgaacattatttaagtaaagaaagaaaataaaatcatctgatgaagctgtctaagaagagaatatagaatgaaaagagatgatgttttaggagagaaaattgagaaactaatatatttaatactcaaggaaatggggaatgagaaggactgaggggcaacaacaaggttttgggaaaaaatcaggaatattcgtgttcaaagatgcaagagattcttctgaaaagactgtttcaaaaagaaggtagtgatcaactatttgaaatgctgcttagagagatcagctaaagtcacactgaaaaatcgccatttaacttattgacatgtaaatgcgaagagataaccctgaagtcagattttaagcaggttgagtagtaatggggagggagaaaatggaggcaaaaagtcatgtacaagtcaacatagagtaaagtatgaggcagtaaaaaatacctttaaaatttcagcaggcacactattgcaagggttgattttgtgctcaaactaccgtgtactgtcagtcaacttcac

SEQ ID NO: 471382 - DNA, 1609 bp, Homo sapiens
gccccaactcccgtacaaccgagccgagcaacatcgacgtgccaatgtcaaaagagcaccgcgcgacacctgcttgaagcccgcgcccgccttgctgcaggtgttgcccagccgagggcgggaagcccacgcgatgcggcgggccgagcatcgccgcgcccttgccaactagctgcgtcccatcaagttgcacgcgcagctgggcgccccggccacacatcgcctcctgtggccgcgcgggcctgcgcacctcccgagccacccgcggtccctacccctacgtgcgctcttccggacatcaagccagaggacgcatgctccagcacagacgcactggacatgtgatactgcccgccccgccccgcagttccacggctgcacgtgcccgggcccgccatatggctgtcgcacaccccgacgccaagcgactcataccgtgcggatccccgggcgttctactgcgacgacccctgcctgggccccgtgactacgctgagcgccgcagtctgcccttcatcgacccgccgggccccaccagttcttctatacagaggaccccaaggcttccggggcagctttgcggccagtcccggtccaaccttcgacgcctactgccccaggccctatccgtcggaggagctcccagggcccagtccaagtccaccccggctggccaccgacagcgccactactcgtgctcctgggacaacattctggccccgggcgtgccgagaccagtggggccgtgcgagaccagtggggccgtgcgcagctatgagaacctgctggggcgtgaggtgcgggagcgcgagcgaatcccccgaagcttggtgccacctgtcgtcgtgaacctgtccacctcgcccagacgctatgccccactgtccctgtccgagacgtcgctgaggagaagggccgcgcgggtgagggccgagcgcaactggtacgtgatgcccgagatcaccatcactgacaatgacctgcacgccaccgagcgcgcaccagggcctgggacgttgcccggggcgtgcacgcggccacttcctcatgcggcccccgacggccccacctctggccgccagcgcactcctagagcagctggacgagctcatcacggacctggtcatcgacttgcgaccccccgccggccacctcagagccgcagcccactgcctgggcccccaactgcgccaactgctggactcgcggcccgggctccggggccccgcgctggtgccgccacactcgcccccagcctccaccggcatcacccaggagcccgcgccccgggagaggcggctgacatgtccccggaacccagcgccgacgaagacgacctgatgacctgctccagtgcgcgctgctggcacacagagaccatgttcaacgcctgcctctacgtcaacttctgccacagctgctacacctactactgatcacgccctctccccgccgacgactgggacgtccacaaggcgcgctgcgtgtacgcccccctcggcagcgtctcccgcacatgctgacgttttgctgtcccactccccggctgactcgctttctcccccatgctcgtctcggcctcctctcgcccagcacgctcccctcccca

SEQ ID NO: 471383 - DNA, 515 bp, Homo sapiens
ggaaaatattttcttaagatctattctcatgaggcatcacagtgatgtcctgactgctctacactgggcctgtgccaatggccatgcagaagtagtaacacttctggtagatagaaagtgccagcttgacgtccttgatggcgaaaacaggacaactctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaagggtgctgatccccccatgcagctgaaaatctgctttataggaaaatctgtttcttttgactcttccaaaactctacaacattctactgttgacctggagcctgaaaaaaggtgaaagcttaagcagtcaattaacccatagtttctattttatatgtactatatactgtattctt

SEQ ID NO: 471384 - DNA, 592 bp, Homo sapiens
aaaggggcactgacttccaaggagtccctggaagccgggtgtcaggggaagatgaaaccagagtgtgcggtgcagcaggacaggtgtcagagctgggctgagctggactggtgggggctcaggggtgcttttgcgctttgtcagcactgggtgtttcggagaggagcctccgcagccagggatggggcgtgttggaatgaactgggcatccttcgggaagacttaaaacagcgtgtctgcagcagaaggttaagtgaaagcacagcctctttatctgccttcctggcctgggaggaagacctctgctgtgcttatgccacctgtgaagagaggctagcgcagggcctttgtaacactccacagagctgtgagctgcctcttaactcctttgttactatggctgtctctcttagagcagtgtttttcaaagtttgtggaggtgtaaagtatgtgtcttactctgggtcatgaaaatatcttgtacaggagtataagcttttatgagtagggactaatatagtttcatatatttttatatctttgaatcttttgctatcttattgcaaagcatcttgcacagaagaggtgtttg

SEQ ID NO: 471385 - DNA, 728 bp, Homo sapiens
tggacctctagcaaactgcagcagacctgcagcagaggggcctgactgttagaaggaaaactaacaaacagaaaggaatagcacgtccactcagagaccccatctgaaggtcaccaacatcaaagaccaaagcaaggggacaacactggatggagaatgagtctgatgaattgacagaagtaggcttcagaaggtgggtaataacaaactcctctgagctaaaggagcatgctctaacccaatgcaaggaagctaagaaccttgaaaaaaggttagacaaattgctaactagaataatcagtttagagaagaacataaatgaactgatggagctgaaaagcacagcacgagaacttcagattgaagatcaacttaatgaaataaaatgtgaagacaagattagagagaaaagaataaaaaggaatgaacaaagcctccaagaaatatgggactatgtgaaaagagcaaatccatgtttgattgttgtacctgaaagtgatggagacaatggaaccaagctggaaaacactctcaggatattatccaggagaacttctccaatccagcaagacaggccaacattcaaattcaggaaatacagagaagaccagaaagatactcctcaataacagcaactccaagacacgtaattgtcagattcaccaaggttgaaatgaaggaaaaaatgttaagggcagccagagagaaaggttgggttacccacaaac

SEQ ID NO: 471386 - DNA, 592 bp, Homo sapiens
ccggctggagtcacccggaccaggatggattaccagcagcttctggaaacttttggcacccctaccattctagctcacttggggaacatgtacgtgcatgtcctggaccaggtggctgtgcagctcagagatgtcagggaactccctccagatgcctgggccacgctgatttccacttgtcaagtaacttctgtcatcctgtccctattctcactggaatttctggtgaccatcagagcaatctgtgcctgtgaattttctgtctctcctgtagctgtctacaaggcacatggaggaggttatccggtgaggaagctagggcatagcagatgtcagcctcgaggcaacatccccgagtggggaaggacccagacaaaaatctgcaaaacggcctctaggcagggacctagacaggcagatcctgtggccaactggggagtgcccaggcatggggacaggatagctcctcacagactgtcctcagccaccatcaggccatgttgaaaaccaaatgaagtctgctaaaatgacttaggctttagtctgaaatgcattgcactggttatcaggaaagtttgactgtcagaacagg

SEQ ID NO: 471387 - DNA, 766 bp, Homo sapiens
tcaggaaatggttatcaattgatatcctgctgtgctgtttacccgacacatttctcccctctttcagccacatgcaaagagcagcctataaaatccagccgcagacatggataagcaagctggaagcttgcacaggtgaatgccagcagctgtgccaacaggaaaaggctacctgggggccaggcatgttcaacatggaggctccatcttccctttttgtcaaccacgtgtgcaataaagaagcaggcaagatggtgctggccaggtgcacactaccaacttcttatatttgcacacggcaaagagcagagagaagcaagctctctaagcattcttttaagggcactagtcagatccatgaaacgggagccctcatgacctcatctaatcctaatcacctcccagaggccccacctcctaacaccatcacattgcttcagcccactggcttcatttctggaagattttatggggccaatgttcagctcccaactcctgaactacctgtgctaactctggggaatttgtattgggcccagactttgttctctggctccttgaagttaagaattcactgctctggggggtgtaaggtgctcgcagaacgttggtcactacactccaatgggtggtgccagccaaagagttttatagtgcagtgacagcaggattctcatttgcatgtgccagcagcagcagtagcagcagcagcagcagcatagtggggtgcacactcatcaactgcagcaaggtgctagtgggtgcc

SEQ ID NO: 471388 - DNA, 557 bp, Homo sapiens
ttaagaaagtagccagatgagaaaggctggacagggatgcgttgcaaaagcagtgatctagcttatcttgccaccacccaggatggcccaggatgtgggttctccttgaatgaatggagttttcccaacattgagaaggtgacatttctactccccgttgcagtctgcacctctgacctgtggtcagcagacaggacagaggcactcagtagacagagctcagaggacagcactcagtcccggcggaaggttcaatgtccagctttgcacccaccccatgtgaccacaagcaggctccatgaccttgtgggtcagtttcctcaccctgttcaggaggaattgtactaccatcctgttaggaaatttgtgaggatcactgcgttactcatgttgtcttttgagagcaagagaggtcccttcacataccccaagaacttacctgcatttgcccacatagtctccatttagaaaatgggaaaagtcacgtctgcctacctgccaatggggtaagagggagaaaaacacttgtaataacaatgtcagaattagcatacaaa

SEQ ID NO: 471389 - DNA, 896 bp, Homo sapiens
aacggaagagaatcatagtccaggcctgtgaggcccctggagtttgcatccgtcttcctagctccagacaagtcacttcctacagtgactccatgaggatgagtttaccacaccagaaagtacaaaagctcccagatgagaggaaagagttacctgttccagtgatccaaaaggatgccagtgtgaatgttcatgatcaggaaggaaaagtaacagggaggacccttagaaggctgctgccttctgtggtgcaaggtagaattggggtagccttggacctacgtcaatggagacatcagtggaaagtggagaagggctggattggatgtaagttacatcgtggagcacttagatcaagatatgaatctgagctcaaaagaagaggtctccatctgaggattaaaatagtctatcaatgcggagaccctgaggaagaatgttccaggcagagggaagagcatgcctgtttttggcatacgatttcttttatacagaagaaccattctgcagtacaacacccataaactctgagaaaataaatgggtatgaaattttatagcttgatttccatccctggaatgattgaaatagatattacctgcacatattatgttagaaattatattatacatacccagtaaaaaaaaaaaagcaaaactgcatctcaaaaaaaaaaggcattcatgctttcataaagattgtgtttattgtaatgaaatgttttatggtgcaagtcatttgtggttatttagagtattaaaaaacccatggattttcagaattgtaagggacattagaggttacgtcttgaagaaccctcttcttaatgcttaagttttctacattaccattaataagatatcacttaatttctgctaaaacacttccagtaatgt

SEQ ID NO: 471390 - DNA, 1191 bp, Homo sapiens
cattttctgagcagtggtgggttgaggaggcctgttgcattaggtggatgatgggcaaggggagcccatgtacactacacatcactagagcactgcaagcccagttgctcagtgttgcaaaggcacacagggcaggcatctagcaccggatgagggacatggctggcccgtgtcgtgtgctgaatggtgtgagaagtctgccagtgcctattaagctctggtgtcttgcagcagacttaaagggagctgatgctggcaatgggatcagagtgtttgtacctgacatcgggatgttcattgctagtctgaccatctggctcctctgtagaaacattgttcagaaacctgtgacagacgaagcagcacagagaagtcatggatctatttattgtcttctggaaagttttggtatttatcacagactagttaactttgagtccatgactgactttattcccccagagtcttccagccacatccctggtcaccagcctcaaggccagattgaagttctgttccgctgcagggacagcttacagctccagcaagcaagactgcctgttagtaaacatgcgagatcatttcttgcaaggaatgctgacaggcaaggagatggcatagatctggaaaggcagagtggtcttaggggcagcagcacctcgaggagggccatctctgtattccctccaggaggagggcagagtgcgtgcgtggcaggccagctgcaggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggtgagtgtctcccacactggctgcacgtagcaaaaggcacaagcagtgctttggtgaatgagagaaatggttgaagaagaaatgaaggaaacagtctgttccaccacatgaatatcataactgtagctcttgtaaaactggccacatgtacaaaccacacaaaataatttttccgggttagttctagttttgatgtttttagatggtttctgttaacctctgcaaaataatctttttctatatatgctaagc

SEQ ID NO: 471391 - DNA, 2050 bp, Homo sapiens
cttcagttctggtgatgctagctttggaaacgaatgtgcagcagcctgctgagagaccccacaaagccatgccatcacaccgatgccaccaggaccaagccatcatagccatgccaccacagcaatgccaccaggaccaagccatcacagccatgccaccacagcgatgccaccaggaccaagccatcacagccatgccaccacaccaatgccacgaggaccatgacaccacagccatgccaccacagcgatgccaccaggaccatgacaccacagccatgccaccacagcaatgccaccaggaccatgacaccacagccatgcccccacaccaatgccaccaggaccatgacaccacagccacaccaccacagcaatgccaccaggaccatgacaccacagccatgcccccacaccaatgccaccaggaccatgacaccacagccatgccaccacagcgatgccaccaggaccaagccatcacagccatgccaccacagcgatgccaccaggaccatgacaccacagccatgccaccacagcgatgccaccaggaccatgacaccacagcaccattaccacatcctcatgaccacatcatcataactagagatagagagattgctcaacccattagggagcacaaatatcaaggagagtcagaaaattcaacattcagagatcgactggaccgccgccggcaggaacttagtgtagacgctgtgagtgaagacagcaacagcaaagatgtccttaattaggaccgaaataaattctgatttgtaacatagaatatacctaggaaatcactgtagaaatttccttctttatccactgtcaagttagttaaaacgtgctttcagcttgaagaatgttgacgcataagtgctggaattccttcggtaggactgaaaccttttgtgtttcaaagcagattacattgttcaagccagaagatgaaatgactccagttactctgtcctcattcactgaagattttaaaataatatttaataaagatgtccaataatttgttagtgcaacgataacctaaccctctttaaaaaaaaaaaacagtaataaaacaaatcttgagagactgttttccttcgagttcgcaaaatttatttcagtgtagaactatcaacttttcacagttaagaacctcattcattaactctttaatatgaacgatttgccttttattacttagtgacaaagttcaaaaacatatcaatcactgtgaacttagacttgggagatcttttagaaaattgaacaaatacaaatagtgttaggatagaaagtatatctttcaatggtcagagccttacaaggaggttaaatattactagaaaaataagaatgtaggtatatatatatatattattgatatatgattatttaaatacatcattttacatttagcctttctcctcataaatattttgaatgttctagtcaaaaatataatattcaagacattaaaattggtgacgaagtatttacaaatattttattataattatgtgtttctatagatatgtagtagcttcaatactaccttaaaatttatttaaataaatatatttggctgtatatttgcacaatcgtatgtgttgtatttattcttatgaaagaattattaaatcattttaatgaatggtatgtctttaaacctttctgcttagatatcagagattatcattgtcgtattgaagtgcagcgttactgaataagaaagtgtactctctcaaaggaaggttacgttgtcagttaggatggacaacagaataagtatttttctgcaacaaaaagggactataaatcaagttattcttagcctgtgattagttctgtccttcattctgaatttcttttcttgtgtggattcgagtcaacccataatgttattttaatttagttttttgtatgtaatacatgctcccgtcaggtaaatgaacttgtcatgattgaattcaatagattataatgaccctttatctgcattgctgagcgttagctcatagtaggcaggactggcttaagc

SEQ ID NO: 471392 - DNA, 1857 bp, Homo sapiens
cctggagaagcgcacctggaggagtctgctgagatctgaaggatgaggctgcgggaaagaaggaaagagggagagcagcgtggtccaggaagacgtggcacgcagaagaaatgtgtggaaggctgggttgggggaggcaagaagcacagaggtgcccttgggaccatggacaggacctgggcattcaccctgagggcagccagcacttttcagtggggacagcagaaagcaggcagcatggtgagcagaggtgcttttgaagaatgtcgctttggctcctggatgaacaaccaagggtggaaagtaaatcaaacaggtcagtgtgaagagtcgctgggcagcgctgggggcccagctcacgtgtgcggtcaggaaatgtgccacagctcagatgggctgaaagaatggctacagtgggatggacccacaagcccttccttggccttccagccactgaacagaagagctcctcctcttcctcctccactttctcctccccatcgtattccccttcctcctccgcctactccgctcatcttccccttgctccaacttcccttccacactcaacagcaacctgtgatcttccagaagatagggacttaggttactttgtgttctatcttctgccacacgtgaatattactcaggaagaagatattgaacaaatatttcatgagtacaaggatgacattcgctatgtttaaggacacaggatcatttcttgcgttacaagcaaaggaaaaaaaatagctctccaaatagaatagttcatcttgatgtgtgcaatttaaagtgacttaactctttgacagttaagcatcagcattgaaatgtttctctctcaggactcgccctcctgccaaatgcttcatttatggtcaatttggtaattgggggcgagttcatctgttcctttaatagcgcttgctgaaattccggagccactcatggaataaaactgttgtgcacagcctcatgattttcaacatttattacacccattgtgtaatgtctcttcaatcgtaaccatttttataagtttctactgattctttctcctatcagctctttggaagtgattctgtatttttaccgtcatcataattgtgttgctttatcagtcaacataatcacggctctcaagtctttacaatgagtcaatttgactaattttattttagaatgacactgtgaggtagcagtgtgccatcattcatgcatttaatactttgcaaaattattccagagttgatgtgactcatcacactaggaagacacttggatgactccttcctaaactaaagggtaatttgatacccttaacttacaccgaaatacgtgcttaaaacttttcagtttttaggttaacccacaatatcataattaacaggaaagaaatcacctttttaaactatatatttaaaaattggtttatatgtagaaacagaaaaaaattaattataatttgtttcttaacccttcccaagatgctgttatctacaaataatttttcttcattcagtgtaatatttccttaggaaacagtgtcattgcttaagtaaattatgaaaatgtacaatagttatatgaagggttcatactctttttttctggtattgaaaaagtttgagactgatcttaatgtctgtctacttttcaaagatgaaatcatattattttccacttaaaaatcaatatttatatttaaaatccactttgattttaatcagttaattaaatggagaatagtcaaaggaagaaataatgaatttactaaatatgctgcaatgcaataaatatacattttctccatcattgcaaattcattccttttttccaaattttattaatttc

SEQ ID NO: 471393 - DNA, 898 bp, Homo sapiens
ctccttcagggagcaccagcagatggataacactggagctcctggttcctgggtttctggattatggggcttcccccagcagtaccccacttctcagacctgctgcctcagagtgagaataaccccattagcttccccagttcttcagactatgtattcagactgaataccagcaccagctttcctgtttctccagttcatggacagcaagttggagagacacttcctgaaaaccaagctctgaaatgctccttccctgattcagtgatgagcactgactccagcaaagacagaagtgatgctctgaatgattccatggggataaaatgcatattcaaaaaatacaaatttaccataattgccctgaaatacagcaagactcctagcacaggtggaaggggtgaagaggagcatgaagtatgtagcagattctggaatgtccccaaagccactgtcattacattcttacctgcccatcatggagaaggccctgcggaccagtgcaagaccctctatatgagctttatagtgtcctctgaagtgttgaatattttcggtgtagtgtgtggattcagtcattctgcgcaaactcttcctttgtccccaacaggctccaagttaaagagcctttctaggagatactattacagcaaaatagataccttgatgggtagacgttaatactagagttaaggttttagtgctcagagtagggaagcatgatatgtttaggaaccccacttcataattttgcattaatgaggctaacttttctctgaatgtgctacctttgcctgaacacaggtatgcacctgattagcttgtccaaatattacacacaggatggaaagagctagttgtccaaccaaacacatcttgtgctatggctgccctgtat

SEQ ID NO: 471394 - DNA, 862 bp, Homo sapiens
tgacatccagactaatgatgcccctggctcaggtgaacaagcattagacagctcagaaggcagactggctggggcctcaggatgcaagaatggcacagaggtgagttcttggactcacctcagggcagaggactccagcaatatagaaatgctaacaggcacaaagaaagccctggcagaagaaaggagcagcctacccagacagaaaacttagacagtacccactcgactccagccacaacacatgcaaaacactgctgcccttccccatccacacaagccagatggggccccagactctcacccccacctggcagtaacaagccatcagtcacttctaagccagagcagtatcaaaggaaccagctgcaacagaaggttccagagaagtctgtcattaccgaccttctgaagcctacttctgtcaacttgtcaaagtcattctctctccagctttgttccgttgctggtgaggagctgcgatcctttggaggagaagaggtgctctggtttttggaatttttcagcttttctgctctggtctattggattttgatggaggtccactccagaccctgtttgcctgagtatcaccagcagagactgcagaacagcaaatattgctgcctgatccttccgctggaagctttgtcccagaggggcactcagctgtatgaggtgtcaagtcggcccctactgggagatgcctcccagttaggctacacagggggtcagggacccacttgaggaggtggtctgtctgttctcagatttcaaacaccatgcttggagaaccactgctttcttcagagctgtcagaaagggacgtttatgtctgtaaaggtttctgctgccttttgtt

SEQ ID NO: 471395 - DNA, 489 bp, Homo sapiens
gaggccaccacatctagggccatggtgctggaggcgaagccttggctgcaagtcagcttcatcctgtaccgccccgagatctacgatggagtcttcccactccagaaatttccaggcatttctcctggtcctaaggcagacagaacccaggcgcaaacagtccagcctggtccacacgacaggaatagccctcctgaaggtggacgtgaaagcttggacaaagctgtttgtgtccaaggagaggaaaggctaaaggattctgaccgcaggagcacccatcccgaggcactcaccactttccaccatgaccgccacaaacctggcacagcagcactcggcttcagcgaaggtgctctgaagtccaagtctgctccgcgcatccgggctgctctctgtcccagcctgcgctgcagcggcatcacccccacgctgcggggcaatcccaactttcccggcgattttcagagagctggaaagatgtgaatgggg

SEQ ID NO: 471396 - DNA, 563 bp, Homo sapiens
gcatcaaggcagaaagaagatatttgatattatgtcttgttcctctggcccacagagggccggctccttctctcctgctccacccaatgctccacccatccctcactgcagcttgcaggtggaagtagattcactccctgagctccagcacaaacctccagctggccctgtgggaaatgtcaggcaggtcgatgagaatagccaggacccagaaagtgctaagtggcccatgcctatggagagggatgcaagaacttactgctcacctccccagtggcggaaagtcactccccttttggatctgacttcaggtttctcccttgagcatcatcctttggattcactaatcatgaaactgcttagccctcctgctccacgtctctgggaagttagaagtattcatcacaagagtttttctcacttttctgcatgcaaaatgtcagttatttcatatgaaatttaagacctacttttcctaaaaagtgtttaagtaaatagactagtacctcaaagtgaatttttagcaattttaatagttggaattttttaatatgcttattttt

SEQ ID NO: 471397 - DNA, 1216 bp, Homo sapiens
ttgaattaacacaggtaaagtgtctggcatacggtgagcccttgaatgggggagaaggacatcttctcaagcagcaagtgtcccacccaacacggatcccagcctccgtccccagcctcctgccctggcgccgccgcccccgcagtccgctgaaaccggaagccccgggccagttcaagacaagggcgccccgcacccggcgcaactcccctccttccacgacacagccctgctgctgtggcatggccctggctctcagcggggcggtccccttccctgctccagaaagggtctccagggcgagatctgccctgctttcccttgtattaatataagggaaagtcctggggaggaagctctcccctgccagcgtccactccagcctccaggagtccctctccgcaggtctccatctttcccgcgggttccgctgtgctgtggcgccctctgctggtgggtcccatgcagtgcgagagtgctcacctggtcctggcgtcctgaaagcccatgtcccctaccttcaagttcctccctctcccaagaagacagcctgcagagacccatccatatctgaactctgccttcaacactttccatctcaatctggtacacagcactaaactcctttctccaccaaagtgtggctccacctacaatgtgccagaggggagtgtggaagaggagaacagacagagctatcagaaccctgcctcttgccaatcaaatggcccgccactgtccactccctggaatgtagcaccacctagtggcagcctgcagcctgacagcgccgcaagtgaaatttcagcacagcaagtctttactgattatcaaccatacacaaggcattatgccaggcctttacagtggggaactgagccgaacacggtgcaacagaagcagtatagcatgatgcttgtgggtacagacttctgagtcagaccgtccagggttcaaatcctagctgtggcacttactagctgtgctattccaggctgctcctctgcaaggcctcctccagccatgctcctctgcttcccgctctggtccacaatcaggagtgtccagaatgtaaggttcgtgagagcaggggtccagcccatcttgttctccaatggggccagtacagcattcagtgcctggaatataataatgtccaaaaatgtttgctgaatggatgaatgaatgaattaaagttttaagaaagtaattcatc

SEQ ID NO: 471398 - DNA, 1155 bp, Homo sapiens
ttcctgtctaagcgggaatttcctggctggattattagcaattgcaaagacaataaagaaatgtactgtcaggtggtaatggcgctgtggagaaacacagggcagggtaaggggagagggagcgaaggggagtggtcagggaaggcctccatggcaaaggggcgttggagcagagacctgaaggaagtgagggagtggtcactgccacagtgtcccagggccaggggcggggacatgcccgtgtgtgtcccacaacacagctccatgactgggacagctctggggccagttgtgcatagtattgtcacaatagtagttacgccaatctgtttcccctggccccttgagccacgcgggggcaaggatgtgtcctgttactctcggaatctgcgctctggagccaagcgcagcatcaggcacctgcaggcaattggcacgtgcctgtggattaagagaatgaatgaatgtctgaacatggggaaaaaatgagcagatttctggacttgtgcaaggctgtggggaggagagaaagaaggaaagatgcatctggttttcgtattcaaggaattttcagttaattagagagaaaagacatgtacacacctgaaattaagacaacttaaacctagtttagatataaagttaaataactttaggtgataccttagaatccattaattccacattttatccaggatgagtgtcaaacacttccaagtcccttagatgcccctacatttactccaagaatactccagaacgtttatttggggttggcttcccaggctgcttcagactcatgaattgttccctggactctgagatccttacttatctgtttttaaacccaaactctctccccggagtgatgttactccctcactcagcaatggttgtacatcactgattcttcctattgtcttcctagaaagcatcatgagaaactgcttctgtatgtttttctccatttgcttacctggagcaaataagccgattgtgctgtttcttaaatattttatttatttatttattttaccaattaactatgtggttttaattcttgcattgagtttgaacaagtctcaaccattttcccttcagagattgcttctgtttcattcttttttctctgggattagaattgcatgtatgttc

SEQ ID NO: 471399 - DNA, 796 bp, Homo sapiens
cagctatcctgtctgtaggaacaacaggatgcactggcagtatctagtgttgagtgactttcagcatcaaagaagcaggaccatgtggatgcctggggatgaggagaggcaagtaaaaatccgaggtggaaagacactgaagacaaattcagttacaccacgtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaatataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttatttttaaagttcttttatttgaaaaaaagaattctatgtctcgtttatttacttctgccttttatgcgttccttctgtgaatttaacaagcagcctttttgctgaaatactgaatacagtactgagttctttatggtatattaaaaagacatgctagaaaggtgagggaatgcagttttagttaccttcaaatgtgaaattgaaggctttaagtgggttcaggtctaagatc

SEQ ID NO: 471400 - DNA, 929 bp, Homo sapiens
aatacactacccgatagagtttctttcagcagctgtttatagttgctctgccccaaaggggcaaggacttctttttgtttaatcttttctgcacatggtccctgatccttacatgcggagcagctcagggcaaatcacacatgtttcgggggacttaaaccttgtcttcaaacagcagcttcattcactgaggcgcagggctggccccatgggtgctttcaggggctctgggagtttagccagaccaacaagcccactgccagtgcagcagggcccatgggacagcctagcacttctctggctggctcagggaactgcatccaagaaagcaagaccacagaagagctggatgtggatagaacatctagaccaggaagaactcagcctggaggagtatgggagaaacacagcaacggaaaacctggaacatgcagagtactcttccatcagcgttctcaaggcagctgaatatgagtctgtaattacaagggaaacaatggctccagggcaggaaatgtgcatgaaatataatgcagctgagagcagcattagcccaaagtgctctaatggttttaggacctcaccaggtgctaaagtgggctccggcagaagaaggtgctttctggatgaaagaggagaagctggaagatgcccggcaagaggcctcggtccttcctggaagaccatgaagtccagtgcagctatcggtactcaacaccagaagcccagagaggaaagaaacaccaatgccacacatgtgacattagatcacctcacctgcacatcaaaaatgctaacttttggccctaccccaaaatctgttgggtatgggcctgtggtcttgcattttcaacaagctgtccagtaagaaaggaacatactgggcaaagaacttaatgtatgcatccatcgttagtgtgtacaaggct

SEQ ID NO: 471401 - DNA, 717 bp, Homo sapiens
cattacgtgattcatcaaattgatgaaaatattgaggctcatagagggtagagtacttgacaatgttacacagttagttctgaagttcaagtgctctatggcagcatacaaatcagtgaaatttaaatcatcaaagctaggaaatggagagagaaaaattacagcacgccaaagagaacttattcaagaagacctgtccatgaaacacaattcaagatgggtaacacagaacaaagagcctcaaatagcattaacgacatttgttgagctgcaaaaggaagtaaaaggtcaagaaaggtgtccacctggtagcaagatgatgggaacaggtccagctcatacatccattcaagtttacattcagcaggagattcaatctactcccccaacggctcaaacaaatacaattaataatgatgtattgttcttgaaaaatgctaagcaagcggataagtgctctcaacccaaaaagtgataactctgtgagaaagaaattctcatatctgccaaaattgttgtcaacaaaatcaagataaaatgttgaactgacctgatttcctacaacaaagaataaactattcaaggcaactagtacctgtatccccagtaaggtctgaacacaattctgcataagatgaatacacagccctggtgacacagatttggggatgataatggtgaggaagactcatgaatttgcagtggaaggaatttgaa

SEQ ID NO: 471402 - DNA, 720 bp, Homo sapiens
tggctcagtacatgtccgaaagcctcaaaaccagggaagctgacagtgcagccttaagtctgcagccgaaggcccaagggccccagggaagatgctggcacaagtttcagagccagcgtctgaagatcctggagtctgatgtccaagggcaggaagagtggaaagaagcaaacatcctgcacgtgaagaagaaagagccagaagactcagcatgcaaatttatctcatcttctcctgctttctttgttccagctgcattggtagccaattggatgatgcccacccacattgaggaagaaaagttcataaagcatggtgctcaatgtcagtgtctgaacatttatgtgcttattaccctttcaggaaaggagggagagaagaagggagagagaaagaaacaggaaaaagcaagagctactgggcaaggtgtagtacaaagctcattttaccttgaattctaccttgcctcttattaatattgcagacctgcttagtttttgtttgcatatgcaagaactaccttggctcatccttgtgttttaaaaatttccaaggttttttaggtttaaactttctttggtgccatatatttagactgtttttgtttaaataaatctgagagatttttctaggtagtttttttataaggtgtcccacaaaatgaaattaataaactaatgttttagactatcaaagaaaaaaggaaataggaaacaattc

SEQ ID NO: 471403 - DNA, 600 bp, Homo sapiens
agccatgacgactgagttctaactgtgaggttgtctgtagtgccccattgcgtttgcgggttaagaaagccactcagattaccgatcctatgaattctgagactgacgccttgagctttctagaccacccttctcttttggtcagacctgaggtgctgatggagccactggctcctgctacatctctggagctggaaaaggctagtgtttccaacacactggatggcagttctaagttggactggctgccgcaggatcacctgggggaactttataaagaaactggcttccaggtccacccttggaagttttcagccaaagctgtcttaatgatgctgagtttgaccagtttaggcaataactgttttttccaatcctttacttttacagcaaaaaacatgaaagccccggaagaagtgacttgtccaagtttctttgggaaacctttgctggttatgtttgactccgtaattcagtgttgtgaacatctggcctctgagttgatagaataggtggttagttgcaggtcagtcccctacaactaactttatttcaaaatatttcaataaataattattgagaaaatactgtgtgtaaggc

SEQ ID NO: 471404 - DNA, 750 bp, Homo sapiens
ctgagatctgtttctgaatttgtcctccaggtatacacgtgccatgggggtttgctgcacccatcaacgtgtcatctacattagggtattaccagcagaggctgtagaacagcaaagatttctgcctgtttcttcctctggaagctttgtcccagaggggcaccagccagatgccagccagagctctcctgtatgtggtgtctgccaacccctgctggaaggtgtctcccagtcaggaggcacggggagccagcaggcaagaatgttaaatcttctgaagctgcacccacagctgccaattcctccaggtgctttgtcccagggagatgggagttttatcaataagctcctgactggggctcctgcctttatttcagagttgccctgcccagagaggaggaatctagaggggcagtctggctacagcagctttgccatactgcagtgggctctgtccagtttgaacttcctggtggctctgtttacactgtgggggaaaactgcctactcaagccccagtaatggtggacgcctctcctcccactaaatttgagcctcccaggtcaacttagactgcttaagttgttcttcaatctccgatatccttttgaaggaatatgattgattcagctgttaatacttgtgtatgcttcacaatgttcttgtgctgtgtttttcagctccatttatgttcctttctaaactggttattctagttagcagttcctgtaaccttttgtcaagattctt

SEQ ID NO: 471405 - DNA, 747 bp, Homo sapiens
caaagttctccagaaggccatgtatgctctgaatcagcatccaatgtatgatacggtttctcccatagccaggattcatgggtccaggaatcaaggggtggaagtggaagttgcaccactcaccatcacccctagtgatccacgaacaaaatttttacttcttgtttctgtgacattacattctgctggcctagatgtcttagttccagagggaggaatgctgccaccaggagacataacaacaattccattaaactggaagttaagattgccacctggacactttgggctcctcctacctttagtattaccataccctgtgattaaggtcaatgggaaactacaacaaccaaatccaggcaggactacaaatggcctaaactcttcaggaatgaaggtttatgtcactttaccaggaaaaaaccaagacttgctgaagtgcttgctgaaggcaaagagaatacagaatgcgtagtagaagaagcttgcagatagcctattgtgggacattgtgatagcatgagttaatacttaatatactcctatatatatatatatatatatatatacatacatatatatgtatatatatatgtatatatatgtgtatatatatatgtatatatatatgtgtatatatatatgtatatatatatgtgtatatatatatgtatatatatatgtgtatatatatataatgaacttattattgtctttatttgaagattgtgtatgatctcaggagat

SEQ ID NO: 471406 - DNA, 3010 bp, Homo sapiens
cgggctgctctgggagtggagcatgtctccctctgcagggtcagcctggaaatgtgtgatgaaaaagaacaagctcaagaacactggtaattcaaaaacgtggagtgtcctcttgcttccaaagaagtccactagatccccagtaatggttcttaaccagtttgaaatgacagacataaaattcagaatctggatggcaatgaaactcatcaagattcagaaggaagttgaaacccaatccaaggaactcaaagaatctagtaaaattatccaagagctgaaagacaaaatacccatttcaagaaaaaaaaaacctaaaattcaaaaacaacatcatactgaatgggcaaaagctgaaaccaatccccttgagaaatggaaaaagacaaggatgactactgtcaccactttcagtcagcatagtgctggaaaatgaactaaaaaatataaaaaataacttttagagctaataattgaattttatagggaggtagcataggaggttaacatataaaaatcaactgtattttttgtcagaagaaaatattatgaaaatggtggggaacatcacacaccagggcctgtcgtggggttgggggaggggggagggatagcattaggagatatacctaatgtaaataatgagttaatgagtgcagcacaccaacatggcacatgtatacatatgtaacaaacctgcatgttgtgcacatgtaccctaaaacttaaagtataataagaaaatattaggaaaataaagctaataatatagtattaaacataacagacatacattttaccagagacattcaaatattccaaaattttgaaaatgcctaaaaaaaagaaatataccatgttattagaattatcaacagtagcaaaaaggcattgttcttgaattaatcttcaagtacaatgacattctaatgatgatcacaataggttttgtagaaaaaaatctagtaaaatgttaattgtaaaatctaaccagtagccatacgatgttgactgtaaaattgagtttttcagtgtgcttaaaactttcataataaaatattggaaaaacataaaggaaatatttgaaatagaacaaattacaaacagaaaagagaggtatgaaatgtcaggataataaacatcaaagtaaaagttgattcaaatgaagacaataggctctcaaaattaaaaaaagtggaccaattttgtggtgtatccttagactctcaaaattatattttacaacatttgttttgataacaaaaattatattttgcaacacttgatttgataacgtaacatgcaggtagtgtatacaacgtggttgtgctagacaaaggaatgattcacatccttggtagtacagagaagtatggtatgagatttaattacactactcagaacagcacacaataaaaaacgtatgaattgttgatttttgaaacttttcatttaatattttcagactgtggttgacctcaggactgactatatcacacttagaagaaacccagaccccagacaaaccctaaaggacatatattggacctggaaaatgtagctcagacttattttatgtaaaaaaacagaagagatgacagaaaaaaaaatttattgtttacagagccatacttatatagtatacaagtatacagtatatatatactatatataatgtatagtatatatagtatatactatagtatataatgtatagcatatatagtatatactatagtatataatgtatagcatatatagtatatactatagtatataatgtatagcatatatagtatatactatagtatataatgtatagcatatatagtatatatactatatatagtatagtatatagtatactatatactatactgtatatacattatactatatagtatatactgtatacagtataatgtatatatagtatttatagtatatatactgtatatagtgtatatatactatatagtgtatatagtatatatacactatatacagtatatatagaatatatatactatatagtgtatatatagtatatatagtactatatagtgtatatatagtatagtatatactatatattcactatatagtatagtatatactatatatactatatagtatatacagtatttatacactatatagtatatggtatatatacactatatagtatatggtatatatacactatatagtatacattatatgtactatttataatgtatagtatatatagtatatactatggtatataatgtatagtatatatacagtatactgtatactgtatacatatactgtatatagtatatatactgtatatatactatatacagcatgctgtatatagtatatatactatatacagcatactgtatatagtatatatactgtatatactgtatagtatatacatatatacatatatacatacatatataaacatttttttgcaatactctataaagaggcccatttctatgtcacttaaagtaaaaaacatacatttttatgcatgtttaaatgcacaagaaaggtattttaaactcagtgtttcaaccataatatgaaaaaagtctgaagaattatgagatgctttatgaagggtcttcagtatatagctcttccctctggggattttttttctctaaagtctcatgacttggagaggataaagacgtattcaaaaagttttttaaaaaagtaattgagtttataaattgttatgcaatccaactccaattatcattatttaaagataccgagtttgggaaaacaatcaccagagatcatatgaagatttcaagagacagcagggcagcaagaatccacactgttaatacgtttgaaactgatgacttcagaagtaaatgtttgaatcttactctcatttttattaaaaggataaagtattacatgctcaagattttaagaaaaatctttacagagatatatattaaagtaaaatttgctcctctgtttctattctttatct

SEQ ID NO: 471407 - DNA, 760 bp, Homo sapiens
gaaactatcagctttgaagtcaacgtgaatatggcaatcatcatcaaaacaattgggatgctgaagactttgttcatgaccttattaaaggctatttccagttcgtactctaccccttcctctcttctgtttccctcttcttcctcacactgctctacgactgccatgcaagtaacagtcgcggagaagtgtgttattaccaaccttctgaagcctacttctgtgaactcgtcaaagttgttttccatccagctttgttccattgctggcgaggagctgcgatcctttgaaggagaagaggcgctctgtcaggaccctcagctgcagttctgttggagtttgctggaggtccactccagaccctatttgccttggtatcaccagcggaggctgcagaacagcaaatattgcagaacagcaaatattgctgaacagcaaatattgctgaacagcaaatattgctgcctgattcttcctctggaagcttcgtctcagaggggtgcccagccgtatcaggtgtcattctgcccctactgggaggtgtctcccagttaggctacatgggggttacatttcggtgccctaaaacagaaatttactgagtatcctggttaatatggcttcctgaaatgacttttatgtctctggagaagctggctccttaaaatatactacagtcaatttttaagttaattctgaagattgggctaatggcttagctaatggtcattgctcatttaagctaaagtcagcatccctt

SEQ ID NO: 471408 - DNA, 516 bp, Homo sapiens
ggaaaatcggcacaggctgcctggctttaccgagaggccagcaggttaatcctttcaactctcccctgtggtccatgcatggtaattacagagggagggctcatctgcattgctgcaggatggaccaacccagagagggtggagacatcctgctcaggggtgaggctggggaaagaagtgcaaagacagatggaccacaggatgaggatggcgagaaaagggaagggcccgggtggaccatcctgggtaccttcgaaaggccagcacggaaagcattctgcaccaacgcagctggctgctttggggacaaactgtcaccacttcctatctccaggcagcttgagagtaatctttcagaagccaaatattgaaacccacacgcaaataagaacaagacccatttatcccattgcccagtccaaggcggtcctttccaaactgttccaagtcatgatacacacagaaaatgatggtgccatatttgtatgacactagggtagcaagagttttgttcac

SEQ ID NO: 471409 - DNA, 527 bp, Homo sapiens
gcttcagtaggagtagatgtccctttatagccctctccaggttcttatgcatacatctgtcacagcacttttcaccgtgtctctgtgctggcaatacccggaacagatatttcttggcgtggatccacctgtgttatccaatagagtagccactggccatgaaatgtggcaagacaaattgagatgtgctgcacgtataaaatacagactggattttgaagattgggggaataaaagccaaagcctaatccaaagcagggccctaactgtcttcaattctatgaaggctgagaggggtgaggtagctgtagaagaaaagtttgaagctagcagaggttgttggttcatgaggtttaaggaaagaaaccatctccgtaacatgaaagtgcaaggtaaaggagcaagtgctgatggagaagctgcagcaagttatccagaagatctagctaagatctatttcttcagtaaaggtggttacactaaacagattttcaatgcagataaaacagctttctattagaagcaga

SEQ ID NO: 471410 - DNA, 831 bp, Homo sapiens
gcagccaccttgtgagcacaaggggagtcgatctgagaaggcagaactgaaaggagggaggaggaggaggaagacaaggaggaggaggagcaatatgaggagaaggaagaggaggaggaagaggaggaggaagaggaggaagaggaggaggaggaagaggaggaggaagaagaggaggaagatgaggagaaggaagaagatgaggaggaggaagacaaggaggatgaggaggaagacaaggagaaggaggaggaagaagacaacaaggaggaggaggaggaggaagacaaggagcaggaggagaaggacaaggagggagaaggaagacaaggaggaggaggaagacaaggaggaggaggaagatgagaaggaagaggaggaagaggaggaggaggaagaggaggaggaagaggaggaggaagaggaggagaaggaagatgatgaggaggaggaagaagaggaggaggaagatgaggaggaggaagaagataagcaggaggaggaagataaggaggaggaagaagataagcaggaggaggaagataaggaggaggaggaagacaaggagcaggaggagaaggacaaggagggaggaggaagataaggaggaggaggaagatgaggaggaggaagacaaggagcaggaggagaaggacaaggagggaggaggaagacaaggaggaagaggagaacaaggaggaagaggaagataaggaggaggaggaggaggaagatgaggaggacgaggaggaagaggaggaggagaaagaagagaagggggggagaagcagtcaaaacaggattataaaaacagtggaatattttatgttt

SEQ ID NO: 471411 - DNA, 618 bp, Homo sapiens
tgtgaagtcctgagggcatccaatgaccccaacgctcagagcactctcaatgggagaaatgggagtttcgaaaattccaggaagttgctgcaatgtgaggagccctgagaggcacagggtcccagcttgctcaggtcgaagggcaatactagctgtgatgttcctaagggaacataaccatcactcacataataaaaacaataatcagacagtgtttctctatgactttgtgggaacaaaccagcaaccagaccgccatgaaatagacagatgggcactctgcaaccacaaacataaactcccccctcttctgactaacttgactattgcttctctcttcacggcagtcctagcccactttaatcttccaccctcctggacaaattatctagatacccccaatcgttccaggcgattttccagccatgggtgtgggcacgccaagcgcgcaggagcacgaccagaactttcaagttgaccttcttagtgcctttggcatgtttgaagaaatttggttgagctgtaatgaagttgttcacaaaatgtgaattgcccgtaagaagatttatttccactttttaaaagaaacttgcatggaaatggtacatgggaattatg

SEQ ID NO: 471412 - DNA, 484 bp, Homo sapiens
gcaggggggtgcccacccccctgcaatatggattttgggagtttgccctgcaagagacagtcaaccactgacttcagtcgaacgtacttggaaagggaagaacttaaaccagccatgaacagaagaaagccaggttttctggaaacatcgccaaaacccagcaatttctcagaattttcagaggcgccaggggggtgtttgcatttcaatggaaaaagttctgaaagctctggaaactattctcagttttactttctcattgaaaggcaaaaaccatggctttcaggggtacgtgtgcaggatgtgcagatgacgatcggctctaaatccaacaactggtgtccttataagaaggccacatacagaggcacagagctaaacagggaagaacaccatgtgataacagaggcagagcttggagggatgcagctacaatccaaggaacaccaaggattgccagcaactaccataaactagaaaataa

SEQ ID NO: 471413 - DNA, 962 bp, Homo sapiens
tcctcgctttgctgtccctgtccctgtccatgtatctggtcacggtgctgaggaacctgctcagcatcctggctgtcagctctgactcccccctccacacccccatgtacttcttcctctccaacctgtgctggcctgacatcggtttcacctcggccatggttcccaagatgattgtggacacgcagtcgcatagcagagtcatctctcatgcgggctgcctgacacagatgtctttcctgctccttgttgcatgtatagaaggcatgctcctgactgtgatggcctatgactgctttgtagccatctgtcgccctctgcactacccaatcatcgtgaatcctcacctctgtgtcttcttcgttttggtgtcctttttccttagcctgttggattcccagctgcacagttggattgtgttacaattaaccatcatcaagaatgtggaaatctctaatttggtctgtgacccctctcaacttctcaaacttgcctgttctgacagcgtcatcaataacatattcatatatttcgatagtactatgtttggttttcttcccatttcagggatctttttgtcttactataaaattgtcccctccattctaaggatttcatcgtcagatgggaagtataaagccttctccacctgtggctgtcatctagcagttgtttgctggttttatggaacaggcattggcttgtacctgacttcagctgggtcaccacctcccaggaatggtgtggtggcttcagtgatgtacgctgtggtcaccccatgctgaaccttttcatctgcagcctgagaaacagggacatacaaagtgccctgcggaggctgcgcagcagagcagtcgaatatcatgatctgttccatcctttttcttgtgtgggtgagaaagggcaaccacattaaatctctacatctgcaaatcctgcccctcagtcacatctttttgtgg

SEQ ID NO: 471414 - DNA, 488 bp, Homo sapiens
tttgataactgcagtcagtcttgttttgaatataattctgatgcttagtgtatgttgccttgtatttttctctactactatgctttaatcatcccaggttttaggccctttaagagtgaaacagcaagtcctgaagtagaagctgcagcaagttatctggaagatctagctaagatcattgatgaagatggatatgctaaacaacgcattttcaatgtagatgaaacagccttctactggaaaaagatgccctctaagactttcacagctacagagaaaaaatgcgaaaacaaagccttgataacagcacatctgcttatggcatggtatactaaatattttaagcccagtcttcacacctactgttcagaaaaaaagattgctttcaaaatattattactcattaacaatgtatctggtcacccaagagctctggtggagatgtacaaggagactaatgtgttttatgttagtgactcctaacataa

SEQ ID NO: 471415 - DNA, 879 bp, Homo sapiens
gactgagcaaattcctctgtgactaaaaaggggccaaggtacagctcattccatgacttcagagggtgcaagccccaagccttggcagcttacaggtggtgttggtcctatgggtgtgcagaatacaagaattgaggtttgggaacctccatctagatttcagaggatgtatggaaacatctggatgtccaggcagaagtttgctgcaggggtggaattctcacagatagcccctgctaggacactgtggaagggaaatgtggggttggagaccccacaaagagtccccactggggcattgtctagtggagctatgagaagagggccaccatcctccagaccccagaatggtagatcaacagacagcttgcacagtgtgcctggaaaagccacagacactcaacatattcccaatatttactttctggtaaatgcgttgaccctggttcttcagaccatagacaatgggttttcggagtcagccactccaggccacactgctccatgactaagatttgcccttcactaaagctgtaacaatgtaaaactcacttcatactgctcttttcttcaaaatttaggtaaaccaaatcaacctggtttttctcattcttcagagatttcagaaaaatgattaagtttctcatttcacaatgtgacttgtgtgttatttattgttaaaataaaagtcactttgtgaatcaaagtttttaatctttccttttcaatctcaaaaaatgttttgtcgggaaacggattttagtaaatacctttttttcatcctaatgacaggtaagggaagaagactggaatgttgtgaatccccaaatgtaggatcctcacttgaaaaatgtagcacattcccatcaacggggtgtt

SEQ ID NO: 471416 - DNA, 983 bp, Homo sapiens
taagtgagcagtctacacgagagcggactcgcccgggatgacccggagcagtcagggtccagccaccggccacggccccctgcagccggggccagccctgcgcggctgccgcagcctccaccacctcctggaaagcagcagccgggcgagaatgaaagtgacttccacaatcggccgcccacgggataagcgcaagcactgccagtctcaccatgtggcccaagatggcccagggaagtggaagtgtggagatccttggggagcggaaaaccgcagctcatgctgccagattgggattcggcctgtcctgttcttccggaagcagtttggggacagttgtgaagactggttaaatggctgtgatcaaaatgctgacagagatgtggatagtgaagttcaggctgatgtgctctcagatggaaatgaggaatttattggaaatgggagcagtgtctacccatacaggcccagagggctaggaagaacaaatgatttacagggccatgcccagggtcccgctatgtcgtgtagccttaggacactgctccccacatccaggatgctctgactccagccttggctcaaagggccgcagtatggttttaactattctgggtctttcatattaacatgtaaatttcagaattagtttatgaatttctgcaagaacaaacaaagagcctgctgggatatttataatgattgtttcaatctatagaataatttgggaagatgtgccatctttatggtagatgatattaaatgtgtaacaatgttgttgatcttttcaaaaaactaatatgtaaaatagcccactttcccacagccttgccaatagaacatgtttctcaaacttatagaatttggcctttttaatatgtgaaagttgtatataaaaatgatttaatatccctttttcttagtttgagcatttgtttcacatgtctaaaaattgaggaggagggactcctccttaactactc

SEQ ID NO: 471417 - DNA, 1127 bp, Homo sapiens
ccaccacttaaacctaacagccaacagtgtatttccttgcatcaaactgcagagttctccgtggagtgtatccaccatgtttgacctggtcactctgcaggtcatggatgcattccagacttccactactacacacaacaataatgtgatcaactgcagtcaagagagagttttctatggaaattttcaaaaagagggatcaagatcccgaaggattcttcaaagggttgcaacagaagatgaaacatggctttatgggttcaatcctgaagacaaaccacaaccaaatcaatggttaccaacaggtggaagtagtccagtcaaagcaaaattgaacttgccagagcaaagaactttgaatatattatccctgtctctcctcacctgcaaggtttctgctgagaaatgtgctgatagtcctacggagttttccttgtatgtgttcacttgcttttctcttgctgctttcaaaattctctttgtatttaacttttgagaatttgtttatattgtgtttcagaaaagatctgtgtatatagcctctatttacacttatttgagcttcatggatctaataatttcctttgtcagatttgggaagttttctgttattctttttttctttcaataagctttattctcctttctctttgtttgctacttctggaatagcataatgtgtaaattggtttgcttgatggtttcacatagacccactgactttcttcactcctttgttgttattgttgtgcctcagactggataatttcaaatgattaatctttgagctcattgattttttcttcagttttattgagtctgttgttaaagctttctatggaatattctagttcagtatttatgtttttaacagcaaaatttctgtttggctcttttcaaaaatatctactttgtccacttcatgtcttttgattgaggattttacttgatctatatctaaggtacaaggaaagtgaatgtgaactgtccaggttgtataactatctctggtattcggccaaacaatctgctactatataaactactactgtataaagtttaggatgaagattttaatgaaattatacactcagaatttttgttttgattttcctccttcacaagga

SEQ ID NO: 471418 - DNA, 991 bp, Homo sapiens
ccctgtagccctttgttttggccaatttctcccatttggaatggttgtgtttacccaagaatttcaaaagaatggagaagctccagtttgcagaattagtattcacctggtacctggtgtggtcacctctgaaaaagcaggagtgaactctgtagctgctgctgaagcagggctccatacggtaggagacatctttagtgatgctcaatgcaccactcaggcacaaagatcagtgcctgagagatggctggacacacattctgagctctactccattgaaatcaccttcctaggagccaaaaatagagttactcccatgaagacgaagaccataaacaagtcttacattctacatctgaaaccagtgttcatgcctacctcttctctcaagagacctgacacacgactctctgagccaccttcacactcaaatacacaagatctctgtgataaacttgggagggcagatatctctttaacacactgatttcattttctttggatagatactcattgatgagattgcggaatcatatgctagttctctttctaattttttgaggcgctttcatactgtttctataaagactgtattaacttacatttctaccaatcaaatgtaagagttttcctttcttcaccttctcctcagcatttgctattttttgtcatcttaatgatagccattctaactggggtaaagtgatacctcatagttttggtttacatttctccgatgattagtgatgttgaattttttttaatctacctgttggccatttgtatgtctccttttgaaaaatgtccattcagacctttggcccatttttattgtattatatgggtttttttgctgttgaattgtttgagtttctcacatattctggatattaatccatagacagatgcatagtttctgaatattttctctcatgtttattgcagtactattcacaacagccaaggtatgtgatatgatttgggtctgtgt

SEQ ID NO: 471419 - DNA, 715 bp, Homo sapiens
ctctgtcttttctacaaataccttgatgttggtgaaagtccacttgagtttgccaacttttctgattattgttgcattttgtttttcccgaagtgccctggttcaggaaataaattatggagtcatccctacactaggtgcttatccagatagcaaaggaaactttccatgcccaaacagcagtctctttacctggtttcttcagctagtacttttgatatcaagtcgaaaagcactggggtctatgagagcaaagcctggaaaccgaacagcagaaaatgtgaagataatgagtaattttggagtaacagattcaacttcagaagacatagaatcagctcatgttcacatccaaaaagcagggctgctgaagaccaagatccttattggagatgcagagatcactaacaatatgtttcaaagagtatgcttttcatacgggctgctgaagaccaaaacccttactgcagtgtccagtacctccactcaatcagaagtcactggagctttaggaaatgtgggagcttttgttttgttttgactttcatcttctatgggacctgcaccttatttaaatcgaagaaacactgttttgtaacacgcgtcctcttgaaagaacttgtgtttagcagacatcatacgcaaaagcctttatatttatgtattgcctgctaaagaaggctttatttctgtgaaaagaaggctttctggaagg

SEQ ID NO: 471420 - DNA, 486 bp, Homo sapiens
ttttctgtgagttcatctacaaaatgagcgaaagaaaaacctccatcctgccttcttttaaaacagaaattttacaatccaaaaaacgtgaaagtattgccaaaaaatatggttcagcagagctgaagcctccttcaggggataagaatacagcaccagcccttctgacagagctggagttgccagtagcctttaatctaaggaaaccacaggcaaagcaaacttggcatataacttttcctacattaattagcacccttcagtttaaagggggaaaaataataacactcttgggagagctgttagagctcaaacccaactcattcggattctgcacacaaagactctggggagggggacgatggggtggagaacagaacacagtcttggagagggaaaagagattattttcaggtcaactgaacagtagctttcagaagcaggccattgtttgaattgtgtttcatgatattgattatgaaccgt

SEQ ID NO: 471421 - DNA, 501 bp, Homo sapiens
ttatcatctttacatacaagagtacacaatgtttagctcacttataaaggatacgactttagagcaaggatccctagcccctggcccgaagactggtccttgtccatggtccattaggaaccagggggcacagcaggaaccctatgaatgtcagcaggtttatattgggctgtgcagttggacctacaagccagaagatggagcttggaatgggctgattcatgaggtgcactgtggtcagagctccctcttcagccctagaggggtaggggacaagatggtcaaggctggactggacaggtctatctgccagtccaccaatggcaggcacaagcaccagcaccaagggagaatccagcaggctactgatccaggtgagtgggtgctccaaatgtctagaatctgcctcagcatgaagtggagacagcctcactgtaccatgatctatgcacaggaagagtgaggaagctcatgctgctgatccaggtcagggggtgaccc

SEQ ID NO: 471422 - DNA, 972 bp, Homo sapiens
cattgggttgtgggtttcaggcttttcagctcatggtgtcccgctctgtcacccaggctagaatgcagtggcgcaatctcagctcacttcagaggagcctcttcctatggctaccaccatcacaaacccatggggaatactgccagcctattgctgatgtttacttaaggcccaggggctcttcagtcagctcgtggttaatgcttctaaatctggaactcacctttcagggcaaagtagtctctcagcataactactacaactgggaatgtgttgggtctcacatgaagccagcatgtctccgagtctcacccaaggcccatggtgtattgctgctggttcttcacgggccaagagttcttaagttagcaggggccaagaaaatccaggattgcacacatctgcctctgagcctgctttggaaagtagaaactacagcctttttggctttaatcctctttaagtggtgaaactattgtctcatttgtcttctatattgggattcctttatgtttcttaaacaaactatgcagtttacaatatttaaaattcactaatctatagcatttttaaagcttatacctcatcataattcccaaataatatttcacccgaagccaaccacaaataagtgataaatcaatttttaatttaattcaaacttaatggtatacactttatctgattttctaaaaatagatatggttaaaactaagaaacccatagactgttatccaggtatttttgcaatcaatactttaaatttgtaaagtgaatgattgggattttccaaaatagaggaatgaggctaacattcttgatgaccattcattcagtggtcagctagggcaataacattgatgctcctgtaattgccaaacaatggaaaggaagtgatgaagaatactcatggctggaatttaggcagctaggggaggaaggtacagtttggaaatgatggctacttggttc

SEQ ID NO: 471423 - DNA, 1040 bp, Homo sapiens
catctgcgtcttaacggggaatgagaaatagccataatttccaaacacttgtttttcataagggaaccgacacaagcatttctgagcagatgtatcattgcatgtcagatggaaatgaaaggggacgacatcgggtccaagaggagacaaatgctcaaaaatgtaaagtgactcgccccatggcacacaaccaagccacagaaggcagcaaagataagcggtggtgggaacctgagtcactgaccgtcaatcaagggactgcacctcctggaatactccctgctgatctggtttgcatatgtggcttaatgagtcctcgggaacaagacagaatcaaggaaacagcagcaaagaaaaacacccaactggagaggaagttaacccagccatggaagtggcactggtccacggaccctaggctgaaaggcctcagaagaagtctgaaggaaagcaggctgcgagccaaatggaaagtgaccctgggcctcgggtgaatgtcatgtgccctcttaactctttggtcctgagttcttggagaatctctctgctatatgaagggatccacaagacgaataattaagggggacctctgatcaacagccagcaaggaactgaatccctcagacccacaactcacaagaaactgaagctgaagcagattcttcctcagtcaagcttcaggtgcccagctgtattggtagaggagaccaaccacaccctccacagcacagcacctggagaggaactgctgccatgaccatagaggacaccctctggatacaatgccagacttgatgtgggactgaccaacctatggaccccaggcaccaccacccagacctgctcagcacctgaaacattcacagccgtggagagagaactgttcactgctaccatccacacttctgggccccttcagcagcagggtgacaaggaagagggaaatcgacttggaaaagagtctttatcatttccttccttctgcatattttggtttaatttgctttactttctatagtttcttaaggtacaaagttaga

SEQ ID NO: 471424 - DNA, 900 bp, Homo sapiens
gagacagggaagctctcttggaaggattaatgaggggagctcagaaggccacaaacgttaacaagctctctgaggtcattcagggaaaagaagaaagtccagcacaattctacgagagactgtatgaggcctatcatatgtatactccctttgatcccgatagccctgaaaatcagcgcatgattcacatggctttagtccatcaaagtgcagaagacatgagaagaaaactgcagaaacagactgggcttgcagggaagaatccatcccaattactagaaatagctagccaggtgtttgtaaacaggtatgcagtaagccgtaaggaaaacgggaaagaggatggaggtcagtcccggccacacgccgacctgtttgtcagctgcagcaatcagaggggcccccgcaaagagacaagggaaagggggccctgggaaagaaactcagcttggctgtcagagtttgcagcgtaaccagtgtgctgattgtaaagaaataggacagtggaagaacaaatgccctcagctcaaaagaaaagaaggtgactcagagccggaggctccggacaaggaggaaggggccctgctcaacctggcagaagggttcttggactgagggagaccgggctcaagcatccccattctgacatctgttcagaatgacagtcaggggtggagacattaactttcttgtagatagcggtgctgaacattcgctagtaaccgccccggtcgtccccttaccgaaaaagactactgacgtcatcggagccacgggggtttcagcaaagcaagctttctgcttgccttggacttgtcctgtaggaggacataaagtcattcatcagttttgttacatgcctgacagtctcttgaattttcaggaagggacttgctcagc

SEQ ID NO: 471425 - DNA, 745 bp, Homo sapiens
ttgttctaaatgtttgtgacgttgctggctaatgagttcaagggcattgatttttctttcaaagacagcatcttccctaattatacttccctggcatgcagcatggctcccacctgcctcagaccctccacacagaacctgggagctgtgaccctctcagatcaggggcagagtctctatcagtgggacaaaccgacctcctgcccatctcctgtggagaaggatgagcggccaaggtggccaaacagggaggtgagggagagagaaatgaacttagagactgcaggctggcagggccgcttctgcagggaaaccctccatcctgctgcccagcttgcccagggacaactggctcttgcccacagggcaaatgacgtctacaacaaccaagctgctgcctcctccactccagaggaactgcaggctttgcccgtctgctaacctcagctgctcgaggtcaagcaggagccaggagctcttgcattgactcagttctcagctgcacagccagaaggttctctgcagtccacagctccacagcagagcccaccattctcaggcagggaagctcgcacgtgtacagtaaagagcagaaaagatggccccgatccactggaaagtctatttgcataataagattagggtggggtgaccagccttccccactcactatgtaaatgtcgtacctgatccaaccaatctgtgaggcctctgtaaatcagacacccccttcttaaaccagact

SEQ ID NO: 471426 - DNA, 1426 bp, Homo sapiens
gcaggagcactgccctggggccatcccagaagccttgtccctgctgacaggtttgggaaagtttgcaccaggtagcgttcccagcactgagcctggcactgggccaggctgtagggacattacgtcccaggaagtgaaatcattgtagggcagtcccgatcaagacacacagcctgaggaagctagtggagaccgatgggaaagccccgccctctcctcgaatctgccttgttctcgactttacatttgttggacttttgttcaaagccaaaaggtggcctgagatgccatcgccagaggtggccaagccctggagtccacccccgcctttaaccggggaccttggttcacaggcaccaaggacgcctaaagcctggcactttgaagtcaaagtaattttgctgtgagctgaatgtgtaagatgacactttaaaggctgtgtacgtaattacaggtttctagaaaagaaacgtgttatttggtgctgtctgcattttggtgtctccaccttggcccacggtcccaccaaaaccctgccaggctctcctctcctgactccgtgagaaatctctgctctcctcctcgccacccctcctctgtccccagtccacgtctctctcaactccccactccctccgaccctcctcctcctctctgctgttctgcggccggaacatcttaatttcacgtgctgccccctgagattgtacagtctcccctgcaggtattctgtaaatatcctatcgacacttttacacaaaaatcactcaaatgagatttaaaggaagaagagccagtggctctggtgtggccacagctacgatatctccaaaggagaatgttcgccttgggttttggctccagcgtcaggcacagcctcatggatcccttaggatttacacctctcacccctcaaaaccgagagccatgccctgtttccccattggaaacacgcttttgcctccgaggaactcaaagcccagccttgtctgatgacaccactgtccctgcctcataccctgacactgcgagctttctcttccccaccgcctacccacgaggaccccagacacaggtgggagcaccgagggcccaccctagcggcttggttgctggactagctgtcttctgcccaggagagaagacgctgtacagtgccttgggctgtgacgtgccagatgcggtactgtctcgtgccaccccccttaaggtgcttggtaggtgccacatgccgtattctctcgtgccacccccctgagggcacatagtaggtcccactgtccctgcttcagagcctgtgtcctgagccagccagttcctaagtgctagtgcctgagctctaggccagctctccctgcaaaccacggaaacacccaccccgtgactggcactcaattcctcaattcctcctccatcccctggcttc

SEQ ID NO: 471427 - DNA, 3798 bp, Homo sapiens
tgccttggctttagcccacggttgaaacctgtcttccctcacaagtgggaatgaagcacacagcagcagcttctcacacacctggtgggtgggagaaagcactccccggacctccgacaacaagaagcagaggtgaccgagagtcccaattgttgtactcggatttacaccatgagttttgtagtgaggctgtggtcctcacacactgccctcagctggtgatggagcatgaccatgttaccagggagaccctcaacggcagccaggggagtcagggcagtcaccgaatagctaagcagaagatagaactcaaccatctgacattatccatccttcctcatcagcgactccagaacttgccaatggaagagagtggctgcagtggcagacacagtgggtgtgtagtgaccaagctaaccactgcagcccttgagtgtccatcaccattaacagagaatgaccgccgccagtgtctggcagaaagtcccttcaatttgtacctgcttaaggatccacttcacagtgagggatgtgagatcagataccaactacagaggcaacgaggggaatttggaacttgcctagaagaaagaggaggcactccagctgcagcccctactcgctgcactgatgactggtgtgctttgttccactcaccccactcttctaagtttccttcaggaacagggccaacaggtcacagagaaatagagaagtggatttttgagggatggactgcagggcagctttgctcagagcatgtccaccacaggattcctgctgaacctatgctcttgccatgtggctcccagatgctgagtgattaggagcaaggtggaagggctgggccaggcttccccagtgtagtgcctcagtgtagcaccaatggacagtctttgttccaaggcttccatcaattaatttctccgggctgccttgctgtccgaagatcttctcaatttactttgtttccctcttttccttgctaggtatctccactcaaacctgagtctcaacccacctctgcctgctccctcctctcttttctctggtcagcattttcttgactactttatgtctttaacatttacgtatctcttttaaatgtcccgtaaattaagttttaaaaaattcaatatggaagatctatagtttagcctctgggcttgtgatgggagaagctgctgtgaaggactctgacgtgcgctggatacattttcctcattgtcttggtgattaacattcggctcctcattacttatgtaaatttctgcattgggcttgaatttctcctcagaaaatgagtttttcttttctgtccattgtcaagctgcaacttttccaaatttttgtgctcactttcctcttgaacactttaccacttagacgtttcttctgccaggaaggacagggtgaactaaaggagctggcctggttatttctcttcctccaggtcagaattcatgaggggatttttcttccataattgctctgtctccctgagaaagctcctagaggtaaagctcacaaaagtgtagggacttccttatgctcgagtctccctggcaatgttcactctcagccttgtccattctgagcctctcataatttgttaattgcagattttttctcagtgtagtctcagtataaagatggattttctattcattcaaataaacaaaattttgattattcaacgataatcttataaatgttttaaatgacatttaaataaatatatttaaaagaaaatatcaatatgtaattaatcataatcctttgctttggaaacatcacaaaagtgatttcatttttcgtgtttctggtaaaaaattaaagtcaaaattcatgtctaaatatttagaaatatctagtcacatgtgtggcatattcaagaagtgaaaaatatagaattaatcatagattgcatcatgaatcttaaattttcatttgtttccatatttctaatagccttattaaagggaaatttttgatttataataattgtcattataaccatgtcagctctgagagctaagtatccttttggcatttcagctatttccctttcaccttcaaatgaattttatcttgattttctggtttatgtaggaaggtagcaatattttaaatagacatgacaaatatttactctttgaatgaaatcaagatatcaatgtaggtatgccttcatgctgtaaagtggaatgcatgtttgactatgcagaaaataatttttcacacacaaattgaacatgaggtattgtgacaaaatattacccattttcaaatatcttcctttttgtccaaacaccattcctattgaatctatcaggaaatatgttgcatggcttatttgttgtatattactaatgtttaaaacttaagtcttgcttcatatctggaatttaaaagacaataaaactacaaatcagtgcattccaaggatgtttcagccaaacaaaaatgcaaaaactcaaataacctgtttgatttgcttgttgccacatatccagttttattaaatgtgaacactgcctggttatatatggatttttatatatagcccatcttttgagcagcccagcctgaatagaacagtgtgtgtcttctgtacatgtaaggtgtaaactgatttggctgaaaatatatcaaaactcttcaattttgttgaaacatgctttacacatctaactaaagaattttaagtacttatattttgtattatctgggccattacaattatagtgaattaaaccttatgagttatattcatacatatgaaatataaacttagaaaatattaaaatattagtgtatataattttaatagaaaaaagtaatacaaggtttcatttaataaaataatgaacaaaaatttattcttgcaaggatactttactgctatttgatgacagacattggtgtgtagttgaaacaattgacataaacgatgcattttttattcctttgagaatataagattttacccatgtaactgatatgagcgaattcaaaacaaggtgatatgtctggtaaagaatagaaaatattaaagttcttcgttaaaatatcctgtgatattaatataaatatcttatattttagaaagttaaccagtttttgtttttacaagcaaagtttcagaagttcagaaattttttacaatgttcaggaataacaaatacacctcagacttctgtcaactctaagattagctcatgtattgctcatatgttatgaggcatattagtcatcctattgatgaatcagtactctaaccttatggtaagctgaattttctatgagttgcattgattggacagtatcattaatctgaatggttatacatccttaattcaattgccaactcattaaatgagcctaagcactaattccacttaacttcattgtgattagcaatcatatacttttaaaaatgttctttgtgcatacagcaaaaaccactttgggataaagtaatggttaggagacaacagcaacaagcacaaagctttatagttttatttcaaacatctttaaagcaactagaggtttatatcttggtcacaacctctctctgtggttgactgcaataggctaaaggatttcagcaaaccttactctcaaagagggcatcagataaggagagtgagaaaatcacaaatgtcaaagccagtctgaaattcaggcttgtgtgtgtgctaggctcttgtggttaaccgaccaagtttcagttataagttatgtgagagaaagttatcatttacactagagtaataaatctactttgtctcc

SEQ ID NO: 471428 - DNA, 2530 bp, Homo sapiens
ggctgccggtgccacatgccggcacacctgaccctggaatccagcatgtctgatgcaaacatgggcgcacccctgagaggcgaggctgcgagggagagcggccgtgcagcgggggctctggagaaggagctgctcgccggcagtcctgcgaggcatctttcccattctcaccgctgcatggaaggaaacccaatctcctcagcaaaggatcaagtatttgtcacgctcagcgtttcctcaccacccccgccccgcacccaaggctgtggcaccccggtgggagccctccatgaggaaaaggaggcaggaagccggtgcagcgatggcttagagcccctttctgggcccctgcgcagagaaacacctgaagccttccccggtcctgcccttagaatgaatagctccctcttctctgatctcggcactcgccttgtttttggcatgttgtcctgttttgttgatatttttgtttcccccatgggagctcgccacggagccagccagatctcccatgtgctaccataaggagagcctcgcagagctgtggcaggtggtattggcatggatgagaaacttctgcatgggtcttagtgaatgcattggcattcctggatgaaatacattaaaaatgaaataaatccatattaataacaaataatgatacagtcacctttgatagagtaaaaatgaacacttttgtaatcctttgttatgaaaaataatgagcctatgaagattcaatttcattatttgcaactacttgaagcatatttttatctcatttcttgtatctataggctaaatacaaattgatatcaatgctgatgatatttagcttaataagtttatatcttttatctgaattattcctaaataaaattgacagcagtattcgcagcttgtaacacagagcagccagtggcttccaggaaaagtataggtaattttcatcatcttgccagagacaaggggttctgctgggttcatctagaaatcaagacatattcctttagaggcttccctatgggcagtaagccatttgcctcacttggcatttatttgttgacagcatttacatgtctttgaaacaatgctgacaactttgcttaaataaatgaacatttccatgtccattctcaggtggccagaataatcagtggatgtgaacagtaaattctcataaatgtgactcgtgtttggattaagtatcgtcattgaccaaatcattttgtccttctccccatttgtcgtgccaccctcacatgatgttataatacccatcgaataatcatgactgtcagcaataaatgcagccactgacgccagctgcaaggaatgaagtcaagattgtccatgcgacgaatctgaccttttcaactaagctttaattttggtacgcttttccccccctttttataaattactcagatctcaaggtaataagcatgtaaaggaaaacctgttaaacatcttatgctgtactcgccattcctttaactatttttaaacgaattccttgttcagcacaaattcaagaaaaagcagagagtgtagaaaaagaggacagagagggacattttataatttttaggagatgtctgtattatgattataaaccagaaaagcacagactaatgtttttctaggttggatgagaaatctagaaataggatattggtggtaaaaggggaagagtgccttaggaagagtcttgggcgtaatttggggagtacctttcttccaagctacacacagccaactgttggtagcatcatattccacacagtgagaagcaaggtggggccaagatgccactctggaaggtcaacagataagtgcagaatatctcatgcaaatgattgaaagcaaatggtgactccgagctatgtaggagcttctcatgtaaatggctgcaccaccttcactgcagtcgaataaatgtgttatcatgaaaacattctcttctaaacatgaaccacatctgtagggtcaaatcaatagatacccatcaaagcatttactgtggttctagtaactatttgatcagaatatccttcctttttggcatttttgttttgtcatattataaagtaagtggtcttagaaggtgattgttccataaccatttttttttttttgctgccttattccataccctgaagagcagcatatgtgtttctcctgccagccctgctcctcatggtgattcagccttctagaggcattagatttatgttgcttatgcaagaccacttttgtatgcaacgggacacatccgtaatttttgcagcctcctatctctcatggctggcactccaggaatttggtagctttctcagtcactttttgaataatgcattgcttgggtattagaactataggtacttataaggtttagatttaacacatttttttttttctgagaacttattaacatccaaatactgtagtaactggagatacaggaattaaaatgatgccttctctatgtacaatgtaaaaggaaggcaagaaacataccgacagttgc

SEQ ID NO: 471429 - DNA, 783 bp, Homo sapiens
tggttctggagaatgggaaatctaacagcatggcatcggtgtctgtggagggcctttgtgctgtattataacatggtggaaggcaaagatacttggatacagttcaatgaactggtatttaataatgaccatctgggtggagcttgggctttggcactgaagagaaggagaaagcaaggtttctgcccctttggagccatcattctgttggggattcaagatttccacatggtcctcgctgtcaacgagtggtggttatctaataggggtccctgccgaagccacttagcagcactcatgctaaggggtggtgatctccaaccccagaactggggcgctctggcaaaggcagcctgtaaccacccagagtgtaatttgtcagagacacgaaggttaacatttttcttcacaaaaactgtctttaatggccatcagcagtcaggacctctgatttctgtctcatttgaaagcttttaatgctttcagagggatagatggggtgacctaataggtcttttccatctctgattttctatgattaatgaagttcaattgtgcagaataaaatgcaaaatggtcttcaaactctgatatcctttcttctgcttgattgatttggctattgatacttgtgtatgcttcacgaagttcttgtgctgttttcagctccatcaggtcatttatgacctctaaactggctattctagttagcaactcctgtaaccttttataaaggttcttagcttatttgcattggattagaacatgctcctttagctcaac

SEQ ID NO: 471430 - DNA, 1529 bp, Homo sapiens
aagggaactcctgtttcagaagttcatgcactgaggcaggctgctgaagggatggttttatagatgctcctcctcctagtccctctgaacttaacacctttctcacttgcatattggtgttttttgctggctgtttattgggacttcagctggggtcttagccagaccacctacaagtggactctccatgtggtctgggtttcctcacaatgtggcagctgggttccaaaaaagagcacctccaagagaactgagtggaagcactatcctttttttacatcctggcctcagaatttacatagcatcacttttgccataggcactggcccactcagatgcaaggatagggaccataagccctgcctgttcataggaggagtgtccatgtcagcagtaagaagagtatgtgggatgagagaacttgttgcagccgtcttggaaaatacaacctgccatgggtgaggtagatccagatattagtgggaggaattaatactttcaaacccagaataattagacagcagtacaaagaggcatctgatcaaatgggtgattgtataacatggataataatggctaagagagtgtgaaggatgagtagttcagtgaggggactgtgccaccttaacaaaatcattgttctttctaaatctcaaattctttctctcaaaattggcataatataagctactgcatggctccatatttcattttaattttgtaaaatgtgtggttgtgatagtggttttctgaggccttaataaaatctgatttaagaaagcttactctattttatatatattgaatctgaagatataatttgaggtccaatattgaaaatttataagtcaattaaaaatctaaaaatgagtacaattttgtgacttataagatgtttcagtcaatgatggaccgcatatgtgatggtggtcctataagagtataatggagctgaaaatttcatttaaaaataattttaatacttacatttctcttgcttctcctgctaggtcatgacctcttgaaaaggtttggatgattaatattttttttttatcttgtcacagggccatgaagcattactcatgtatttgtggtgatgctggtgtaaagaaacccactgtgctgccaattgtgtaaaagtctagcacagttttgtacagaatgtaatacttgataacaataagtgactatattactggtttatatattcactacactatgctttttattgttttcttagagtgtgctccttctacttattaaaaaaagttaactgtaaaactgtctcaggcaggtccttcaggaggtatttgagaagaaggcattgttgtcataggagatgacagctccatgtgtgttactgcccctgaagacctcccagtaggacaagatgtggagggggaagacggtgatattgatgattctgaccctgtgtaggcctaggtgaatgtatgtgtttgtgtcttagtttttaacaaagaagtttaagaagtaaaagaaaaaaattttataatagaaaagagctt

SEQ ID NO: 471431 - DNA, 1061 bp, Homo sapiens
caccattgccatcattaccattaccaccatcttcaccatcatcaccatcaccatcatcatcatgatcactgttattaccataataataataataattgtcatcaccatcatcaccattatcaccatcaccatcattagtatcaccattatcaccctcatcaccatcaccatcatcactatcaccatcatcattatcaccatcaccatcatcaccatcatcaccgtcaccattattatcatcatcatcatcatcagcatcatcattaccaccatcttcaccatcatcactatcaccattattaccataataatcaccatcaccatcaccgttattaccgtaataataatcaccatcatcatcaccatcaccaccatcactatcatcatcatcactgttagcatcaccactatctgtaccaccatcatcatcatcataatcaccatcaccattatcaccatcatcatcactatcatcattatcatcaccatcacatcatcaccatcaatcaccatcactatcaccattattgccatgatcacaattatcattaccatcaccatcatcactatcatcccattttcatcatcactatcatcattaccattaccattatcaccatcaccatcgtcatcaccaccatcttcaccatcattattgccatcgtcctcatcattaccattatcctcatatgtaattcacactgtgctaaaattaattggaaatataggccagaagattcatggaggaggtgagattgaaaataaagattcatgtttgattagactcatgcttacgtcatgaaaatgtgtgaactctctaagaagaaaataaagatgaaaaagaagtcaaagtatcaataggtgatgatgctcctataggactaagggaagaggaaatgtagctagttatgggttcagatatggagttggcaggcctcactaaaagctgaagttaaagcaaacatgaatctagatgagtccattgtgctttgaaatagcccgtctctgctgatgtagtagggcagtttccatggagtggtggatagaattcagattgcagc

SEQ ID NO: 471432 - DNA, 614 bp, Homo sapiens
gcagggagccttccatgattgactacatcacaccatcgtcaatgttctattctctgtcttctcgctgccagggaactcaattagcagatgtgtcacctaatagaaacacttcattaagagagagttctggaaatggaactgcctacttagttttgtccactctggtcactggaatattgatgttcatattctgcttgcctggacacaatccaggaatttttgtgttaatagcatctggaggaagacactggttctttacggattctcgtggggtggttgtagacgcctgtgaggtgttgtggatgaatgaccatctccaggacgccagtacacgcatgggggacccatggttacagactccatccttcttccgatatggtgactcagatcaaattcactttgccaaggtcatcctcctaactcacgtccgggtatcctcatgctccctgaaaggcacctacagtgaggaccggctccttggagccctgtggtgccctgggatggtgccttggcatccagtgtgcagctcccatctccaggtgggtgctgccacaaccagcaaagggaagaagacagaaaaggcggagactttctgaagctgacaagtgagattc

SEQ ID NO: 471433 - DNA, 983 bp, Homo sapiens
ccctcaagtcctcagaagtcagccatcatgaagttcccgccattctgggtcatagacaaaggtgttagtcctttcatgttcagactgaggatgccagagcccacaggtggagtcacttgcgtgccaactttcaccagagcccacatgtcagagcccagactcacactgcatttcaggactttcatcctaatgcacaaagccagagatgaggactggaaaacagagagtgatgatgacgacaccaacgacaaacggaataaatcagctgtgcagctatgggattctcctcattcaaacattgcgaagggatttaccaatggcattgagatgagttgcaacaagcccctggtacaaacagctctggtgcaaatccacaggaaagactgcagccgcaagcctgccatgaagatggccctgttcagagcaaatactactgaactttatactctgccaaccaagaaagaaaagtgcttcacctatgtatcaattccacgaggtccgatacttttgatatttcaaattcaagcgcagtgcttggagcccatgctaggtggaaattcagaatgcactgtgaaccttatcctgggctccggcccctgcaatgcagttcttatcctgtgggttggcccaccagtcccccaagagctgcattcagcggacatctttgcagatgatcaagttaagatgcggtcaatagggtgggccctaatccaatatgactgtgtccttatggaaagggaaaatgtggctacggggacagacatgcgcataggaggaaggccctgtgaagatgaaggcagggaccaggggatgcttcctcacacaaaggaatgcccaagagtgccagcagccaccagaaactaggagaggcacctggaaagattctcccaccctgccctcgggaggaacccaccttcggtccttgatcttggacctctcctccctagacctgtgggggaataaattcctcttgtttaggactc

SEQ ID NO: 471434 - DNA, 611 bp, Homo sapiens
aagattgggcagggtcaagggtctttcaacctcccacagtgggagttagttcccaacagaacatggagggagaggtaaatcagggatttcttcttggtttgaatccattgctgtcaaactatagagattgttatcagtcttctgggtctagccacccagcaagtctaccaggttccaggctggtactgggggttgtctgcacagagtcctgtgatgtgaaccatctatgggtctctcagctgtggatacctccacctgttcgggtggactctaaagcactctctgagaaggagctaagcattcagagtgttaatcagcataaacatatctccataaagatcaacacctgcggaaagagtacggcagatgtttgcccaaggatgagagggaaaatctgtgaaagttcaagagcctacaatattgaggtttatggaggacaagtggctttgtgggccatatggttcctgctgcaactatttaactctactgctgtggcacaaaagtggctataaacaagatgtaaatgaatgaatatggcagtgttccagtaaaactttatttattgcactgaaatttgaatttcagataattttatgtatcatgaaatatta

SEQ ID NO: 471435 - DNA, 471 bp, Homo sapiens
atttttgtgatggctgttttaaaattctcgtcagataattccaacatttgtatcatcttggtgtcagtgactattgattatcttttcccattcaagttgagattttcctggttcttgtgtagtaacacatggtccaggatcggaagatacttccggtccagtggggaagttggaagtatggcagggtatgatcaaggtatggcaggttatgatcaaggtatgccatgggaagacaggagagagggcagagcaactctttcagggtcagggaagggtgtcttggaagaggagaccatgttgagtgatgataaagaacaggactgcaagttgggaatgacttgctgtgcatttcttgcctttatgcagactttgcacagcatttacgggtaaatttaaacctaaaaagacttgtgttttgacttaggaagcataccatctgtcagtgggctttctccaggacaattttaaggc

SEQ ID NO: 471436 - DNA, 552 bp, Homo sapiens
agcgagcgagggctgctagcccagcagtatggaagggaaatgtggggatggagtccccacacagagtccccaacagggaactgcctagtggagctgtgagaagaggacctctgtcctccagaccccagaatgttagatccactgaaagcttgcaccatgcacctggaaaagccacagacactcaatgccagcctgtgaaagcagccaggaggggtgctgtaccctgcaaagccacaggggcagagctgcccaaggctatgcaagcccacctcttacatcagtgtgccctggatgtgagacatgaagtcaaaggagatcatttcagagctttaagatttgactgctccaatggatttcagacttgcatggggcctgtaccccctttgttttggccaatttctcccatttggaataggtgtatttacccagtgcctgtatccccatcatatccaggaagtaactaacttacttttgattttacaggctcataggcagaagggatttgccttgtctcagactttggatttggacttttgggttaatgctggaatg

SEQ ID NO: 471437 - DNA, 516 bp, Homo sapiens
tcgatggtacaccgcattgctcctaggctacaaacgtgtacagcatgctgctctgctgaatactgtaggccactgtgacatgatgggaagcatttttgtatctaagaatagaatagacacagtcgaaatacagtatgaaagacagaaaatgacccatctgtcttggagctggcaggactggaagttgctctggatgggccagagaaggccgtgtgatgaaggaagcagagaatggaggatgcactttgaggatggaggaaggagccacaggcaaaagaaggttggagccttctggaagttagaaaagggaataataacaaataaattctgtacatgttcaacacagacacaaccatccattcggtttcttccaagtatttttgattcctggttggttgaatccacagatgcagaacccagaacccacggatatagatggactgctgtctatcagtttcctactgctgccgctccccacaaagggcctctggggcctgcggatgaataagtccttga

SEQ ID NO: 471438 - DNA, 828 bp, Homo sapiens
ttaagacggactaacttaatgggtatgcgacttggacgtcctaggaagggtaaagggtgtggctggcgctcagggttccttcctcaccactcaccccggccgaaatgtccacataaatcatttccaaacgatttgactccaccttcaagactcagtcctcccagaaataggaaagatcttcaagacagctgcgattctcaaggcgatgaggcacatgaggatctctggctgggggagggggctttacaaagaacatctgcccaggaatcctgggaaggattcaggaaggagtgctttaccaatgaaataatttccacagtcaactgcggccacttctgccgaggttttacagacctcagaagaagtgccagtcttaaattgccagaagaagtttcagaggcagtgtttggacacctcagtcaattttaccaggagctggacagaacacaatggtttaagaccaagactatgcactcttggagtagatgttctgatgaccaaatttctggtaccagtcgacaatggagttgcaagggacccacattaagctataatcagagtttcattttggtgcctactctaaacgtgccattcttagatagttgcactgaagattgtgagactttgtttctgccccatgagaagaagggctcagatcaattggcaaagcctgctatgaagaggggatcagggaaagccgcctcaaagccctgagagcctccaaataagcattttctcacctgttgccatgcacttttacaatttggtcatgtgtttattgcaagctcattttgtaccttgagggagggaggtagaaggaatttgatc

SEQ ID NO: 471439 - DNA, 2369 bp, Homo sapiens
caggaagcagatcagtggttgcctgggtgtagaggtaggggcatgaatggggaaaccacaaggggacacaagaaaacttttggatgtgatagaatacaatcgaacgaggagtttggcttccctagaaatctgtcattttttggatgaatgaaggaatggaaacgacacagggactacgaagaaaagcccagccacctggccctttccaattctggccgcggacagccagtgctgtggccagtttcgcccgcccacgccctcctccccaaatatatattttgaaaattatttgttcaacaaatatgtgttggggtcgtgccctccgtgctgccctgggacgcgaccgtcacacggaacctcccctgggcctgggggccgcgctgtgttgtttgcgccgggactgcggaggacggcggcgcgggccggggctctgggcgggttcgcgttcagatcctcgaagtggctccctccgggacctcgctggctttcctgttcccgacccctcggccaagccgtgcgaccgggtgggctctgcttccccgggaccccactctgaccccatcccctaagccgctcccgcgagcacctcagctccgctcccgcgcgggtcagcaaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtgtttgaaacgtgagctgttgtcaggcccagggccaaggatgctaaatgtccgggaaaatgcgcgcggcagccggccacactcaggacgatggtccgtccccgagagccagcagggctgcggagaggaagatccagccgccgagcgcagcgcgcacggagcgggacgcctgcggcgatgcctgcccgggtggccgctgtcctctgcccgggcgccgctggagccgcgcgtccccatcgccgcgccggctagtcccacaggtgcccggagagggaggcacggaggcatacccaaccttgagtgcgtccagcatacgtgggtgtggacgaaggacatgttcagcacacctgaaagctccctcgtgcctcccccagtcggtgccctccccggaggtaaccactcttctgacctctatgccctgtattcacttggtgcacctgaatgatctaatggtcttttgcatctctggtgtttttagtgggagtttattcgcatcccgcaggtttcagctcttctcctttcccattcctttcaatggcatgacggcgtttctttccttcaaaccacttctcagtttgcaatttctgtgttagtttgtttacctgtctgctgtttgctttccagctagaaggtaagtgtcctctcccattcactgctgtctcctgagcccctagcgcagtgtcggcgcacgtagatattcaacaaatacttactcaatggatgagtatgggaatgaaaggaagaaatactccaggcatgaatttttgccgtcctgaatctaaaaccaatttacttgggcaaacactggcctatgactgagatctctgcatttgttttacaaagacagtgttcaccaaatccaagttagaagacttagagaaaaatactgaagttattccagtctgcctggaagccaaaagtggcatcattctcaccttctgtgataggactaccttctcaaccaagactaaattttcgctttaaactgttgaatcagtgttttataaaagcactccactttggctacataaaaagaccctcaacagtggtgtttcccccccacctctctttttacagtcagggtctccttccatcagtccattgctggagggcagtggtgtgatcatagcttaatagtggttatctccattggggtgatggaggatgattttgcttacttcccttatactttgtcattttttatatggacacattttacttcttcaaatttttaaataatgtttaattgtggcaaaacacatataacttaaaatttagcaccttaaccatttttaagtgtacagttcaatagtgtcaaatacattcacattgttatacaaccaatcaccaggatgcttttcatcttgcaactctgaaactctgtacccattaaacaactccccatctccctctccacttcccccagcccatggcaaccaccattctgttttttttctctgtaaatttgactactctaggtacctcacatatgtagaattatacaggatttgtcc

SEQ ID NO: 471440 - DNA, 3317 bp, Homo sapiens
tcattgaggtgggagtgggcctgacgtgtttctagaacagcaaaggggtccgcatagcagagacaggcatggtgagagagaatcctcgtcagaagtgtcacaggggccgccgctgccttagtgcagggagcccagtccctccaccgccgtccctgcagcctgcagacagggcccacctgccgcctactccccggctccagcagctgggaaaggctcccatcagcaggtgaaggggagcgggaaagccactcgccagcgcctgctctgaggctgctgtccttgcacgttcacacgtgggagaagcgactttctttctctttcttcagttccaaggagcccattagtggcctgtgacgggctcagtctcctgccctgggcgctccttgagaccaccaccaggacgtccaactctaaagccacagagacccgggcttcctgggaaaagctgaccagcgcattcctgcaggcgcaggattaagacgggaaacccagaaaggagtctctcctcattgcaaacagagataagccttcggggagagttgcacacaggagtgcgagtggccacccctccaggggctgtgacaggggaatctgtgggtcagcggcctctctgccaccaccagccacacgacttggggaggacagctggggcctccctgttcccctgtccgcagcagtcagggcctgcctgttcatacccaggttatcacgtgaaaccagggaagtcagggaccagcctctgactgcgggacagaaccacaacacagggtgttgctggggaggcccgacctggctcgggttggctgctttctcctttacaggctaaagatctgctgcccgctggctcctgcggccctccgtggagtgggggaggccgccctccctcctgcgtcaccatcctggctgcctccgttcctgcagctgactctgcaggggtggggagttttgctagcaaggcaatcccatttgtgggttcccagggcagctggtacgaatcaaggggaatatgaaacatcttccgcatctcttgactcacatctggccccaacccaccgccttctgagtccagaagactttacatctcacagtttcctctgccgccccgcaggcctgcttggacagctgtggcttgccggcacgaaggccacgaagctgcagatcaaccagtgagtatgtgttctgtcctctttccaacttcctgcacaacctgagctccagacgtgatgcacagcagagtgacgcaggccggggtctctccgtgctaattctgagcgcagctcccagaggccaaagacaggcgaggcaggagcgccgccgctattggaggatggaggcagggaatgtggactgaagtccagagtgacccccggaagtctctatatggcaaaaccccagctggccatcaggagcaggaaaagcaaggcagcaggaccaggaaaggggtcaggaatgactctgaaaggctgggctttgggacggcaggaagggctccacgctgagagcaccggcttggatggccatcagagtaagcagcaagggctaggtagagctcagttctggacactaggcgaggggggagagatggcagcccagggttccgcacacggcggctccgggattccagcgcaggagagggcaagcctggtggacctgagctttccaggcctctccttcttcacatttgttaatgcccagtggaccaaaacaagccacatggccacacccaaactcaaggagtcaaataaaagcccccacctcctgctgggagaagctgccagtgcagttcccgaggccttctacgctgctgtggcgctccgaggcttccctgctgacatcctagtggccccagcagagccccatctattggttgaagctcctcttcagcctgtcctctcctggacgtgactcttccttgtactcacaaatgtaccttgacacaataaatgtacctgttttgagtccctgcatctctctgtcaggaaccactcaaatatgagtaatactgtgaatcctgttcatatgaacgttacagttatttctatctccagtcaagagcagtgcccatcttagaagctggctaaggtttcagagcagctttggaagcaatatttatttgtagcacatgtatgtatctataaaatcctacctaagtaaaacaagtgtttctagaatcatgtgccatttggggaatggaaaactcaaaatgtaaattgttatgcaggtcctgtgatggattccccaacagacatgtcagttcgtggacaacatcccccataagtcaccgtgggtcctggggcatcctcctttccccaccagggggcagaagccctgcttctcacaccagctcagagtttctaaaactgtgactcgtgccactactggtgtttgaggcaattttagtgacatacatttcatctttttttcccttcttttcttatacgttaaacgaaaataaccaaagagtagatattccaaagagaagtgagaagaggctgagaataacatgagcagagaaatatgacatgcatttgctgtttgtaaacaagagggagaagactattgaaaaagtatggtgagaggaccaagttaagacagaagattgtgatggtgtcacaattaattaaattatcactggtggtagttatgtttctggcaataactgataggttactctgtatcaaacttgtttctgaaaacaactagaaagctgagataaatataaaaacattttttaggacattggagagctaccaaggtactgagaatttgcaataccaagattagagtattttctccaactgcagttaaaactaaaaataggtaacaaaaagttaaggagaaaaatctccatatgttgggaaattaatcaatatgcttataatacccataagtcaaaggagaaattacaatggaaattagaaaatattttgaattaagccacaattaaatttctgcatttcacaatttgtgggatttatttaaagccaagcttagaagaaaacttatagctttaaaatgcacatattcgaaaagaaaaaaagtgaaaaccaatggtctaagaatctatgtttatagcacatacatgtttatagcaacagagtttgcaattgcaaaaatatagaaccagcccaaatgcccatcaatcaacaagtggataaagaatatgtggtatatatatatatatatatatatatatatatatatatatatatatatatatatacacacacacacacacacacaccatggaatactactcagccataaaaaggaacaaaataatggcgttttcagcaacctggttggaattggagact

SEQ ID NO: 471441 - DNA, 661 bp, Homo sapiens
cgggtttgagcgggaagcggggggatttacagccatccctccagaagatgagggtgggtgcagccccggtaacgctggtgaagggtgggtgggcccagggcagtggagcaagagtgaaggagagtgctgaggtcaaagcacctaccacaaagggaagcaggcccaagggaactgccttgcctcttccactgtgtgaggacacaggaaaggtgccatctctgaaccagaaaagtgggacctcaccagacaccgaatctgctgacgcccagcctccagaacgcctctacctactagctgccactagcatcctcccacactgccgacagcaacactgtctgcagacattgccagatatcccctgggaggcaaagtcacccccagttacagtgactggtctagttacaccggcttccttcctgcggcgcgagcctggctggtctccatttagacccagtgtagtcgctcttcttcagtctgctgtgcttcctccgagagtgttgtgtcagctccttctctgttctgacctcagctcagatgttgcctccccacagggtaactgaagggtcttctttgaccaccctgacttggaaggccctcccttccaagtcaccccacattacattactgcattttaatttcttcctgtccttcatcaatatcc

SEQ ID NO: 471442 - DNA, 531 bp, Homo sapiens
tccagtttcagagtgagaactatctaaaatgacagcacttttggtgcactcaacagctgatggcaagtgtgatgagaatgcacctttatatcatggacagtttccagtagaccctgaagaggcatctgtggttgacctcggctgggctgatgcagtgcgaatcccatcccattttcctatctggcttcctctgccgtgggtctggctgggattgccttctctgcaaggcctatgtgtggtgccaggtcccggtgaaccaggctatgtagcagaatcctgcacacacgtactgcaccaagctctcctgtgtattggcgtcctgtcctcctatggattgaaccatccaaactccccgctcccggtgatctatattaacctagtgttgttttctacactttccaatatatacatattcctatggcctatatgttcatatagataggttgcataattttaagaaagtctttttcacaagcaataataaaaacagtaagaataggagtaatgaagaaaattgagaagaaacgacgc

SEQ ID NO: 471443 - DNA, 1188 bp, Homo sapiens
aagagaccaagtatagaggagggtatctgtggtgacgagggcggatttgactgaaatgtgctatgtccaatgagcgactgaatgtgcgatgtaatattaaggatggacagtactggtcaatatccctgggggttgggtgttatgtgggggttaaagttgatgtgttacctgtatttttgaataccctgtttaagacgtgccaatcagcttgtgttttttgcacatatcatgttgcatctttgggatgtctagaatttttctcttctatcttactggaatgctttctctacattgctttcccatacaacatattatctctctttgaagacttttcacatatctgggtaagtccacaccaggacttcgtggtgcatgcaaatcatctattgaaatgcccatctttctttacaggcaaaacctctcaagagccaggactatgtcttattcatttttatattcatcaggctcagtgctgagcacatgctaaatgttcattaaatgccagttgaacaaagaggggagagaaaaagaaaataactcgaagtataaggtgctttgccatgtgtttttcatgaaagaaagaaggagatttaaacaacagggaatgaaattctgctttatctttctttcattctcaagaaaatactagtaccaaattatgacccaataggcaaatagacattagttaatgtaccttgaaatttccactaattctcttgtgactttggatcagctacttcttgttgtattaaattctctcataaatactgtgagttgtgacttattgactttaactaacagaaaagtgaatctcactcctgttcaagtgacctcactgctttctgatgacccccactggctatgccacatttctggtgctgaatggatgcacaacacgtccgtactcatctgggcttcgatgcagttgttcaatttgaaaaatgatggaatgaacaatcctgcgtatggcttccaaactgaaaactcagaacttaaggctctggtctgaagtggccacagttcatctctggccttgacaagccatttgttggccgtggaactcattacttgaaagagatttgctacagctcccgttatggtgcctttagaagaaataaagatctcctgcctcacttccaatacttcttttatggtagcaccagaaatcttgatttcattggcttattt

SEQ ID NO: 471444 - DNA, 510 bp, Homo sapiens
tactacagtcttcggctaaatggatagtctatttctcctaggctacaaacctgtacagcatgtcactgtactgaatactgcaggcaactgggccttccccgactttactctacacctctctttgctgccaccagttggtggcagcaactggggagtgctggctggcctggtgaagaaggacgtgtttgcctccctttccaacatgattgaggcccttgcaatgatcggagggagagatgatggtggctgggacccacgggtagagatgaggaatggaaagaagaagtcaaatgctggatataaaggtggaatcttcacctttgaaattttacataaccctgaaaatgcttctccatacttctgctatgtccctgggaaacagattatacaaagtagaaacaattatggaacaactccgcaattgccacattttctgctccaaaggacttagtctctccagacttccagaaaccacagattttggtctcagtacagctgacccagacactc

SEQ ID NO: 471445 - DNA, 647 bp, Homo sapiens
aaacagaaaaggacatcaggcctttacgtccctgctttgtctgcacgatggggccctgggctgttccacccatgcccactgaggggctttcatgtggacaggcccggccatggcccatacaacaccaaccaaggtcacatgagtggaattacatagatgatgacagcagtagccttaatgtgcaggtcacactgatgcaagagttaggctcccacggccttgggcagctccacccctgtggttttgcagggtacagccccagtcctgtctgctttcatgggctggcattgagtgtctgtggctttttcaggtgcacggtgcaagctgttggtggatctaccattctggggtctggaggacagtggcctcttacagctccactaggcagaaaacatgctcctgaagttgactacgtgtgtgcagttggcttggggcacacttgcaccagattcttgacattcacctttgaagcatatgccagctgcgttccagatggcatgtgaagcagaaggatgaagagctttcctcagttttcttttaatcagcattaaaggatggaagtaaatattggttgtctatttttaagcaattgaagtttgcaaagacatggaagttcacagtatacttagtatagtggtgtgaattat

SEQ ID NO: 471446 - DNA, 604 bp, Homo sapiens
gtgagctgagctatgagccagaagtttacaggtgtggttgaattccaaatggctgtcaacaaggcaggtccagtggtgacagataatgggaattttatcttggactggaagtttgaccaggtacataaatggggtgaagtgaacagagctgccagaatggtcccacgtgtggtggacacaggcctgttcatccacatggctgagagagcctacttcaggatgcaggatggctcagtgaacaggagggaacagcctttctggagggccgtaagtagctctgcaggctcagaggagctgcgactcaagtctcctctgcctgcaggacttatgtggacatgtgcagggtgtcccaggaacctcaagggccacatgaaggaacactggactttctgtaggatcactgctcctttggcatccacggagtcacagtgaaggacattcccaacaatgttttgggtggctgatgggaagacagtggtcatggaaccaaaggatttggaaaaacttacaaacgaagacacaaactggaaacgtaatccttgagttcttaaaggctttctcagacatgaccttgatttgtacttttttgcctctgaaatgggag

SEQ ID NO: 471447 - DNA, 745 bp, Homo sapiens
cttctctgtagaccagaccttacaatgggagctgctgttattcagttggaaaacttaaatgcaatgggagtaattggatcccaaggtgatagggaccaagtgacggcactcaaccgtcaaagacaagttgaatgcagttttcaaaatggtacctggtatgcacctactaaactggcaaatacctttttctccatttgtgttcataaggcccacctgaggcactctgccttcagctggcaaggcagaatcacaccctcactgtcttacatcagagatatatcaactcgccagctttatgtcacaatccagtttgcgggaatcttcactgcctttcccttccataagatttcatactgttctattgataaccttatgctgatcagacctcatgaccaagaagtagaaactactgtggacttatggtggagtccagaacagaaggctctacagcaagtcccagctgccatgcaagctgctcttcctcttgggccatatgacccagcagatccaatgatatccaagatgtcagtggcagatagcgatgctgtttggagcttttggcagggtgctgtagaagaatcacagcagaagttcttaggattttggagcaaggctctgccatcatctgtagataactactcttttgagagagctcttggccagctactgggccttaatagaaactgaacgcttgaccatgggccaccaattaccaggtgaccggagctgcccatcatgaactggg

SEQ ID NO: 471448 - DNA, 2303 bp, Homo sapiens
gtgtaggcgtcacaccaggatgaggactggggttacttcttcaatgctttgccgcttagaaatttcttcttccagataccttaaatcatctctcttaaattcaaagttccacagatctctaggagggggcaaaatgccacctgtctctttgctaaagcatagcaaaagtgactacttcagttcccaacaagttcctcatctcctatgggaccacctcagcctggatttcactgtccatatcactattaacattttgataacaaccattcaacaagtctctaggaagttccaaactttcactcatctccctgtcttctttgagctctccaaactgttccaacctctgcctgctacccagttccaaagtcacttccacattttcaggtatctttatagcagtgcccgactcctagtacaaattttctgtattagtccattttcacactgctacaaagaactacctgaaactgggtaatttacgaagacaataggttttgttgactcacagttacacatggctgtggaggactcaggaaacttacaatcatgcgaatggtgaaggggaagtaaacgtccctttttacatggcagcaggagagaaaaagataagggggaagtgccacacacttttaaacaatcaaatcttgtgagaactcattcactatcatgagaacagcaagggggaaatctggccccatgatccaatcacctcccatcaggcccctcctccaattcgacatgatatttgggtgggaacattgctgttctatttttcagggggcagtgagctattatttaaacatttttctatgaaacaacacagtccttagtgaccaaatcatttcgattgctgctgggaggtgcaatgagtactacattaaaatggcatatgcaaaagtgtaaatataattttcaaatatttttaactttctcatagagtgaagtagtttacgataattgaattattatattcattgcaagcagagaaatatcacctatatttaaagtatattaaaaggtaaaacttttattagagaagggtaacaatcagaacttgctgattagttctatggtagaattgcctccatggtttcatattgagaattagcactaagctaataccagaagaacaaaattaataagatattggccttgcccttgaaaaactttgagtccaatatttattgatatttctcaacctataaaaattaaatagtttgtgttctatgtcagacttctcacaaaaatgtcctattaaaatcctttggatatatttttaacagatttttaggtgctagattattaatctccacaaacagagaaagcaactcaattcagtttgtattgaataaaaataagtgagcttatgttcatacttaacaatagtaaccattaagaggattttctctaaaaacattaaataaagtggatacagtatctaccttaatctttttcagagagcttttttcttttatatcatcaaatatagtcagcaattacatatttttttgcatttatcagtttttatttccattatgtcccttctactggaccataaagcctttcaaagaagataatgggtctaattagtttatatttgtatcctcagagcctaggatggggtatgacatttatcattagggattcaataaatagattataataccaaaaagcaggaaacaaaatgttcctttcatttatattttaagtggaatgaagtgtttttatgttttgctttcgcgtttttgttttaatttaaaatgattctgcaccaaagactataacattttggggaaaaatgagatataataatgaaatgtactccaaatagaaaaaaagtaattgtaacccacattcttatagattgcctaaagcttccattgaattatttcttttatctttattaagtatttttatccgaagaaataaagccccaaggccaaaatacaaatatggtttttaatagtgttctaatgatagtaatgttttatgccagaggtgctaaatctattgctgcttcttcttatgttgacctatttctccccatttggttaagatcagcttttccaaattttagtaattgtttcattaaagcatttaaatatcacaagataaaaaagtgtagataatattatttgattcacttaaaagtttataaaatcatatctcaatataagttaatattatcaatcaaaggatcaactatgacaatttttgattaacttttagcaagagaatttatattttgcattgaagtctggtttcatagtttgttgtctaaagaactgtgtgcaaataaagaa

SEQ ID NO: 471449 - DNA, 1502 bp, Homo sapiens
tcaggccagaaatactgctgtggctattttaacggctattcaaaatgtctttgggctgctgtgtgcatcacttttggcggcgtggtggcgaatcctgcaactggcacaagaaagacacaggccacctgtcccagagctctggctgccaatgtggaacaggcgattatgaggtctttcagactgcaggtgaaggaggtcgagtggattatattgtctcagagtcaggaccctcagctgtaggtctgttggagtttgctggaggtccactccagaccctgtttgcctggatgtcaccagtggaggctgcagaacagcaaatattgcagaacagcaaatgttgctgcctgatccttcctctggaagcttcatctcagaggggcacctggctctatgaggtgtcagtcggcccctacttggaggtcccgatcgggagtggcaatgggcacctcgctggatcaggaatgcagcagacaccctgccggatccgaagggatggaagccagcagcgggtctgcggtggcggcggcaaacagcagtggtggatggcgagtgaaagctcagctcgagccgtagccattgccagctcgaatgcctgggtttatatcccgatcattgtccctcctgttgtgctctcaggtgatagatgattggttgtttctttacctcctgtttttgcctaattagcattttagtttctgtacagccaataataatctcttaatggcttcctgatgtttgacaagtgttcccttggaagttaggaattccctttctctccctattgctgcatgggcatggaggactaggaggcttccttggaataattattttttctagtcagaaaaatataataggtttttgacccaagggtagagttctgtattgagcttccatttgcagaactattctgttactgaagagttactgccctagaaaactttccaattctacttatttccctagcttcatattttgttgtgaagggttattattaagttttatctgaaaatatagctattttcttgtaagtaatatgggtttttttcctgattagttttaagattttctccttgctttgctgttgtaaagtttcatcaggaggtatccagttgtgaaattacttctatttattcttttgtttccctttctctttattctttcttctaagattttttcatagacatagatctttttattttatcctttatgtcactgatttgcttgtgttttctacctcttcgtctctgtatgcaatatttcatgtattttttcctgtcccctccttatttctttattcttcatctatgtctaatctaattacctatatttttctttacctgaatctccatttagatcttttcaaatctctttatttttcttagtacctttttttttctttttcagagaataaacactctttcttttaggtctgaaattatttttaaatatttcttttatattctttctttgtagtatcatgttttttccttaaattcttgaga

SEQ ID NO: 471450 - DNA, 583 bp, Homo sapiens
gcttcatggtttaagaatcttggcttctgccagttcagacaccatgcccatgtttgtaccaacggctgcagtgtgggctctcctctcctttgaaaaaaaggaggaagtctgttatgcagactccaccatcctcagccaatctgacaggcatctctggagacaagcaaaatggctgagcttttccgcatttgtctctcacagacatcagatgtgggcagcgcaagaaacgtgttgctttggaagatctcacaatgatccactctgtcaaagacaccaagcaaataggaacccaagatcaagaagtgacacaaatgtgttgatggctttgaaacaacaaacgagctccagagagtgggagaaaaaccttacggatttcatggggcctgttgtattcatgaatttattagtagtagttcaggagtctggtgcatgtaaaaaccttctctctaaataaaggacaagtaacttcatctgattattaagaaagaacaattcttgataagccaatttaagtgatgggacaacatattctacacttgccaatattttttgacccatttatgaggttatagacaaagttacc

SEQ ID NO: 471451 - DNA, 609 bp, Homo sapiens
acatgctaataaaattttgaaagatggattttggaatcttctctcaaactacctgcctgcaagccctgtctcgggctctatttctaggggcacttcttacatggtggtggcaagagaaaatgaggaagaagcaaaagcggaaacccctgataaacccatcagatctcatgagaattattcactattgcgagaatagcatggctgaggagcaaggaagccagtctgagtcccaaaacctcaaaagtacgaaagctgagagtgcagcctttagtccgtggcttaaggcccaagagaccctggcaaaccattgctgctatggaaacaatgatagacaatacccaaatgtgaacaattttcttattagagttcaaaatgggtcaggagacaagagccttgaagataaggagcatagtggctggccatcagaagttgacaatgaccaactgagagcaatcatcgaagctgatcctcttacaactacatgagaagttaccgaagaattcaacactgaccattctatgctcgatcagcatttaaagcagattggaaaggtggaaaagctcatttcatccatgtccctacaaaagacatgaactcatcattttttat

SEQ ID NO: 471452 - DNA, 682 bp, Homo sapiens
tgttcttagcaatgatggtatgtctttatcaatcgtgtgaaaatggactaacacagaaagtagagcataaaagttcagaaaatttgcagcctgacaatgcgatagaagagaaaatcccattttctgaagagaaattcaagtcagctgcagaaatttgcatatataaggagcagccgaatgttaatctccaagacaatgggaaaaatgtctccagagcatgtcagaaatattcatggcagcccttcccttcacaggcccagagacctaagaggaaaagatggtttaatggtccaggcccagggtctctctgttctctgcagcctagggacttggtaccctgcattccagtcactccatacatgggtaaaaaggaccaaagtaaagcttgggctgttgctttagagagtggaagccccaggcctttgcagcttttgtatggtgttgagcctgccagtgcaccaaagtcaaaaactgaggcttgggaacctccgcctagatttcagaggatgtatggaaacacctggatgtccaggcagaagtttgctgcaagggcagggccctcatggaaaacttccacttgggcagtgtgaaagggaaatgtggagtcagagcccccacacagagtccctactggggcactgcctagtggagctgtgagaagagggctgtcatcttccagacc

SEQ ID NO: 471453 - DNA, 787 bp, Homo sapiens
tcactccctcacggaggagcgcaatgcaagcaaatgaaagtgatgccgtgacctgactgccgtggttagaggacttcttatgctcaagcacaaagaacagaccgtaaggagcagctgtgatccagggaaccggataggaagatgttgcctgggccaggagccctttaataccattgtgtgtgtcaagcacatcttcagtgcccagaccattcccaagtctcccttagcctttatttcctgcttgtgcacggtctcaaggtcagccaaaggtgagtggttgtggattccttcaggtctgtcccagcctggccatagccctgcacatgcaaaaagcctgaagaccttccgaaagaaaagcacagcccttcaaagccctctaagtcaagtgaaaaagttggtacaaagagaaggatgtcatcaaccacatcaaagcagccaacagttgagcaagagcaagtccaacaaccaaccactggatttaccaacaccaaggccaggaagcacctttataaaagcaaccccagtggagcagtggggtcaaatctgtaaatggattcaaggaagtcatgttggggaggccatggggacagtgagtgcagaaagcttttctagttgttctgtcaagggaagcagagaaatggggtcccatcatagtggtcctgctgggtgagatagtcaaagcagaccctgggccccgctgcccatgcagagtgtgagggttttactcaggaagccttggagaatcatgtgggacttgattttcacttatgccccaatcagaaagtga

SEQ ID NO: 471454 - DNA, 725 bp, Homo sapiens
ctcgccttgctcccgctttccctttctgcctatgttttctctggatgagactgaggttgccggaggcagtgtgtcctcctcagggcagcgcagcaggaggacgtgatgttggtctttctcactcctgctgctgtgaactctgattgtttggttaaggtggtgtctgccaggcttttccactggagcttctccaagttggatcttacaggactttataatttgaatggatgcattaagaacattcgtgattcatgggaggaagccaaaatatcaacattaacaggagtttggaagaagctgattccagccctcatggatgactttgtggggttcaagattttagtggaggaagtaactgcagatgttgtagaagtagcaggagaactaaaattaaaagtgaagcctggcgatgtgtttgaattgctgcaatctcatgaatattacataaacttagctgagaaagcactggcagggtatgagaggattgacttcaattttgaaagaagttatctggttaaaatattaaagagcattgcatgtatagaaaaatctttcttgaaaggaagagacaatcgataagcaatatctttcaatcaaagcccgccactcaaactgactgcatttatagctcctttttgtagcatctgattgttcaggactcctttcattttgcacatataatggattttctctttctggtggtcattttggatcaatctttggcc

SEQ ID NO: 471455 - DNA, 1052 bp, Homo sapiens
gctaagaaaacgttattagagtcatggaagtaagaagttcagggactgatgagacactagtttcaggagagtgtgaattgaaagtcacatatcaaggtgttcttggtggaagcaaggactgggatgatcttcccacaaaccaagagacacccaagagtgctggcaactaccagaagctgggtgagaggtgtggggcggattctcccttacagcctttggaaggaaccctcccagttgacagcctaagctcagccttctggcctccagatctccgagtcaatcagtttctgttgtttaagcctctcagtatgtggtgctctgctagggcagccccggaaatgagtacatatgtatatattttatgcgaaaaaataaagtacaatgtcttacactgtaccattttcagtgagcatatcaaaatgaaataattcagacatactttaaaaagatgtcttgaaatacaggagacaaagtagagaccaaccaagagacaaacaaaacaaccaataaacgaaaaacaaatacccaataattataatattgatatctaaagccaaaagcattagttatgaataagaatacccatttgtactctttattttaccaacaagcaaaatgcggtaagatttagatgcaaaatgtagaaggaaatggtgattgttaaagtaattgaaagcacttggaaataaataatattctgaatgtactctggatcaagcaggcagttgaaaagatggtcactggagtatttgaattacgacaacgataataacatcggagagacattttcaaaagctgctttcagactgaagtacctgttttattttctttttattatcttactttagagagagaaaatgatcaatataaatgcaccaagattttgtttcaggctttcagaaaaaaaaaaacaaaaacaaaaaacacctaaaacaaataacatggaaaaagagacagggaaaaacccaataaactgaaaaatagtaagacggtagaaatgataaattcaataattggtctttgggaataacttgtgaggaatggaaaagctc

SEQ ID NO: 471456 - DNA, 606 bp, Homo sapiens
accctgacacatgcagcctgctttgtgctgcacagatatctccctgactggctgcggcgttattctgttacacactcagcaaagcggcccctgggacctgccccttctaacatgccacattgtgaaactctccctgcgtcggtaccttggctatcagctttgtagtcacctttcagcagatcaaagatttcttggaaagaatgactgctgtatcagccccaacaggcccatatacagctgcacacacatcacagcgaaacccaaagcattcgtggggatgagcaaggactcgacgcgctgcaatgtgatcaagcccaagctagcctgctggaagatgagagaccccagggagcagaagggaaccgctccagctaaggccgtcctggaccaacctgctccagctgacctgcaaactggcttcagatatgtgagtcagccccgagaaaccaaccctgctggcaccatgatcatggactttcagcctacagaacttagaaaatgaattggtgcaaataaaacacccaatgtatgtgttttgctacggcagccatagtaaaccaataaaattttctgtcagagcattctgtgcctctgaaattatttaag

SEQ ID NO: 471457 - DNA, 595 bp, Homo sapiens
tgagaatttctaggaccagactgagaatgaagagatgttatccatccctggcgcccaaacaccctgaggaagctgtttctcctgtggaaggaacggaggtttgcgctggtaaagcagaagccggggaagctgagagcccgaggagcctcgctggttgggagggggccaggaggaaacagccgagaacacagaccccggatcggcattccaggaaaagaggtcgatacaggagtcatgggttacatgaatggagaagagatgctctgaaatcaggaggcagaggacaagaggggcaggtggacaggcaggagcttgtgggaaagtctgatttgctaggtgcgtcctccaggcgaagaagtcgagaagtccttaccacctgggaagtcaccttggtggtctgcctggtgtgtggcttggggtcactgttggtctgctgggcacagcacaggaaacaagtgaggacaagctgagaccctctggaacccttgcgtctgttcaacattgaattaacacctgtttgttgaagatgtgatagttgtaggtacgtggtcttatttctggttatttgttctgttccattggtctatgtgtctgt

SEQ ID NO: 471458 - DNA, 921 bp, Homo sapiens
gctagcggctgcagatgggcctcagcatggcttcctctcgctgcacctgacagagtcactcctgctcacagcctgccaggaggaggatgacaggctttgtagaccctgctcaacctgccggtcgagatcttcatggcagtgggaagtcaccacgggctatcagagcagaggatcagattagggttcttacaagaaggctgactgggctaaagagggaaagtttgctttgcaacatcatcataaccatcatcatcaatattagaagtagcagcatcaatattacaacagctgccagttatgggccacttatctgtgccaagctctgtgctaagcactttgcatgctttatcttattaaatcatgataataacccagttgacaccccgtttttatatgacgtcacctttaagcagcttgttcctgaagtgcaggcttcaggtctaccctccaactattttcattgtaaaatatccacagatgctcagctgctttgttaataactatcacattttcatcattgtaaagataagctgaatcacaccgatccagttatctttaatgaccactaagtgactcccttattattgttgtttactaattttataccattttaaccaccaccttacaaagtcactattattttttacagaagtacttatttagatatgctcgttattttacttatcatttctttttgcattctatttttttttttttgagttcagtttacttgaggtatgtacttcaatcctggtagaacatatctatttcttctacattatccaatttgctggcatataattgtttatagtagtctcttatgatcttttgtatttctgtggtttaagttgtaatgtctcctctttcatttatacatttatttatttgaatcaattttcttaaatttgttaagacttcttt

SEQ ID NO: 471459 - DNA, 605 bp, Homo sapiens
gatattttttggcttctctacaagcctttatccaacccatttgaaaacttaccttgaatcatggcagattctgtagatagctatagctttgaccttttatctccatctctacaagctgagctttcgcttgccgtccaccattgctgtttgccgccgtcgcagacctgctgctgtcttctgtccctccagatccaacagggtgtccactgtgctgatccagtgaggcaaccattgccactcctgatcgggctaaaggcttgccattgttcctacacagctaagtgcccaggtcagagaacacaagccttgccaccatcttggaagcagcccaccaccatcttggaagcggcccaccaccatcttgggagctctgggagcaaggaccccccagtaacagtaatgcttattaagtgtggctatcttgagattttaggactgacatgtcattacagctgtgagtgctttctcctctgggaagatgctagtggctttcttgtggtccttctcattccgtgacttatgttttgctgactgctcacctgtttctccctcttgctggactataaacttctatcagatggggacactgtcttatgcatctttca

SEQ ID NO: 471460 - DNA, 1129 bp, Homo sapiens
ggagaaaggcatctttatcaagaaagccaaagcctttcagaaaacggtggggtttggctgatctatcgcctctggctgggctgtgtcacatggcagttgctgtctacaaaagagaaaaatctggaaaatgtgaatgctttttgtacacacattaccatttaaaacgcacttgcagctctggtaatcagaagaagaagcccataaggtctcagtttggaccacagagaggtgaactgaagacctctgcaggccttctgaccctgagcccctgtggttcctcaagtccctgcgccaatatcaccatggattggtaccacctttggactcgaggaaggtggagtataacttcccactgttatgggccatacatagtgagttccttccaaaatacggaaggaagtatggaaaaggggaattctccagtacagaaacctgacaggcaccatcttagtcgggtgacaaggacaatatcatccgtgaggataatgagggtattctttgcaaatcataaatcaaatacttcgctagttgattctcatcaccactgtgatagcttcgacatcagtttatttgaaagtatctaacagagtaaattatatagtcgctgttctatttcttcattattgctttcctcttggctacatctagtaatttttaattcatatcactagaaactaggtgcattctacattttgaaaaatgctgaaatgcatatatggctgcatctatgcaacagtctcattcttaatggtgctccagtctggatagaatgaatgtaaggcagtgtcaaaatggtatttgttcccattttgttgcacacagtaaagtttattcattttatctttaatatctaagatatcccttcgtgtttgtcacaaatgcacacatacataaccattcccatccataaatgggctaaagtccatgatcaggaaattgcaagatttctaagttaattacatataatggtatatttatttagtgtattgcagctgtcctcattaggagctattggttcatggtgcaatgtttgttgaacttggccaaaatgagaaattgggattctttctactctcatgtctccaaagctatttgtttttcctttaaaagctcattataatgtttcctt

SEQ ID NO: 471461 - DNA, 742 bp, Homo sapiens
ctaacgtaaatgctgaaggaaacagggagccagtacttgaaggtttggggaccattttactattttcaagctttgccaatttgttttgtgttattaaaaaaacgaaaacacaaaacaaaactgcatggcctagaaacacagaagcacagaccactggactcttctcttggccaaagagccatcattttctttccgatgccccagtttcccagcctgtctcaatcgaaagggccggggagacttccttatccacaacagcctctgggtccccgccatctccccaggaggaagagccttctgcctttgggctcatcattagaggtggctctggaagctgctctctggctggaggctgtttcctgtgggaaacaccttcatagtgttgggcaggttacccagggctttcacctcattacccacggagcaacctgtggaccaggggctctcaagtttcgtgcactgcattcatcagctccaatggcagtcacgtagagcttatttacttttgttttatgcacagttataacaaattttgtctcatccccattatctgaaaaacaacacattaaaaggaaggaggagtcattttcattaacaaacatgcaactatcagcaagaagggagcctgaaaacagaagacgagtcagaaaatgtaaaaagaagcaaccagcattccaaaaccacctgggaaaacaacgtgaatccctcagtggtctcagaaggagtaaagcacatgtgatct

SEQ ID NO: 471462 - DNA, 893 bp, Homo sapiens
ctgcctgtcccgttttggggtgatacggtctgagagggtggcttctcctggtgatgtgtttggtttgtgtcgacccttgagctgagagttcagagctgagaaggacaggatgctctgcagcacagcgcaccacaccagctggcctgggctgagcaaccaacaaaagctgacaaattcacctgccatgtggatgagtgacttccaaagcctttcatgccaaggaggggaggctctgccagcagagcacctggggctgattcctctcccctgagtgcccatcctggaggaggaagcagttctcatttgcactgacttccagcaacttcctccaggcgagcgcctggaggcagtcacctgaagtcatgtgcctgcaggcacagagcaaagccctaactctcttcgattctgtgaagcctgagagaggtgaggacgctgcagaagaaactttggaaaccagcagaggttggttcatgaggtcgatggagaaaagccacctccataacataaaaatgcaagatgaagcagcaagtgctgatggagaagctgcagcaagttctccagaagatctcactaagaacattgacaaagacattgccacagccaccctgaccttcaacaaccactatcctgatcagtcagcagccatcaatattgagcttccacccagtgtgcgagaggcttttcaagagcagaggctgcaggatatcttggaagcagaggttgggagtcactcggtgtcatttctgctacattgtgttggtcaaagctggtcacagggccagcaaagaatcaaggggtagatgaacagactctacattctactgagagaagcttcaaataacgtgtggccatttataacctctcacacttttattctaattcattatgatcac

SEQ ID NO: 471463 - DNA, 1201 bp, Homo sapiens
ctcgccctgttacctctaaaggagaaagcaacgtccgggcctgactctctcgtccttacccagaagactgcgtcttggtctcccctgccaaataaaaactggatgaatgaacatgatggcccaaggagaggtcctgtccagcttcctcaagcaggaccctcctctccccggggcaaactgtctttgcacggtgttacgagtgatgcagcccccactactgaaatgcagctccgtgtgcatagaaattcatttgtgtgatagccacatcaactatgaagcagttcaggaaaatccagaaattaacatgaactgggatccgcaggaccctggagggccatgtgatgaggagggagcttgtcatgagcgtgaccggaggttccatcccctccaccatgttgctcgtgaccctgggaaccagctatccctggcagcagcacctattgaaaatcgtgctacttcaggaacagtgaaatgccgatcaataggagaccccactgatcctccactggctatggatgtcagattcgccagcatccttggagaggctgcaacctgcttccctcgtctacagggcgtcctccgcgacctccttctacgaaagagctggcgggactgcccgcctgtacgtttagctagtatcctctcccgcttctcatctggccatgaccgcactaagtgagactcaaaatgtgtgacttatccacagaaaagccgaggtgcaaggtgtctcacacacagggaagagaattctgatagcaatgccagcgcattccaaatagaggggacatgtgatatttataatttgtgggtgggaaaacaagttccgaatatgaaaaaaaagggagaaaattgttagatgcttagtatctggagcagaaaggaatttaccctgacaaggtattttttgtgaatttgttttctttggtgtgcaatgactaggactacttcttaatggtctcctgatgtttgacaaaatctccaagctgtaattgtaccactgctggttggaaaattttatccctgtcaattttgttcctttggttatattttactaataaaaatggcaatacgcaaaacacattttgttgcctttttttcatcccaagcttgcatctcattatagtttaggactgtttctgccaaagatttgcaacttgctgactgtcccctcatgcttagagtcttaagatttgaaggatac

SEQ ID NO: 471464 - DNA, 1483 bp, Homo sapiens
agccatttgtccaggccactcaactaacatcacagtgattttgtgcgttctcggtggaagcctgcagcctggggagtgggtttgcatgtataacgatggagctgtgcttgcagatacagatgctgagaaggttgaagggaaggagatttccaggcactgtaagatgcaaattgaggccacgatagaattcagggccacagtgatggaagagcatgaaaaatatgaagaagcaaatcatcgagacttgaaagaggctggactccagacactcggatttctggggaagggggttccaatcacagcaaacgtcatcaaatgcaaaggccctgaagaacttggcagacaaattccagaaatagcaaggaagccagaggatgggatggatgaggacgaggtctatgtgggacacgggaggaaggtgggaccatcctggggagtcaccagtcccacggttgcggatggatggttggagctaagacttctgcctgacttcagcccgacttcagcccttcttcctacctgtattcctttcctcttctcctgcagatacattcttaatttatcacaagacctgggaatgccttatacagacctggggcccacacttgaccatgtgagggtggatgcaggcagtcagcctgctgatgagcccgcctgagattcctgtgaactgtatctgcctatccactgtgttctttaacccagtttcataggcagggatccagtagaaaatttcccaagattctgtctataaattgtctggcagtccttgttcttgtggtcattttgagggtctgtaaatgttatttatttctccataggcgtttagtgggaatataaaggggcagctatgtcagcaaattttaacagacgccattttaaatgaaacggtaaataggtgtttccctacctccatgcaaatccgcttttcaaatttccaaaaatccactgctttgtgaaacaggccatgctgtgcagtatttctccatttcttaagaaagcaacctgtaagttttagttttccatggatcgagtaagtctacgtacaacttctgcacttggctttgcgttcgttaaaccaaggactggctctgttccatgtctccctgatgatgagaaatgtgattccaggctgaatggatgtacatgctgcgatcaagcactgctgcttggtggcattaatattgctattatttattatttacatatttaatgaccttattgttattatgcactgttagcgctactaattataacacaataaacataatttataaacacagtttatggtgatatacataatcaaccactagtgacagtacctggaacagctgcagatatttctcgtcatcactgactattctatgggagagagctatctgctcacagaaagattttaaaataaatattttaacaaattagaaatggattgtggctaactcgagtgatagtttctccaaaataaatccaaataatcatttta

SEQ ID NO: 471465 - DNA, 2528 bp, Homo sapiens
ccttgtgggcacacaaaaaatattaggatttccagcaatacggaagccacaatgcgaatggaccacaaccctgccaacaccttgatttcagacctcttctctgcagaacgacgagagaatagacttctgttgttttcagccaccaactttgtggtaattggttacgatagccctaatccatgttccactctgtgccttaggaagctgagcctcctgaaccacatctgcaagcagcttggggtccaccagccagctcagttcagtcaacggggatccccacaggacatggggcagatgcagcacacaggaccctacagaaataggacaggggaagcaaacatgatgcatttaagggtcatctgtgtcatcgtgtgtttcagtagttggttcctatttacaccgaggaatattttcttctacggatgctccacggtttgtttatccattcgccagttgaagaacatttggattggctccagatggagcgattgtgaataattctactctgaacatgtgtgcactggtatttgtaggaacataacttgcttttctctaggataatacctaggaggggattgctgggtcaaaaggtaagtgtacggttaacttcttgagaaactgtcaagctgttttcaggtggccatatcagtaatgttcccaccagcaacgaatgagaatttcaggagttcttgtcctcaccagcactccagcacttggcatttcaggtttctttttgaaatactctcatgagtgtgaagtggaatctcgttgtggttttacttcgctttctctgtttactaatggtgttagacatcatttcatgaatttattttccattcatatgtcttctttggtgaattatccattttttgttatgtatgctttcccttattattaaacttgggaattatttacgtatgctagacacaagttctttatcacatatgtattttgcaaatattcctctcagcctgtgactacagttttcattttgctaatggtgtcttttggagagcagaggttttaaactttttgatatccaacttattaacatttttatgaaacatgctttatatgttgcatctaaaattttttccccaaattaagctggcaaagatttttgcctgttttcttctggaagttttgtagttttccattttgcatttagttctatgattcattttgaggtaaatttgtttctggtgtgtcagagaggtcaaggttttctttatgtagatgtctatttgtcataacatatttattgaaaagactaattacttttctactaaattgctttgcaccttggtcataaatcattttaccatgcacatgtggacctgtttctggattctattttatttcattgatccacatgtttatccttttcataataccatattgtcttgattactgtaggtttacatgaagtcttgaatttaggtatttgaactctcaaaaattgttcttttccaaaattattttggttgttctggttcctttgcttaactgtgtacatttcagaatcgcttctaaaaataatcctgctaggattttcactgggattgcactgagtttgtaagtcagtgtaggaagaattgacacatcaacaacagggggtcttctagttcatggacatgccatctcactttttatctttatctgtgatttctctcattcacgttgtatagtttacagcatgcaggtcatacacatattttgtcatattactcatatcatgttgaatttataacaaaatacgtttttaatgtttcaaggagctattgcaagaaatattgtttcagaaattttaattttcatttgttcattactgagatatagaaatgcatttagtttgtttattgatcttgtagctaatgttcttgctaaatttcacttattagttgtaaaagattttcttaggatccttgggattttctaagtagattactacctgtgaatacagaaagttttatttctgccattccaatctatatacttgtaatttatttttcttccctcattgcattgcctcagactatcagtgtgatgttgaattggagtggtgaaagcagtcgtattagtctgttttaatgctgccaataaagacatacctgagactgggtaatttatatagaaaaaaaggttcgatgaacttacagttccagttccacatggctggggagacctcacaatcatggaggaaggcaaggaggagcaagtcacgtcttacatgggtggcagcaggcaaagagagagcttgtgcagggaaactgccccttatagaaccgtcagatctcatcagacttattccctgtcacaagaatagcactggaaagacctgcccccatgattcaattacctcacactggatccttcccacaacatgtggttatttaagatgagatttgggtgaggacaccaccaaaccatatcatcccatctctggcccctccaaaatttcatgtcctcacatttcaaaaccaatcatgccttcccaacagtcctttaatgtcttaactcatttcagc

SEQ ID NO: 471466 - DNA, 770 bp, Homo sapiens
tctgaggagtagggttgggagtgtatggtcaggtgctcaaaagagaaaggccagctgggttcttcacctggactcacacaacacattgggcagggatgcaaatgccactctaaaaagctcaatccctgctacgtgaaagaagctaagtgctgtaacggggaggggccagtctaccggaacgccacagaaaagtcaagttacaacaaaaatgaaaagattagttggaggctcaggagcagtggggtgacacagggaagacaattcacccaagtcctgggccagttcacagctgcaagatccagggctagcacttctctctgggctcataatgcattgcttctgacaggaaaacttctagatatgactccaagattttgtgatttacttgaccacccatatgatacaaagacattaaatgtaaaaaggcaagttcaaaacaaacaaatggacactgctgacagtagaagaactcagactctcatctcttacacaaaaatgaagggttatcaggagaaaaagttcctagagtcagcatttatgttgaaaaagatttctagatttaagtggatccagtatgttaatcttctgaaaaattttgtctaaaaaacgtctattgccagagaaaatagagagattaaaataaaaaaggaaaagcactgatacttctaacatcttttatgtatccattcatttggttgtcacatagtcagctaagaacactttacaacctaagacatgtaacgctttctgtgattgccaataccattttc

SEQ ID NO: 471467 - DNA, 753 bp, Homo sapiens
gtcattgctgagagaatggaagaggaggtgttgaaagtttgtggagggaggaagacggtctttcttgtgatgaccaagtctttcttgacaattatgcttaattccaacaatgattattctgtgtggcaaaatctactggcacaagggcacgcgagcattgatgcgttctcactcacagggaactatgagaacgaggtaattatatttcaaggagctgcagccgctccattcccaggggtgtcaccaggaccttttacttctgggaatgtgtcttccccaacccatggtcctatccccttgttttctgcatcatttgctggtgcgaggctcaccatccctctgtgtagaaatgagcataggaagggtgtcatgagccctttgtactttctccttgacactctcttaagtgcccttgatgtgtgtgagtgcagaaagacattcttgagaagggcttagcaagggatccctccatctctgttacttggatctattttatagcaattgatacaaaagaaggttttgccttatcatgatgcttttgtcaataaaatctatctaattatcgattggcaaagatttggttaaatcagatgttttgcattatgtagaaagcatatgtacttagtaaaatcctttttcatgaactgaaatatataatgatgcttgaatatactttacttttctgaggtaaactaatgttttctttagtcatttgattttatttggatcttattggtagaatctaactatttg

SEQ ID NO: 471468 - DNA, 569 bp, Homo sapiens
cccgcagacacactgagatcagtccctccttcctaccttcttattcctaatcattctgcaaagacagagtatgagaaattttcctgagggcactagagttaatgggttccatgaggagcctgcatctaccataactttccggaatgcaacgtgccaaccgcatcttcagagttctaaagcttggatggcccgtgaagatttaggattcccaggcatcagtaaaagaaatgagcattcttgcccagcccaggggattttggtgactgcatttgatgtgcctgacgctggtgcacagcctgttgacgctgtgctggacagggctactccccatgtcaggccttgcccctccaagaaacagtttgatattctgtctgcatcatcttggccaaatgattgttccacagctgcaaagtgcactaatgagaagagttggcagagtgtcggagttccccatgttccaagggcctgggaagcacactgattttgcaaggcaggattaaaggcaaagaaacaaggaatgaagcatgctttgttttgcactatgccaaaccctaccttttgtagtctgc

SEQ ID NO: 471469 - DNA, 731 bp, Homo sapiens
catcgtcaggaacgaagcgcagccattcagtcaaagcggccggctggagaggcaacaagcaggtgcagctgtagccgtaacaaagaccctcaagctttgaatgatttgctgggctatagaaatgtatatcacaataggcttagactgggtaatttataaaggaaagaggtttaattggctcacagtttctcaaggctggggaggccttaggacacttacaattgtggtggaaggtgaaggagaagccagtaccttcttcacaaggcagcaggaaagagaggggcaggggaaatggccccttataaaactaacagatctccactttgttcacggtcccacaaatgcagtcctgtatcacggcacacacactcaccaacaggttctcccttgttcctgtatgtcagtgcacacagccggagcctgctgtggttctgactttgatcctgagctgagcacacacaggagacatgatgaaaattcccaaggtgcaattgaatcctgtggatttcctatgaatgaaatgctgtagccagtggactctgttagacctaattataaactggactggttacttctcctacagtacttctgtcttcacactgagagttgctgccattttttggacccaaatataactgtcaggccacattgagattgtaggtgagattggagaatttgtgtttagaatgacccctattaaaatgttagatttcttccaatagtcaacagcc

SEQ ID NO: 471470 - DNA, 615 bp, Homo sapiens
ggagaaactgccacaaaaatggaggacagggatgataagtatactttgagagctgtggcagagaaacagacaatgtggttcctggatggttggtgctcccatcacacgcagcccgcccctgggggtgaacttgctggggggtcactcttgatggtggagggtatgacggcccgtgacccgctgggccgtgctgcctctgggcagaattcaaggttgcttcttttactgtttctttttctatttgaagaacttcttttggcctacctaccaaagctaaaaagcaaaagaggcagggaacagactgtttccaattcactttactgcatgagaacaaagtttaagaatgtttatacagttgcaaaaatatccagcacccaacatagtaaaattcaaatatattgtatccatcaaaaaggctggccatgcaacagtaggataatatatccaatattaagatgaaatttgcttaatcaaaactagctcagaaatgacacaaatagaacattagttgataaggacatcgaaacagttagtaaaactatattctatatatttaagaagctggaaatagactgagcagattaagtggtgacattgagaatataataaaatccc

SEQ ID NO: 471471 - DNA, 461 bp, Homo sapiens
gggaggcagcaacagacccagatggcttgtgtcgatttagtcacaactgagttaggagacagccctggccagcccagaaagtgcctggcatcctggtggcccttgcagagccccaagaagagagagcagggatctgatgtgctgttagcccaagcacctgacccaggatggttgggtaaacccccccttcctggtgggagcagcatcatcctgttggagaagcaaaatactaagcaaaacaaggagttcaaccctggaagccctccactgatggctgagggggtggaaaagtggcccaatctcagaatgtgtgtcacctgggccagtgagcattttctgagagctcttcttccccacacgagcagtgctgcagaaccctgctgtaatgaactcattgctattgttacactaaacaccaacagtacgggttattttaatggacatattgctttaaactgagc

SEQ ID NO: 471472 - DNA, 809 bp, Homo sapiens
ttcttatatctgatttttttcctctctatggaatgttgatgctccaagtagggaggaattgtgactctgcctctcgtgcaggcctgaatctggagcatggtcctcctgtaggactgcactcaatttggactgttccagaaagcctgtctataggtgcctccatgctgcattcctgtgggagaagccccagctatatcttcacgagagtaccagaggggaacaaggacaccttctccaagctctgcccgctgctgctgctgctgctacttttatattttgcacagctctctaaatccatttcacctccagccctctaccctggcatcagccagacagtgggcattcttttctgcctgctcttgggagctattcccactcactgcagctttgcctgctgtgggcaaggtctgttagtttacggttacagctcaaactgttcccatgagagcctggcctattctgatttcccctcttatggaatatgggaagctctacaaattcaggagaagaggggctcctctgatggaagacattgtcttgtaagaacccttattagtttaggcttaaagcatgagatgttctcagtagaaatattctgaagccaaaataaataaaaaagaaaaagtggaaaagagtcaaacaggcaattatttgtaatagaagaaaactattgattttcctttttgatacatagtctaaattatccctccagaaaagtagtaatgcatctttaaacagatttattggttctaggaggggaaaatgtattatttaacttcaatgctattggatttttcttttatgttaga

SEQ ID NO: 471473 - DNA, 2278 bp, Homo sapiens
gtggccgtggaatgcccccccgacatggcctcccatgaagacacctcagccccacgttccctctgcaccacctggacggggacccactgcggcaagaccacacaggcagtcccctcacggccagctgctcctccacctgctcacctcctccaccccagccaccgcctgaagccagcagaaaggtctgagcagcttctccctccaatcctccagaaggagcccaccctgccaacaccatgatctgggacatctgacccccagagctgtcagacaatgaattcctgtgctacgacgccaggtgtgtggcgctttgtgaacagagccctcacctgtagaactcagcgtagcacagggaggtggtcctggaccatgctggtgggcctgatgcaattgcatgtgtcatcacaagaaggaggcagaaggggctttgcccgcaggagacagagccaagcaatggaagcagagagaagccgactcacagagaggctgtgctgctggcttggacaacgggggcagtgaccgtgacccacagaacacaaggaatgcagctcttggtgttggaaaggaaaggaatcgaattccttcctggaccacccagagggaatccggtcctgtcagccctcgatttcgactcactgatgctgagttcagactagtggcttctagaaataggagagaatacatttcaattgttttcaaccttcaagtttgtgatcatttgttacaacagccacaagaaactaatgcggccaccatagactgggtgtttttccacgtatttggaaccaaactaagcatttcatagatgttattacatgtagcccttgggagtaaattatattatcctcattttacagaagagtaaactgaggacaggtgaaaaaatattccccgcccaaggtcatgccagcaagtgtggagcttggatttggactcagagctatctaaggaggacctccaagctctcagccttcctcactgtgacaaatcccctctgtgtagctcccaatgcactcttcacatcctcctctgcttcctctccacctgcctccagatgctgcctccagctcgtgtcacctgctgttccccagctcaaaagctcccagaagctcctcagttgccacagacccctcagcctggcttccatggcacctaacagcctgagccaccctaaccttccaaccttgtctcccacagtttccttggggaggtctctgtttccagcgtgttgtctcacttccactcccctcccagtcttcaagccttcagaggtgcactcccttactaggacatcttcttacttcccttccacttcttaagacaaatctgattctaagtttttccaattatttgagtgcgtacaaatatctccttcctctgaatccccattctactcaacacttggtttagtatacaatgattctttattgattttgtatgtgttagttttctcttccctagctgtactgtaaatttcttcaggatgctaaagaacactaaaaaagtccctatcctcataaagcttatagttcagctgcagagacaaaacttcttaacctcagaacaatcaacatcaaaggatttgatttaatgaggaagcagcaagcttccacatgccatattgagaacacaggacaggatgtcaaaaaaatttggttccagccctggttttgtgccctcagggaagcccctccagctcgccagctctcttcctctttatctataaaatcagacacttgagctacataccccctaatgtctctccactctagcgtcctatgagccagagccggcattggaatgtgctcctgatcccaagacacctttccccctcgcccaagaattccgccagcgactgagtcacatttcctatgagggccatgctgtagctattcatcatcctaaaagcctgggtcctgtgtgattcacatccagcgaaggccaccttgccactgaagtcttcattggcattgaaaccttgaaagctgcccctgacttctgctaccttggcaggacagagtcaaacagtgccctcttatccaaggagctggaaaatgggaaacaaagccagtggacatgaggccagactcagagtctggcacaggcataagaggaagttcaaagccaagagaaaagcccatgacactgtggctctcccaccaaccatccactcatgaactctagatgtcacagttcgcttctggaaaactgtatgtgcagaagcttaataccaaatgaaggtcatgaatcatgcgttcctggaatggtccttcaactc

SEQ ID NO: 471474 - DNA, 4571 bp, Homo sapiens
aaatccaacttatatcacctgtcttcatcaccatcatcacacaacatttgctaattgccaagatgttcagaaagagtcaatgcaatacagcagcacactgttataaacagaccgaaaagacagtcatgacctggtacctgaaaaaggccttgccaaaaagggaatatgagagtgacaggcaaaccgaaccaagggagttttctttcttacaaacagcaaaactccaaaaagatgctcatcaaataattgtgaggcttgaaaacattcagaagtcattgtcttctgcgatgtgtagaataattaaatgcaacatcagcatgacatcagtggtagataattttcagccctgccaaaaaagcgattgcgtgtgcagcaccagtaacaaagtgaaaatgaattatgcatcagaaggaactgcatttgagtcagaaaacttagacttcagcatcttcaaattacaatatgatttaagaaggaatacatttaaggagatagcaatggactgaggtgaagggggcatcatatgtcccagggtaagtgtatcaatggagggttagcatttaaaacttttatagtaatttgtcggactgcattgtgtctgttttcatgtaataataaaagacacattcgggcttgtattttttaatacctgctttaatttcattttcataaatgtaatatctattttaagctcatggtattttcatatatttatttttttgtaaaagtattcatacacaatagattggtgggagaaatatgtttaaaacatatttatatatttataatacataatttatatataatatatatatttttaaaatatagtttaaaaagtgtaaccaatccggctagtcagagtagaacttattggaccagaaatcacagcctcagacaatgactgcttgataagaatgtttttaatgatctagcaactaaaatttggaggagtacgggttaatatttggagaaacaagttttctgctatccatgggactgaatcatcgtttctcactagggcctggttatttcttccaaccttggaacactggttgctctagaccaacctcagtgaacatgtattttgattgaactcatcagtaaactcagtctacacaaagatttgacttgtttttttttccatagttgttttaattcattgccaagctgttttgaaataatattgtttggaggtatttctggttaaaagattaaatccattcagtttgacaattcactacaatcaaatatctattgtctctttttcttttttattctgaaatggttattatgaagctgaacgagccggtgatgctaccactgcagttattttttcatttatatggctctaatatctgtaaacctttaatattgtcagtcataaaattatgaatctgccattagcaacttacaaaggacagagtaactcactcataaaggagaaactacattttctcttgtttctttgtatacattttctgataattgtaataataaaattggaaatataaaagaattttatggcagtttaattgggtttgcggttttaaaactatgggtttgatataactaaatgatagcagaggataagtaatgattttttaggagaacacaatttttgtaggataatttccttctttttctcctttatatggtgagaaggaagaaaagaatttgagaaattaaaggcttaggaaaggaggaggagagcttctctgtgggaaaggttgacatcgatgtagcctcagaaatgttattcttaatgcagtgggaaatctttgcatctttgtattcctcttaaagagatttggataagagcttcagtttaaactgtttcaggaaagtgatacagagacttgattgtttaacatctcatgtccacctgtgtataaaaacagagtgtatttaacatattttaccaagatctcaaaagatgtcagattctgtcaaatgtggcatattttctcgagacctcaaagagactttggatttatcaatttagtgaggaatgtgtaatttgcaccacatgtgcaaatcatcaggtggctaccacaaaaaacaaaaaagaaaaagaaaaagaagccaacattaaacaatgttgccaaattttgataagcaacattatcactcatcaggatgacttaaaaagaaacaaatttcttatttagaatttggagatgtttcacaaaaagaagtcagaaaaatttttttaggagaaatacagaaaaattgaaatttgataataaagaatatatattttaagatgagaaatatagtaaaacagtaccacttacacaacctaaatgcatagttattttaaagattttataatgaatattataaaaatatatcataatcatatatataaagtaatcaatatgaaattcaagatggcattttacaccaagtaaagagagtcatatgtagtgaattaaaaagaaaataaatgaaaagaatattttttttaaaaaaagggtttattaatcactaattggggtagccttgaatttggggataaatttagtcattgacctttagaagcatgactgagtgaagtgttacagagaagatgagaattgggagttatcacacacccttggtgaagtactttcagttgccataattttgcaaaattaaatctctttgtaatatcaaaaacttggaagtatccattaggagaagaatttataattttcacatgttgacaaatgaataaaagcattctatctgtgtagatacagatttatattgaagatttttaatgtagagtgaaaaaagaaagttgcaggatggttaaatacagaatgagactaaagcaaatagcgcatcattcatggcttataaatacatttggatggtagctcctccagacaagggattgagagtgtgttgagaaaaaatgtctatacaataataaatcacaaataggattctatttaaagctataccactactgttgaaaacttatgtttgagctttgtttttttgtttgtttgggttttattttcagctttattgaaactcggcttccatcagcagcatcagatgttgttttagagttgcaggaatatctatcacaatgacaatttagagattagctttatttgtgaaaaataccaatttctattaaagcccattatacactgtcatcattgatttgcctaaaactttattaaaaacattcagggatgaaagactctattctctgatcacaattccagaattccttacacaaatccacccagctgtcacccaagagctccccagacttatgtcctcttaactaattttctgaaaatgaagtcctaaggtagcctaagctagtctaagttccctctcataagtattcattactgttttcataggttgaaagagggaaaatttgtggaaacatgagaagcaaagaagatcaaagaagagcaggaagaggcagagagcaaaaaaggtttttttaaaggtatactgtggacttccttctattaaaagattcttgtcacagccctccaaaagtagctgcagggaaatatgagaggcttatagatgagttcgctctgagccctatgtctggcacattctttactgagaggtttggataaactatttgccaaaacagtgtttagctatttgccaagcttaataaatttagcagcaatgtttactggaacagggcatgacccatgcaaaatacatctggtgaaaatctagtaactgtgatttgagcggttccataagtctctagaagcatatcctcaagggtcagctttcatcatatttgtttggggaaaattctttctttgtagttcactctctaaaacaataataattctcataataatcatgattattatagtaacagtattaataataacaattataataaatataaggaaatgaggaaataaataaggaaaaacagcttaaaatagtgtatacttaaatctttgtacaagatagtttacttaacattggaatgagaagtcactatttagaaaagtaaaaatctaagcaaggacacaaaatagtagagaaaaacaaaactaatagcatgaaataaaacaaaaacagaaaatatattttatttatttttcaataaatttcccaagattgattttcttatcattagcatctgaaggaaactcagaaagatgagatttaacaaataagaaaaattcttcctaataattgagaattgtgtgtatatgtatagaaatcattatttaaccttgcatatgtcaggacagtcataagctttccaagtctgattactacttactaatgggtaatgacctggctctgattattcactagaaagcctcctgttacatcttcagataactctgatctctaggaatgtactactgtatgaaggacaagaattatgaggtgagaatgttaccgtgtgtacaagttggagttttctgaatgttcggtagaggttcacatgacgttagaaaataggaggacatttttggaagatgtgcaaacttctggcaagggagacaagttgcagactgggatcaggcagacaaatagatttcaatgtgaatctttaacttaatagagacttttcc

SEQ ID NO: 471475 - DNA, 733 bp, Homo sapiens
caaagattgggaggaaatggaaagatctagagaatggtagcaattgcatgtatcttacaccgtaacagcactgtgatgagaattagatcgggtaatagtgagggtaggactgtcatgaaaagcacaagaaacacttcatctaagtgcatgcatgttgacctccagctagaagagcctctgccatccaaaaaagtggacagcggggaggagatgacctcttctccaaatcggttttgggtcaccagtgctgcttccttcaggaattattccaaagtgggatctggtggaattggaaaaaactgctttaaagttcacatggaaccaaaaaggagcctgcatcgccaagtctatcctaagctaaactgtgatcttgccactgcactccaacctaggcagcaaagggagatcctgtgtcaagaagaaggagaagaaggagaaggaggagaagaagaagaagaagaagaagaaggagaagaaggagaaggagaaggaaaagaagaagaggaagagggagaggaagaagatgaagaaaaggagaagatgaagaagagagatctaactgatgaagacctaagaccgactttccctggattccctaggaagcagtgacattcttgctataaccacttgcgtaaatatttagaatgaccatgcatttggaatgaccatatgggttttctgcctggtgactgtgttgatggcaccaagttaaccatggcctaaaactctgttt

SEQ ID NO: 471476 - DNA, 1541 bp, Homo sapiens
gaattccctttcctagccaagggaagccgtgacagacagcacctggaaaatcaggtcactcccaccctaatactgcccttttccaacaatcttagcaaacggcacatcaggagattatatcccacgcctggctcggagggtcccacacccacggagccttgctcactgctagcacagcagtctgagatcaaactacaaggtggcagcgaggctgggggaggggcacctgccattgctgaggcttgagtacctaaacaaagcagccgggaagcccaaaccgcagctcaaggagaactgcctgcctctgtagactccaccaatgggggcagggcacagctgaacaaaaggcagcagaaagttctgcagacttaaatgtccatgtctgacagctttgaagagagtagtggttctcccagcacggagttagagatctgagaatggacagactgcctcctcaagtgggtccctgacccctgagtagcctaactgggaggcacctcccagtaggggccgactgacacctcatacggccaggtgcccctctgagacgaagcttccagaggaacaatcaggcagcaacatttgctgttctgcaatatttacggttctgcagcctccactggtgatacccaggcaaacagcgtctggagtggacctccagcaaactccaacagacctgcagctgagggtcctgactgttagaaggaaaactaacaaacagaaaggacatccacaccaaaccccatctgtacgtcactatcatcaaagaccaaagatagataaaaccacaaagatgggaagaaaccagagcagaaaagctgaaaattctaaaaatcagagtgcctcttctcctccaaaggaacgcagctcctcgccagcaacagaacaaagctggacggagaatgactttgacgagtggagagaagaaggcttcagaagatcggtaataacaaacttctccgagctaaaggaggatgttcgaaaccatcgcgaagaagctaaaaaccttgaagaaagattagatgaatggctaactagaataaaccgcatagagaagcccttaaatgaccttatggagctgaaaaccatggcacaagaactacgggacacatgcacaagcttcagtagccgattcaatcaactgaaagaaagggtatcagtgattgaagatcaaatgaatgaaatgaagcaagaagagaagtttagagaagaaagaataaaaagaaatgaacaaagcctccaagaaatatggggctatgtgaaaagaccaaatctatgtctgattggtgtacctgaaagtgacggggagaatggaaccaagttggaaaacactctgcaggatattatccaggagaacttccccaacctaattcaaccaagttgaaatgaaggaaaaaatgttaagggcagccagagagaaaggttgggttacccacaaagggaagcccatcagactaacagcggatctctcggcagaaactctacaagccagaagagagtgggggacaatagtcaacattcttaaagaaaataattttcaa

SEQ ID NO: 471477 - DNA, 560 bp, Homo sapiens
cagccaaatggaagagatgcacagggcaaggtatgggggaagcgccatggggcttccatgccctctccagtgtgagctacacatagtgacttccttccaaacaatacagaatggaaaagtggaaaaacccagtaactttacagtggagaaacctgacaaattccacctccgccaggtgatcaaggttaacatcaacagtgataaattgtgtcgttatgacatccagttgtcctggcaccctttgttgaaaagacaagacaatttccctattgacttgtcttggcacttgatatttatattcaatgcgactgccagaggatgcaaaagaaagccaaaagccaaaggaaatttaggattcattaataaccattcccagggtgtcagtgcttcttttctgggacagacatgtccattgggcacctccaccacccctgagcattgccactaggggcagctctgccagttctcttttttttttaagctgtacctgggtgtaaaagttagttatgctttaatagctgtactcacaaagctagtaccggaattgtacaggtcttttc

SEQ ID NO: 471478 - DNA, 781 bp, Homo sapiens
gaaccccttcaagatgtagtgcctaggagcctgccaggctggagggcctggaggaagagcctttcattttccttgtaggagcagtgagatgaggctgggccctgagaatccttcactctctccctctcctggagggcaaaagacaggcctgattacctgtcccctccagcactgtttggctcagatgtatgctagcggagcggggaattgtctttttgcggggctggctcccacctggggctcgctgaagacaagcaccctgaggacctgtcccctgggagctgcttctccgggaaaggggccacagtatgctcaatatgacaacaattatgtaaaagttgaatacaaaacagaaatatgtgaattccgcacagatatatccactattggaaatgcatatgagctatctatgggccccctggcaaccaccgttctgttttctgcctctaggaatgtgactgctctaggtatctcatccatcctaatggatgtgaggtggtaccttattgtggcttcgatttgcatttccctagcaattaatgatgactgcttgaccttgaagcagtttctggaaatgcccctgaacagctgttgatgaatccacatggtttaaagagacttgctaaaggtgggtgggtggtctggctgtctttactttattgggttccttgtttacagagtgagcccatagttttttctcaatgcccactcgtccccatctctagtcagctctagtagctgctttctgatccagagaggagacatttgtaagatgcagccc

SEQ ID NO: 471479 - DNA, 889 bp, Homo sapiens
cttgggcctggcaggcaggcaagctgatgatcactgagctgccaagtcgccatccgtagaaccagcatggaagagacctacctcatcagcagaaagaacctcttacttggcccatggtttggagtaataatcaaaatccgtgcttgggatccaagaactgggctgagccctgggctggagccgacctaccatgagggagatgacaatacagtgaccaatgtcccagtttacacaggactgaggggtttcccgggacgtgggcctttcggtcctcaaaccagaacatttctggaaatggctggccacatgacagcagcaagtcggggccagggtgaatacccttgggcctcgggcctagcccaagtggacaacccctgctcaaccacccaaaccactcataagctacctgctaccccaacatcacagtcattatttgattgtgttgttattggcggcacagatgtctcctctctgaatttctcaccactggttaagatggagttgaacatcccaacaagttctctttctacaagaccatgttgccccatcacaatacctgaaaatctgcaaccatttgaaatatgccaagagtactccacagactccactttgcagtcaccagccaaaatgccaagcatagctagaggagataaagggatgtcaatcaatcttgttgaagatgtaaaaccaggaaagggactggaggcacttcatgacacccattttgggtcagaagaagaagtgagagagaaactgggaaatggaaataaaggaaagggagagtttgaaagagcttattattagaaaccagacgggtgaactctggggtcagtttccttcccagtagcttttcttgagcccttcccagtgacaaggtgtggtttttggc

SEQ ID NO: 471480 - DNA, 1088 bp, Homo sapiens
tggcacaggaattgttaccagataatatcttagaaataggaaaattacaagctaatttcagtccatctcaaattaatgagaatgttctttgtggagtgctaccagtgtaaacctttagaaaatgacaagtctgagatatttaaatcctctgtggagcttagcacagctctgccagcacacccaattgctattatctggccaattgctgggaccacggccctgatctatacagtggttgatgagacagatgttaaaactgatgccttcagaacagtggtgtggggaagtgttttcaatggaatgttaaatgatgataatagaaggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtggtcctgcaggctgtgactctgctcctgtgaccttggctttcaccctcatcctccctagcacttccagtgtctgccaaccagcaggctcagctgctcccacaggtcccaagggagccagcccacatgggatgagggcacgccgtggccggatcctgaacatcgctctgccctatcttgtggttctgcaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagggattccagaatctaaaaaggagtggtgcccggaaaactctgttatattcactctccagcaggttatcttttattaatagctgagctgcttttcccttatttttatttatcagctttattgaatatttgtgtagtatatagtggtaacc

SEQ ID NO: 471481 - DNA, 572 bp, Homo sapiens
aaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtgaacctaatcctgattcctggtgtctgatcccctggacttctgatccatttcctgaactcaggtccactgtgacccttagctttcagaatctgctccattctgtgcttgcctcatgaacttttttatctagcttctctc

SEQ ID NO: 471482 - DNA, 591 bp, Homo sapiens
gcaaacagcagtggtggacagtgagcgaaagctcagcttgagccaagccataacaaacatgcaccagaagagagcgcagttgcaagatttaatagagcgaaaacagagctcccatacaaagggaggggacccaaagagggtagccattgccagcttgaaggcctgggtttatatcccgatcattgtccccctcactgtttcaggctactgtccctggatgaatgatgttgccactcactgggatagaggagactgtgcatggttctggttggggcagagatgtgggttgtttgtgttgcggggggtatcgaaggtcctctatctgcttttaaacaagctgaacttgaagtgcctttgggatatccaaaagaagatttcaagaaggccgtttgatatacagatctggatcccagctttgcaggccatatggtctctgtcccaattatccaactctgctgttgtagcaaaagtagtaatagaaaatatgtaaacgagtaggtgtggctgtgctccaataaaactttatttacaaaaacagggggtgggcctgtgggttgtagtttgccaacgcttgttctattgtaaaagact

SEQ ID NO: 471483 - DNA, 593 bp, Homo sapiens
cagcaaacagcagtggtggacagtgaacaaaagctcagctagagccgagccatagcaaacatgcaccagaagagagcgcagttgcaagatttaatagagcgaaaacagagctcccatacaaagggaggggacccaaagagggtagccattgccggcttgaaggcctgggtttatatcccgatcattgtccccctcactgtttcaggctactgtccctggatgaatgatgttgccactcactgggatagaggagactgtgcatggttctggttggggcagagatgtgggttgtttgtgttgcggggggtatcgaagatcctctatctgcttttaaacaagctgaacttgaagtgcctttgggatatccaaaagaagatttcaagaaggccgtttgatatacagatctggatcccagctttgcaggccatatggtctctgtcccaattatccaactctgctgttgtagcaaaagtagtaatagaaaatatgtaaacgagtaggtgtggctgtgctccaataaaactttatttacaaaaacagggggtgggcctgtgggttgtagtttgccaacgcttgttctattgtaaaagact

SEQ ID NO: 471484 - DNA, 627 bp, Homo sapiens
acagtctgtacactctcgtgtttggtgcgtctttctcagcataatgcttttgagactcatccaaactgttggcttgccacgtgacttcctccagctcagccacgggacccacccaccgtcaagtccctctcatgctttgaagctctcagacttccccttctatgacccatggaagaaaacggtctgctttcaaaaggctcacgtgattagggaaggcttcctgaggagatggcctttaaacctggccttgaagactggggagatggcctttaaacctggccttgaagactggggagaattccaacaggatgagctggatgtggaaaggggcttccaggaaagacacagccaagtgtggaagcccgaggagcatttcaggaagggcaagcagccagtgtgtagagctgagaatggaggatcagcagcaggaaagggttggggctggaccgggatgaagggtaaggactaggcagaggagcgtcggcttcagtaacaatgcaaggtcagcttgacttatcttgacattagaatattcttgtcacttcccaagagggagaggctgtattccaagttaatagtccattttaacacctaacacgaaagagagagagagaaacacaagcactt

SEQ ID NO: 471485 - DNA, 1008 bp, Homo sapiens
atcatccagaagactatttgaaatacggctttacatccataatcattctggaccatcatgaccaaatttatcctgtctatctgcagacctggtgtcattggccacgttcctgatggacagagacatgttttggaggagtgtgcagtgtccttcagattgggccaagtcatatccatgcacatccaggccactcgcttctgcagaaaggcctgctgtgataccaggtttctggacctgcccgtgttggcactggaattccagcctccagcatgcatcctgcagggaaaagggagcaagctctatgcagctccacaaagttccagcgtagcctatctgtgcctggtgctactggttggggctggcatgggggagcctctgagctccctcctttttcagcacggctcatgcacccatttgcctttgatgtggacagtgggtctgaatggctccagtgggtgccccaaatgcagtggctgcacagacggtccagtgggcagctgctgccttgtagatgggctcaagaagttgctgattccaacagcacctgatgaccacaagtcatctgagggaagctgtggccaagaatggataacaaccacattttattcggacaccaaagcaagttgcaatctgaattgcaaccacaccttgcaatggcgccaacacatgcaacagaaacagaatttgcacttgcctatgaagcccctgaaaaatctaagcccacacccaggcactgatttaaatgaaaaagcagtatccaaaagcccaaggaaaatggtccattgcgaagctggacaatttcctctcctgacacatcttcacagcttcgtagactgtgagagaatgctgtgttcttaaagtgcttacctgcctcaaactaaagcaatacctccaggagctatgtgatacatgtaataaacatcttcttgtgcacctttaaaaggctcccaggtgactctaaggttcaggtgagattaagcagcaccgtctcaaggctgtgtttgccct

SEQ ID NO: 471486 - DNA, 1208 bp, Homo sapiens
tttttttttttttctttgagataaggtggaaaaaaatggtgagagtgtgtctccactccttctcaagaggcttggggcccaccaggtttcctcccatcccccctgtatcagcaaggatgctttcagctgctaagcccctcaacaggttccataggccagaattaggtcatatactcactcctcagctgcaagcggagctggaaaagtgggtgaatggcactgtcacctctgcagagggcaatgggctcttcagcaaggaagacagcagtctgactggtggccccaatacttgttgcactcttctcgttgtctctttgaaaagctgtcttcctgctgtgcctgtatccaagcagctctattccccttcaatagagtgtgaatcctatcttcagagaggtggaactctaagacagccttctctggctgacttcaataggggcctgatgggaggtgattgggtcatgggggctgatccctcatgaatggcttagtgctgtcctcgcgatatatataactcatgggaagtttcctggacgaagcaggccttgagctgcaaggggctaatctaatatgtaaaggactgctagaaatcaccaggagacagacctacaaaccaatagaaaaatgaaccaaggacaggaacagccagttcatagaaaaataaattaaaaggaccttaacacacgaaaagatgctgaactttgcttataataataagcaaatgcataaaatattatacactatagtattaatataaaatcacacaaatttgtattgtaatagttatatattatgtatatgtcaatatataattaataattataaatgcacaattctattattaatatataaagtaattattacataacataattatatattagttatataattaatatataacatataataattataactaatatataattatattatatattataattaatttataatatataatatataacataataattacattatatattaatacttatatattaatgtactaattatatattatatattaattatatagcatataattaatatataaatatataatataatcatattatatatcaataattatattatatagtaatatattatactatataattaaatactatataattatattatatttaattatatatgtaaaataccaaaaggaataataaaagaagtgtccattaatg

SEQ ID NO: 471487 - DNA, 1763 bp, Homo sapiens
cagctcgattcaagatttgtctttacctaaggtgtagctgcgagaagatgagagctatacccagcaaggaagcaggacctcagtcctgcaaccgcatgaaactgaatcctgtcaacaacctgcatgagcctgaaggcagcttctcccccagagcctctagcaggaacacagccggcaacaccttgactttaacacaacgagccctgacctctgacctgcagaactgcttaaagcccatatcacagaacaatgatggttctcctggactgctgtctcccctccacacagtgattcaggaacccgggttccttcaatcttgtccctttgccatcttatatacactcccatttttccctgggggtcttttccattccagccaagtggaaggggagaaagcctggcagctcctgggctgcctgaagcccagccacacatttcagaccctcatcttgtcctgaggtgcttgaaacggaggagagtagatattctgcatgtctgatttatgattatttatcatgaaagattactgactataatagccctaaacaagcctctattttctgggtcataattatggctgaactattgctacaaatctcaatagatttaaagaaagtagaagaggaaaaggaaaactattaacccaagtgactatgggaatacaaagcatcgggctagttcattaccttttgtcttaaagataagagaggaggttaaagaatattaacaaactgatgaacataaaatggcaaacaagaaagaacattagccagggggaacacatgtccctttaaaattatacctatatatattctgaattattaaatttaaattatcactactttatctgctattttattgctgaaatttctcacaacttcatttgcgaataaactctcctgtgatggtctgccatttacataagcatatttattggtatctcctacggagtataatcttaaccacaaggctatgaatacagtaaaactttacattttttatcttcttggcccatcgatcaggctagtaaccattttaacatgactcaccttattcacctttacttcagtagctttagacatttaaataaattaaatgttagtaaaaatatttggagaacatttgtatttaattgtaatgatgttaaagtatttaaactactacagtgcatgcagagatggatcagtgaaaatgctttgtccattactggaaatctaatacatggcaacgcaaaataattttgatggtctcaagcactaaattactaagtgggtatattatagtgaagatatatgtaacaagggcattctataccagttcagcccactcagcaaaattgctccaagaagttgcaatatttgtgtcttattaaaagactgacttcatatttttatgggaaattgataaacattctttcttggtgccctcttaagatccatatgaattgtataatgttttaaagtgggtgggagaccatggttccctgtttgctgttgtttcttgtggacatacatctatgtctttgcactgaaggattagttaattatttcagtctttgctgtgtggcttgttttggtcttcttagagtgtgtttgcttagaggttctttgcgctcttctcctcctcctctctggaagttgttcttgcttctgtcctcctccaccttcctggcctgctgcttctggaccactaagcactctatgtctttactacaccttgacattagggcctttatgtatgtttgatgggatagcagttatgcc

SEQ ID NO: 471488 - DNA, 997 bp, Homo sapiens
accatctttgaatgtcaggacggtggttctcaactgatacgtgtggctgggtattaggaagggctgctttgagcgggattaggggcggcgtgggaacctagagtggaagagattaagctgaaggaagattttgtgaaggggacggacttaccctccactgtgagagttacccagagcgtctgtgatggtcctgtaggcttccgaggtgatcgggcagtgtcagtcttcagctgctaagctgagaagatctggggaggagtcagtcagtcagagagccttgggccagagttccaggggctctgggagcggctgccaggtgagttgaacagtctgattttcagtggggtcccacacagatggaacgcggcttaggaggaatcccgggctatgggcattccttggcccagtggccagatttctggcacttgtagcaagctcctgggggaggaggttctggaggaacccctggcagctgcgattcgggcatttggagttcttgtgtgctggagatgtggctggggtttgtctcacagtggaggcaaggaattgcaactcagaaatacattgctacttggctgcctctactctattattgtacatcttgaaggtcccactcaagaagcaaaacaaggaaagttgaagctaaaaggtgccccaaaatgtcaaggattgagtgtggccactttacccccaggtctcagcaggtctgaagaagccatagttctatccaacaaatattcactgatgcccttggaagagaggatgtataagaagcatgcgccagtatctgcttctagtgagggcttcagactgcttccactcatggtggaaggtgaaagggagacagagtgtgtggagatcatatagcaaaaaaagaggcaagagtagggggagctgccaggctcttttgaacaaccagctcttgtgggaactaagagaataagaattcactcattaccacaaggatgccatcaagccagtcataagggctctaccc

SEQ ID NO: 471489 - DNA, 546 bp, Homo sapiens
cctaactgggggtggagagggggcactgcctggttaatgctgggaccaccatggctgctgctggcatcactaacatgctgcatctcagcaggtgagatcggcactggctccaaggaagaggttttccatgcagatgtggaaactgccaaaagaccttggatatttggtggatacatgtgcaggtttgttacacaggtgtcttgcatgatgctagggtttggaatacaattgatcccatcaccagcaaaaaacaaaccaacaaaccaaaatgaaaaccttaagaaccatatctcgatgctccaggtcaatttccaccccagccatcagggcctagctttctataatagccatccggatggagctgtgcctactagcctatcccttcatggaccaatattctcccacaatctcaccagtttttatgtcaacatgtggttcttctttgccaggcacagttgtatgtcatggacaggcacagaacatgcagacatggctcatccagcctatcttcgactgttcttccagctgacttaggctcctgctgag

SEQ ID NO: 471490 - DNA, 860 bp, Homo sapiens
gtcttgtgctgccgtatcgtctgttaatgcgcatgctcgagctcactcgcccaactcctgaaagctgccgatcaacagacacccacaccaataaaagcagacggcaagggaaccaggacaagcatggctgtgaagaacagtggcaaagggggatagaaaggagcagaggggccagagtcaccgaggaaggagaactggcagagctggtgaatggggtggatgttggcgagacagaagacggctctcaggcgtccgggttggtagcatctgctccaagatgtaatccaggtctgcctgactctgcggatgcatttcccacagacacacactccttctggctgtacaaatggcaggcagccaacagctccagctcacaaagacaaggctcccgcctgaacagcatgcagctctctcaagtctggcctctgctgagaacctctgtcccgctgccggacctgcaaccccaaggctcctgccctgtcagtggcttcagtgtggtcactgtggtgaggaaaatctgtccctttgcgaagacactgaggcagggcctggatctaagccgtatcttcctcagctgcagtgccagcacaaaagcaaacagcctcacagggggccattctgtcaggaagataaatgctgtctcattgattccctcaccgaggagcttgtctgaaatggcagctgctagacagaaacgctttgaagattgaacccaggagtccagttccagcctctctttcagtcttgactagcaattcaaactcgcgtgacaaatttaagtccatgtcactgcctaggatagaaagtaaactcggtgaatgacacaacttgccagggatatccttagaccgttgccacgt

SEQ ID NO: 471491 - DNA, 730 bp, Homo sapiens
agtgaagtccatgctgctggtttgagacagctgagatggagatgcccctgtgggatagtaacaagggcaggaccagcaacttctgcctcctccctcttgggcccagctgccaaactgtgggtaagcccaagcagaaaggtccacatggaggagaactgaggccactggccaatagcctcattgagctcctgggcaacgaggaccaacttgccagccatgtgaaaatgcaaattctcaggtctcacttcaaacttattgaatcagaaactctggagatccataatctggggtacagggagtgtctgggccctgctaaagtcatcctactcactgatcgagaaactgtcttgagaacctgggtttccaaactcctggcaaggctttatgaccaacaggatatgtctaaactctttggcaagactctctccaaagtcacttacttcacttatccatcacacagcctagtttccatcaaaggatcttttgaatgccttctgggctgtactgagcttttattcacaaaagcttcagaagggcagaagaaaggcttgactcagtaacccaggaatgtagcagctgatgttcgaggacaagctggtgtatgcaggagcaccagatgtcccgacagaagaaagcggatgccacagattgggaagagctgtggcaggggagagagccaactcagatttcttcttctgactaattctgattttctgattaatgaatgctt

SEQ ID NO: 471492 - DNA, 1717 bp, Homo sapiens
tccctggatccagccatttctgcagctactgtatccttggactttgccattacagaaacagcagcagacaaggtcttcttcctgaaccaggtagtctcaactaggggaactagttaagacagtcttcctgtgcatccaccaggtggagattcatttgtttgtttgtcgaattgatgtttgattcaacacgtgatgcagaagacaatgacttggctctcacaaagcttatggtgtactggcacctgctgctgctgctgctgctgttgctgctgttgctgctgctgctgctgctgctgctgtctccacgacctctgtgcaaagaaagttatctgggggtggtgaatactgtcctgcaagctcaaagatcagatttcattgcaattatttcaactgcaaatgtttataagaaaccaagaaaccaggaaaccaagcacaaagactggtcaaaagtgttccagaaagggggctgtaagcaagcagggggagaagctgagattttgatttgtattgcaggcccctttaaggcacagaaattggtaccatcaggtacatttgaaagtgaggatattctcattgttcaattcccacctatgactgagaacatatggacacaggaaggggaacatcacacactggggcatgttgtggggtggggggatgggggagggatagcattaagagatatacctaatgttaaatgaagagttactgggtgcagcacaccaacatggcacatgtatacatatgtaacaaacctgcacgttgtgcacatgtaccctaaaacttaaagtataataataataaaaaaaagaaagtgaagagagacactaataactctgacagctgaagactgtaggctgttcaaatctcaaaaacagcattgccagccagctgactgagagcacccagtgttggcatactgctcatgtccattatgtcatttttttttcttgccagtaccccttctattacgagggaggaaaataaaactcagatttcaggaatcaatcaaggtcatgtagcaacctggtggtcagccagagctagaaattatcaaatatgatgatccaggaatatatgaaggttttaaagtacttttccagaatccataataatagactattttttctgattttattttttgatatagtaagttatgttaataaatttcctgatattaaaacactatttcttccctgaaataaattcagcttcttcaaatatattgatttttgtattaccaactgttttatagggtatttaaaattttaatttttattcataagattgatctatcattttcttttttatattaccttttcaacttttgataatgaacttacgctgatttaaaaagtgaattagagagccttctatttcttcctattgtttagagaaatttaagcattctgttttcacaaggttgcatatgaacagaaagatgccagtttgattctttttgatttgtgcttatgttttctttattgtccttgttttattttttaaaaacaataagcacacatattcttctatatctattatctctttactgctactacaaagatcttttgatggtggagagacagtgtattggggaatgaacagaactgccttccatcttctttagcctaaggttaaatattaatttttctacaaatattttgtctggttttagggaattctctatttatttaaaatatgcatttgtcattttttt

SEQ ID NO: 471493 - DNA, 458 bp, Homo sapiens
ttgtgagagcaaggtagtatgtggtagtgttccacaagcagaatggttggtgccaagggtccgttttacagaataccaaggcaaggggatgttgggaacttgagtgaccagtatgaccctgtgattaaggtcaatggaaaactacaacaacccaatccacaaataactactaatggcccagacccttcagaaatgaagtctcagttctacaatgttcttttgctaatttcaatcaagctgcatgtaagagctgaagagacctcacctaagtctggagttagtcttgtggccatagcctggcttccctgccgtgagcagctgtctgtccatcctttagcctgctgtgtgaaatcgtgtgggatggtctctatgatgggtctcatctctttacttcagcttcacactctagttcccctgctggccttggagccttgctttgaactctagcccaattgact

SEQ ID NO: 471494 - DNA, 1770 bp, Homo sapiens
tgcttaacctggaatcacaaagcctgagcttgatgttgaaaagaccttcaaagaaggaagacttaacaagtaaagcaaaagaaaacaaaacaaaatgaaacgaaacgaaacaaggaaatgcaaatcaaaacagtgtcaagtaggtgaagaatgtgcaggagtaaaaacactgtccgttcatttgctacttatccgtcgctctctgaaatattttcttcagctttttatagttgaggacctgaagaaatcctcctgcaaggagtgggtgtttcatcctgatctgaaagatgagaagatgcaagttcacccaaagagaaccaggaagcactggggcacaaggaactacggagaagaccatgagtcaagaactagcagaggatattcaaggagcagaaaggaagccggagtgtggctggatgctagttcattcctggaaagttataggagacaagctggaggatgcaggcaaggggctgctcctcagcaaagggctttgaatgaaacgagtcactctaactcttatgaggaatgtgaggcacccaaagtggaaaaagccaagtcagcaggctattgagagttcagtgagaattgaggagggttctaccgaggtggcggcatgggaagtggagagaggaggagggtttcgagcacatttcaaatgtagggcagatagtacttggttatgaatctgctgtggcaaggaatgtaaacaaataactaagaatcttctcttaaattttaataaaatgtgatctagagagaccattaattttaatctcacctcttttgataggccagttttatgtttgttttgtttaagacacctctccttcagatttgtagcaggtgcaccaagacaattttttttttcaaaaatagcacattgttatacttttatttttttgcaggaaaacattagatgcatgaagatatcataattaaacctttcattaaagaaggttaggcatcctgctcatttctcactgtttttgagaggagctcatcatattaatggttgccatagccttaaagtgcctaactcttgtcttgccatttccggtctttttactttcttgtgtttttggaaatttttgtaatgaccatgaatcatttggctagcaagtgttaaagacattttatctttaaaaattaaaaaggaaaaggatggctaggggtggaattaagaagcccttctatgaaatcacagaagctcttacctgccttccttagacgcagacaccgtattggaagggagaacaagacttgagaggtgactaaaagtctggatatttatgcacaataaattaaatacctaaagaaaattagatgtacatttaaatacttaaaattattggtttgggacaaggttactggattagacaaaacataaatggtcgtaggtaggtgtggaaagatagtagagagatttgtccctcactcttgggagacagaaagacaatgaagaagattcagttgtagaaagaaaaacaaagttcattgtttttaatgtgtagtgcaagtgatactcaaaagcacaacataactgacttttattgagaattgattgcaaaggatgctttgtacaaggtgtcttatttgattcccacaataattcaatgatattaatattattaggtatattaatattattatgtgttaaaacacagttgacttcaaatacgtgttttaagtgcccaggagtaattatgtggaatttgtccttaggatatgggtgtcatttgtctttagcagtcttcttacctgtgacat

SEQ ID NO: 471495 - DNA, 661 bp, Homo sapiens
gggtatgtcttcgtagcagcgggaaacaaaaagacagcaggatttagagataatgtggaaatgcctgaaaacatgtgaagtagtaagtttctacaaatggaatgtgagtgcaaggaatgtgtgtcaaattcagaacgaggctgagaagcagcaagtgggttatatacagaggactgtgaggttccaaggatatcagggctacaggatggaagaagctgtgtccgtgaatcacccatgtggagaagccactgaagagataaacatgactgttttgtggagtcttcctcaagcacggcataaagcttacagaggacatgagaagacttccctggaagatatgttgttcaacttttatactaaaagacttaaaattgccagtagcagaggtagcactgccaccataagaaaatcctgccaccactcccatcctaccactttcatgtccttcgagtcctaagaagaattctatatagaaagcaaatatttgaatcctgattttacaacaggaatgagaaattaatttcttatgtaaaactactaaatagtatttatttcagtataatacatttgggaagctttagacttatttagttttaattttgccttgggatggaatgctttttttgcattcataaaatggattatgtttctttatatttgg

SEQ ID NO: 471496 - DNA, 741 bp, Homo sapiens
cagtgtcttttttttttttggctgcccacagcaaagtttatagatgctggtagcagccctcagagagaatcgacaatggtgaatgttcctttcagacttttaaaggtgtcagaagctcagttaatcttttctaagtctggacaagggaaagcctcagcgaaagcccagctccatcagtgcaaatcttctctacgaatgccgatctaccccagagacaagctgacggcactatcttttggagcttttcttctcccaattgaagataaaggcaaggaagctggcctgccacacagaggctggttcctggaccttctgggatctctcattccggatgtaggattctatgatcagcaagtgggcaagccagtcatgtttgttctcctcccttcagagtggcaacttccctcaggccctgggaagaccattgctgctatcattacaacggatcagatgtggcctaatgagtctgaaccaggctttttccatgaatgggctgtggttgagcagtggtagatgcagcacagacacagattagttctaactgaaaaagaataaaattagccaagtggctggcgccccctgtaggcaatctgtagtgtttatccaggcatccccatggatccagatttcagagccttagtttaagaatcagatgagtaattttagaatatatatgtgagggataaattaatatttgcatcaatattaaggtttttgcatggtatagcattaatctttctt

SEQ ID NO: 471497 - DNA, 979 bp, Homo sapiens
gtaggctggccagaccaggaagatgggcgtttgtacttttcccactgctacatagaggaaagagttgcgttgggtgtcttttctcttctaaattcagtggccttggtgggagtggggtgaagcttagccggagttggacgagtgtgaatctgcctctaaccagccacgtggcctggagcaagctcacgcggaagagtggatctcaccgcgcatgctcagccactcccccaaatgcatccatccagccattctctccagctcctccagagaggaaaggggtggtaacatgaggccaagtgggtgccgaaagaaaatcttcgaaaatgctgatgtgaggagcaacaggcggcagccatgggtggggatccgggcttccagccggtgcacgctggagaccctgacctctgcgaggccgcttctggcgtccagtcctgagcctcggggacctcgtggggatggcagtggtggtagtgtcctgaagatgtctgtccctgctgtagctaagctcagttcctggctgtgtttctcctgttgttccaggccctgtcgcctccaggcctggttcctgcccccctggagagtcagaccctatttcagcaacagctaccccaataaactgctaacattatcctaagtgaaatggctcagaaaaacagaaagccaagaactgcatgttctcacttacaagtggaagctaaacaacgggtgcacacagacatacagagaggagtaatagacattgagggcaggaggggttagagatgaaatactagctacagggtacaatgaacactatgtcagtgctgcacttgtatccctaaatccataacaataaaaataaaaaataaaaattttaaaagcagagggtaagcaaaagtttgtataaaaaaagatgaaaaacaaatattttttagaaaaattaaattaaaatgtatataaaaaaataaaataaaataaactatttaagaaaggtgccaac

SEQ ID NO: 471498 - DNA, 1379 bp, Homo sapiens
ttctgatttacagattattcattttatcaatcaatacacctaagatgtacgttggtttggtccataaaggtgggacaattggaagtggagggcttccaggttataagcagttcaaagattttctgactggcaatcggctgaaagagttattatctaaagacctggaatccatagaaaagaatgtctgggttatgataagggtttgtgaagaccaaggttttatcatgccgatgaagcctccagaatggtcaacgttgagttcttcggaaacttctcatatagttgtgagaggatcggcttcaatgattgctcccagttggttgttgtcaagttcctatgacccgccacgatgttcctcatcttcaaggctctcatctccttggcaaaacttctcgaaccacctctgcactgtacgctcattagcagttcctgggccaagcgtgttctaaccctgaaatcatgtcctttgcattatcatttttcataactcatatggtttaatccccttcaaacaaaagaaaccacatggtgcattagtgggtccacttaatttctataatcaattatattgaaaatatgatatgaagttatatgtcagatcttgctgtcatttcttttcaccattaaaattgtttgtgtttcacatctgtaccagtcattgtaataaatttttaacaacattttcttatattttccctttgatattgcatgaaagtccctgttagctcttcttaaattattgataattcttaggttaacaggtttatactttctgctctattgcattaaaaatggatttaaagcatgttgcaacattaacttagaatcattatagtttaccctctatactttgctcatttgaatgtccaaaacagaagataacatgaaaagagatatgtatttctttagtttaaaaaataaaaaggtgttagacattgattcaggacttttctgatggcactgaggacttattacatgggaatgttctagttcttatctatccagctggtgaggtggaacattttaaaaacatatataattttaaagtagtatttctattttaagtcatttatctttctggaatgataaatagcaatattcatattatttgtagagatgacctcaaaacttctcatttcttcatatgaagtgagttttatacacatatttcatttcttagaactaacttaaagtgaaaaaaattaagaacaaaatgttatttccaactacttttttccacagtattccttaatttgtttaataaatatacatcacattaggtacagagaactttgtcatgtactaagaacactcacacgacattgtctctattttaatctaattacagatgatgactatttgtaaaaagaaaaaaaaaa

SEQ ID NO: 471499 - DNA, 542 bp, Homo sapiens
aagaagcaaataaatgtcaacattttatttcatgtcatgtgagccacaatgcgactgagaatccaaattcgacctgagtttgcctgcaaaactcaagaggtcagagagccactcatgagacaccagaacacagaattaaggcctgttggcactaggctccatgactgcgagaacagacaccatgacgtcctccttggataccgcttcttcagccagattgtactccctggtgctccaaatggcctccttccacagacctggagcaatgcaattaaagcctacagtgaagcagtatccagaccaccagggtctaaagcaactgcattaggctactgccagagacacctacaaaacagcttccctccccctgaggggaatctgcgcgagtttctcctagttgtcctaaaatgcctctctgttcattaagctctgcaaatatgtagtctgcatgcaatattcaacgtgaggagagtatgggctgagggcactatccatgatgacagtgctggctcgcagtacaggcaggactggacccagggttc

SEQ ID NO: 471500 - DNA, 748 bp, Homo sapiens
ggattttgaatgttatttaaagcttcttctgcatctaagtcagccatcttggctcttaccctcacaattttaaaacttgtactaaagagccatgactgctatttctctcacacaaggaagcaaccctcgagatgcagccctgaagtccagctgttgactataatagcctataggtctctgatgatcaccatgtttctggatgagaggctaccactggggctgtcagaaaatcatcagggggacgtgtgtcggacccgaaatgtgtggcttgcagacctagtttttcatggacgttactccctgaaccggtttggtccacccgtgtcacagctacctggcactgtgtcaggggctcaaggtgcgggaggggagcacagcggacaccctgccatatccggagggatggaagtcagcggcgggtctgcgatgactgcaaacagcagtggtggaaggcaagtagaagctcagcttgagccctaacaaacacggaccagaagagtgcagttgcaagatttaatagagtgaaaacagagctcccatacaaagggaggggacccaaagagggtagccattgccggcttgaatgcctgggtttatatcccgatcattgtccctccggttgtgctctcaggcaatagatgattggctatttctttacctcctgtttttgcctaatcagcattttagtgatctctctttcctacctgattggtcgggtgtgagctaagttgcaagccccatgtttaaa

SEQ ID NO: 471501 - DNA, 956 bp, Homo sapiens
ctcactaagagtgacctggctatggccactgctgagtgccagatttgccagccacagagaccaacactgagccctccatatggcaccattcctccaggtgatcagcaagctacttggtggcaggatgattatgttggacatcttccatcagggaaggagcatcagcttgtcctcaccagaatagacacttactctggatatgggtttccctattctgcaggcaatgcttctgacaagggtaccatctgtggactcatggaatgccttatccatcatcatcatattccacatagcattgcctctgaccaaggcactcactttatggctaaagaagtgaagcagtgggcttgcactcatggatttcactggttttaccatgttccccatcaccctgtagcagctggtttgatagaatggtggaatggccttttgaagtcacaattacaatgccaactaggtgacagtactttgtagggatagggcaaagttccccagaaggctgtgtatgctctgaatcaacatccaatatatcaccatttctcccacagccagaattcactggtccaggaatcaacgggtggaagtggaagggtcaccactcaccatcacccccacttttggttcctgttcccacgacattaggttctgctggtctagaggtcttagttccagagggaggaatgctgccacaggagacacaacaacgtttccattaaactggaagttaaggttgccacctggacactttgggctcctcctacctctaagtcaacaggctaagaagggagttacagtgttgactggagtgattgacccagactatcaagatgaaatcagtctgctactccacaatggaggatcctttctttttatttatttatttatttatttatttatttatttatttatttttaattatactttaagttttagggtacatgtgcacattgtgcagg

SEQ ID NO: 471502 - DNA, 686 bp, Homo sapiens
aaactttctagagcaaaggcaaaatgctgccagtctccaaagtcaaatccagggcaaggctctgcctttatgcctttatctttgcccatttacgaaagctgagagaggaggtcaaaatgtcaatgttaacgggagtttggaagaagtttatttcaacccacgttgatgactttgtgggtttcaacatgtcagtgaaggaagtactggcagatgtagtggaaataacaagagaactaaaattagaagtggaacccaaagatgtgcctgaattactgccatctcatgagaaaactgagatggaatctactcctggtgaagatgctgtgaacattgctgaaatggcaacaaagggtttagaatattacataaccttagttaataaagcagtagtaggatttgagaggattggctccaaccatgaaagaaattctactgttcagaggtatatgagcagttttgttacttagataaatgtgtcatggggatttgttgtgcaaattatttcattacccaggtattaagtctagtacccattagttatttttcctgatcctctccctcctcctacccttcaataggccccagtgtgtgtttccctctatgtgtccatgttttctcattatttagctcccacttataatatagtatcttttggattagaatatcatataagggaagggtggctc

SEQ ID NO: 471503 - DNA, 566 bp, Homo sapiens
tgctagttaccagaagctgtgggttttgaagaagatggatggggatcctctgcagggctccagctgccactatgcaatctccagacaacacctgggctccaggtttcagcaaaaccctggtcactcttgaaaacatttatggtgtgtctattggcctaattgccacaactcttatagttcaggtcttgtattttgtccactttggcaagcccaccagtgacactgccgtcatcattcatgcagacagaaagtccagtcatgccacctgcctctctggttctatcccccatctctttccccatcatcccttcctggatctgagagcaccctgcattctgctcctgtggccaactaaagcttcactaccaaggcagcaagagtgtgtcttctgcccatccgtccccaaattatattttgttttgaaaaatttcaatcctatagaaatggaaataagcaatatctatttactcttgacctaaattcctcactgtcattattttgccatattttctttattgtcagtctttttatttttgtcttttgactgaatgatttggaagtaaatt

SEQ ID NO: 471504 - DNA, 680 bp, Homo sapiens
gtggtttgctgaatctatcaacccatcacctagtttgtgttgttcccctctctgtgtccatgcgttctcattgttcagctctcacttataagtgtggacatgcggtgtttggttatttgttcctgtgtcagtttgctgaggataatggcttccagctcctccaatgttcctgcaaaggacatgatcttctgagtgtttctgacataaagaagaaattggaaaaacaagaagggacactggagatgactccctcccagatagtagatattgccttcagtgtatacagttcttcagaagctaagaagttaaggccaggtacaatatatttaggaatggtgggaaaaatcccacaccaaagaaaggatggaaattcaggtaaggccttgggtcacagtgtgtgtactgtaatgagaaagatcactggaagttcatttgccccaaaaagaaaggactcaaggtccagaagaagaagaagatgccagggagaaggcccactggcagatggtggaagaggattgtgaccccaataaagaatgagaattcccaggggctcccctaaatctttcagagccaattaaaatattcccacaggagccctgggtacaattgaccttactaactgcttaaaggatgccctcttttgcatccaaattgacgaaaaggcccacatgttctttgcc

SEQ ID NO: 471505 - DNA, 3246 bp, Homo sapiens
tatcccagctgcttcagctccagtcatggctaaaaggggccaaggtagggctctagccattgtttcagagagcacaaggccaaaaccttggcagcttacacgtggccttgggcctgtgggtgcgcagaagtcaagaattgagctttgggaatctctgcctaggtttcagaggatttgtaggcggaagtttgctgcaggggtggtgccctcatggagaatgtctgctaggacagtgcagaggggaaatggggggttgaagcccccacacagagtctccactggggcactgcctggtggagctgtgagaagagggccactgtcctccagaccccagaatggtagatctaccaacagcttgcggcatgcacctggaaaagccaaggacgcctcatgccagcccttgaaagcagccaggggcggggctctaccctgcaaagtcacggggtggagctgctcaaaaccatgggagcccgcctcttgcatcagcgttgcgtaggttgttatgtctggctgtgggtgttggtcacgtgaagatgacagacgatgagcttgtgtataacgttcacttggctgtcaacttcttggtgtcattgctcaagaaaaactggcagaatgtccgggccttatatatcaagagcaccatgggcaagccccggtgcctatattaagacacatttgaataaattatattaccagtaaaaaaaaaaaaaaaagttcaattcacatagaatcattgagtcctgaccaaacactctgaaaaattgtgagatatgaataaaggtcgtatttatgttaagttttaataaaggtaagcaatatgaaaaatataaatgtattgtgatgtcagtaagattttaccatcccacttaatcttttgctttgaatttttaaaaagtagtgtattcattttggggagtatattgagactgagaaattttgaaacatgttttaagctcattttcaaaatctttgcattgttttaccagaactaaatttatgttagaagatcttgtgttagaagataccagtactaaatctgtgttagaagatagtaaattgctgttagaaggttgttttaccagtgctaaatttgtgttagggcacgaagattgtgttagatttgtgttcgtaaaatttgccaactataaccactaaggaaaatacatcagaatgattattggttatattgccatttaagtgttctcgataattgttttcactgaatttaaataaatataaaactcttaagttttaaaggaggataaattgctatgtgacttttcttagtaatgtcacaattagtaatcttgacaaggcatgttttaaaatagtaactattcattagcacaattacataaagaactaatataataatgtttaaagaacttttatattttttcaaaattttttccaagttgaaattcttaattctacatttctattcccgcagttgtttttcataataattaatatctttaagtaatatataatttttaaaatcaatgttatttactgaccataaagttcctttctatgtaatatctactgaaagattttccctgttagttgcccactaattttatatgaagtaactgtcatcagctatctaaaccagtaaatatttccaaatatattgtaaattttgaaacattatttattataaaaataacttcatatattatatttagatttcagaggtttaaaagctgaaaactacatcttattttaatttgacaattactttctttgtttggttgcgttttttttaaagactcagtcctaataatcttcctttcaaaatgtcttccaaatataatattttattcataaggaacaattaatgttcttcaaattttatggaaaaatcccaaatcccaaatttttactccctttggaagtattttccactgaaaacacgtcaagcaattctcagtacatccaaacacctcagttgctaagcaactgctaatgaattttccaccaaaaaggtttcagaccaggtcttcaagatatcaaatattcacacagcccttgatgcctttgcaaaatgtctctctattgtagcatgaaaaagttactgcaaataataagtagaagctactggttacagctataatgtggggggagaaagcaagcaaaaatcattttagtttactgtttctgaggcttggcttctttcattacattttacctaagaaaatgtagataatttaatagctataagtaaagactttattgtcttaattagtgtaagataatttaattgaaaatagtttaatgtaaatacattataaggctatttgaaaataaatacagcatatctttttatagaaagtgaatttttcaatagaagttatttttcttttctaatgttagtatttcataccacagatatctattttaaatagatatctattcattatatgttctttatatgctaatataacatacttgctattagctacttttaaatcagatgtataaatttacatttagcataatagttttttaatatgttaagttttaaatattttgttttaataaattttgaactcttaagaaaaatgcaattaataatattcttactgacttgcaagaagtacctctattgttttagaaattattctcatacatcaataaaaatgcatcactgtgtaatggaaagagaagaaaattagttctgaagctatcatgtaatagctgattgaattttggacaaataatattgcttatcatcagtatccttatctgtaatattttttaaattggagtaaggacaatacctccaaaggatttagcattattaaataaagttatagtcataagaatactttataaatcacacactaatatatacatatttattttaaattgtataacatgttggttttttattgaattaattactaaattacattataacattgtagtattacattataaaagtgatggacattgatcaaaaaatatattgagcttccacatatacttacaaaaatgtcaaataattttgcaattctatgttcaggaaaacaggatcccttcaatgcctagttagttgagggtttttaacataaagtatactttaactttttttttcattcattttgacactggaaaaatcttactattatatgtcttggaggatggccttcttttctagtatctctcagggggtttctgcatttcctgaatttgaatgtgcgtctctctagtgaggttgaggaagattttttcatggcgata

SEQ ID NO: 471506 - DNA, 693 bp, Homo sapiens
gccatggatattaatgtggcttttatctgtgaaacgggaagcttgggttggctttgaccatactgtgctatggagaagaccttaaattgtatctatctggagatctttgagctttcttatctagacttgttgaatggctttgaccaaaatgttaatagtgatatagacaataaggtccaggctgaggtggtctcagatagagatgaggaacttgctgggaactggagtaaaggtcactcttgttatgcaaagacactgatggcattttgcccctgccctagagaactgtggaacattgaacttgagagacatgatttagggtatctgatggaagaaatttctaagtggcaaagcattcaagaggaagcagagcataaaattttgaaaaatttgcaggctgactatgcaatagaaaagaaaacactattttctggggagaaattcaagctggctgcagaaatttgcataagtaatgagaaaccaagtgttaatcaacaagacaatggggaaatatctccaggccatgtcagagaccttcatagcagccacacctatcacagtcctggagacctaagagggaaaaatggtttcctggctgggcccagggtccccctgttctatgaagccctgggtcagcgtaccctgcatcccagctgctccagctccagccatggctaaaagaggccaatatac

SEQ ID NO: 471507 - DNA, 569 bp, Homo sapiens
gaagaccaaaggtagataaatccatgaagatgggaagaaaccaatgcaaaaagactgaaaattccaaaaaccagaacacctcttctcctccaaaggatcacaactcctcgccagcaagggaacaaaactggatagagaatgaatttgacgagttgacagaagtaggcttcagaaggtggataataaactcctcagagctaaaggagcatgttctaatccaatgcaaggaagctaagaaccttgaaaaaaggttagatgaattgctaactagaataaccagtttagagaagaacataaatgacctgatggagctgaaaaacatagcacgagaacttcatgatgcatacacaagtatcaatagccaaattgatcaagcagaagaaaggatatcagaggttgcagatcagctctgtgaaataaagaaatacagagaacaccacaaagatactccttgagaagagccaccccaaaagacataattgtcagattcaccaaggttgaaatgaaggaaaaaatgttaagggcagccagaaagctcaggttacccacaaagggaagcccatcagact

SEQ ID NO: 471508 - DNA, 555 bp, Homo sapiens
ctgtcagcagaaggggctcatgatgtggatacagcgtggactatggagatatcttcattgtgctgggctgcaagcatgtctgacctttgctttggagggagacactctctccatcttcctggactataagcaaaccagctctttccttcagagggacacattatctctttactccaagaaaattgatgctagatcctggagcctggctgagcccacaaatggggatccaatgggaatacatcgccagaagatggaattctataacaaacgttctacagttttagcagtaaagtcgaagtggctagaaaagagcatccagagtatcccaagctctgagcaggcacaagagggtgggaaaccaggcactgtggtcaggctaaggagggagcaggatgaccacagagatggctgtcggcctttgtacccgtcctcctgtaatttgattctaggaatgggtctggaagcaagacaaggtgatggggcaaatcttgtggagaatcagtaacaccaaggaaggaccacatttagtgccaaatacttgctcagaaaatcgta

SEQ ID NO: 471509 - DNA, 718 bp, Homo sapiens
cagctctgtgatgtaaggggctgctgtgaaggaaacttactatcatggcagaaggggaagaagcaagtcttaggtggaagcaggcaagagagagtgggtttgtaaaggtggaactgtcagacacttataaaaccatcaaatctcatcgtatgtcactcactatcatgaaaacatcatgggggatactgcccccacgatccaattaccttccaccaggtataggagatacatgtgaaggtttcttacatgaatattttcatgtcactggggtttggtgtacaaatggttgtgtcatccaggtagctgaatctgctggcaaaagagctatgatggcagctgctggcaaacacttcaattgggcagctgaggctgcactgcaagtgggtgcaaccaggtctttggggcaatatgaaagaatgtcaaaaaaattcatgtgtgagacctatgtcatgatatccaaataggatttgatctcaatctccagcctgatgctgaattcatatctccatttactttcagtgtgtggaatatgtaatgtatgcagactttaaatggtatgactcacaattgtaggtaatgttcttcattatgtacgaatgtatgctaaatggcattagaaagcataatgtggaacctgctaattgatactaaatagtgtataactgacagtctaggaacagttttcttgattttacatttaaaaaatatttttccatga

SEQ ID NO: 471510 - DNA, 1820 bp, Homo sapiens
cctggcatacacgtgcagaacgtgcagccccacatgcattaggtttttgtcctaatgctctccttccccttgcccccgaccccccgacaggccctggtgtgtgatgttcccctcactgtgtccatgatgatggttcttcacaaagatattatatcacatcttccaagtcccagtaacaagcagcacatgagttggaacttgaagaatatggtggagatgattgggtttagagtcagcataactgtcattgggcaaagaaatgatgcaatgactgaggttgagggtgtaagtcaaagccagtccagacaggatcccagatgctgccacattccttgcaatacagccccttccactatcttcaagttatggagcatgaaagaattaggaaaaattccacgttttatgacttcagaaaaatgcacacacacaaagatgcaggccaatcttaagaatattatacaaacagaatctacccacatataataagagtaacacatcatgaccaagaagattttatttctaaattaagaatgactcgatatgaaaaatatgtaaatattattttaaataatattaacagtaaatgttaaaagataaaagtattgtggaaaatccatgggtcaactcattattaatatttaattaacattaatacctatagaattaacattaaaacaatgggggaattctctaagttggctagatttcatgatatatgaagacaataaatttccactttaaaaacaaccaattaagagatatgatagcaaaaataccttatttatatgagcaaccaaatgacagaataactagcagtgaacctaacaataaatttgtgctatgtatttacttataaacatgtatgattttataatattcaatactatgaaacttccgattaaaaattatctataaatttattgcgatatctataaaatgttaataactatatttttcataagaggggttggggatagaattaaaaaagggatgaaaactttatttcaaagttattatggaaaagtaaaccggtaagactgactaatatgtaagaaagttatgaaaaggaagagtagtggttatggactagccttacaagatgtgaatatgtatttttttaactgttggaattgaagcggaatgttacaaatgcatcaatacagagactgctgatttttctgtccagtgttcgtccaactttgttaacagtacaaataaggtattatacaaataaattgtgaaagtcctacagatattgcattataaaaaataaatgaaaacatcctacaagattaaaataggttttctaaaagacattgtatttagaagataggctctactgtactgatagaagaaatgtttaaaaatctataaattgttgagacctaatatacatttttaaaaaatcaaccctgttaactatttccaatagccaaaacatagaaaaaaatgttcatcatagataaaaagataagcaaattttatcatatgcaaaacagtggaatatcctgcaaatataaaaaggaatgaagtactgatgcaagctctaatatggacaaaccttgaaaacgttatgctaagtgaatagccacacataaagttatatattgtttgattccatttatatgaagtatacagaacagaaagcagattagtagtttccaagggatcaaggcataactgcctagtgtgtactgcactgttctgaagggggatgaaaatgttttggatgtagaggtggtagtggtacaacattgtaaatgtactgaatgccattgaatagtttacgttaaaatagtaccaattttgctgaaattatt

SEQ ID NO: 471511 - DNA, 2946 bp, Homo sapiens
ccccgcagcagctgatccagacgggctgccaccactgtcaacaaggtttcactatgttgccctggctgggccttactggggtgcccgaaggtgcaggctgcagagatgccagggtcctgcaccggggaggacagccgcagctccacccaggagctcctacccggccaccttggaagatgcagggctcccacttgtccccagctcctgcctgcttcctggagcaagaggcccagatccacagctgtaatttgggcggctgtggccccacccaggaaggcagggctcctgcttgctgcatagagaaggaagcctgggtctgcagctgcagtttgggcagctgcattggcaggggagctcctgtcccaactcagaaggggcagggctcccaatggctccatggagtgtgcagccccagccgcgctttcctgttgcagctttttcctcatatcggtgtccactgcttcctggcttttatcctgtggagcagagaataacaaaaattatactgaaataattccacactaatagtcctgatatactttaaaaaggtaattttttattactatttctttcaaaatttgtgagcgctttgtattaaaaaaaaaaacactctctaattggataactttgtggacgacaacgctgtgctttcagcttttacatctttaaaatgggtttttgtgaagattaaaccaatgatatttgtaagcagcatgcttagcttctacttattcacattttgctcgtgctttgcgacttgatgtttctttcattttttgttttttgaatggtaatggagtttacccattttgctacattgctcttctggctgaagctgctcaatggtgaagtgttcttctgaccaacattagcctattttggtaatttaagctatctttaaaacttatcaaatttaccaagatattctcattagtattcattaaccatgagagatgctccatagtttggtaatattctttgtttagtgcttgaatttgtattcactatctttttgtcttaattgtcctcaccaaaggattgtgcaatgcaaggacattttcaagaaccagcattttcatttacttatttcccagcattttattagtatttttaattatttcgatgtgatttcattaaatttattttactcactccgaattttttatagaatactaagttatttcatatttattccaacttaataacagtatttaaagctacacattacatataggatatttaaatagctgaatgtgctgctattgatgtgattaaatttgatctttatgatcagcttgaaggattttataaatgttttatataagtgacttaagatgtcatcaaatttaatcaaggatttttagcaattgaaagaaaacttccataaaatatgtattaaattgaccctttgaaatatgttatttggctcctcctcccagttgtttattatttgccagcttgcactacatggaaacgcaaagctaaagcagaaaaccagtagtgattcccaagtttagatcatcttccaatcattgtaacaaatacatttgatgcaatgtgcaatgttatatgggaccaaagtacttgcctattttacctttaagataaaatgtttaccaagaagcattcctcaaacaaaatgccacagaaagaaaacataaaacatatcttagtaatgtaagatgttattagaagaagaaactgggtttgggatatatgggaaccctttgtactatcctcgcaatgtgcaatgtcctacaaaacattgcacattgcaaggcctaaatactttagtcctacataagattcattgcacatcacatcaaatgcaatgagaaagactgatgcctctttctttgcaagcagtctgtgtttatgtgtgcctatgtctgtgtgtgtctctgttttctttctggcagttccatttttaccctcaaaattaaaacctttcccctgaaatatattaataaaaattattttattaatatatttcacttcataaacaaaataagtcatatttatataggactaagaaaaacatagatcatagtgcttccgattatagaaataatacattttaaaagcaaaacctgagaaactacataaaattacacacataaaaacgaagaatacattcacttttccatcataacgactgctgacattttgatgaatatccttccaaactaccagagcagaaaacagcttgtgcaagatattttatcacagcattgtttcagattctataaaattcaaaaaaggcttgtttaataaatcttgctctatcacaaaatgaattactctgtaagtattacaaataaggaaataaatcaatgtgttaacgtggaaaacattccgcagcgcatttttattcaaaacaacagcaagttgcaaagcagtatgtcaggtagaattgcgttttattaataaacttttaattttagaacagttttagatatacagaaaaattgcaaggagtgtacagagagttgccacataccccaaacccagtttcttctaataacatcttaacattactaaggtatgtttcgtgtttaccttctgtagcattttatttcaggaatgtttcttcataaacatacaaatatctggatattgttatttgatgctaaaaacctttgccttttaacaaaaatgttttaatgtcttttaatttggtaaattttgataaaaaatgaaattcttattttctattctttgtcttttacggtatcagctttttcaaaaaactactgcctagcattaagcttttcatctcccaggtagctgttgtacatatctttatctatagttatgcctacgtgtacatcgataactatatttgcattttccctatatccgtgagtgttgtttgctcctgtcattattttaagaagttgataggagtgtactgagtctttcaataactgaaaatatctttctatt

SEQ ID NO: 471512 - DNA, 719 bp, Homo sapiens
ttgatggatttcccggctggagagcccacgaaagaggccccagtaacagtgccggaaaaggagcagtcagcgaagtaggaaggaactcaaagacaatggtgcactggaggtcaaacgacgaaagtgaacaggcaccaatcaggcctgaggttcaggcttctgtcaataagatccagaagcacaagatgaaagaactaaaagaacacagcatgggaagaaacagaaaggccagatgggagaatatttcaacaatgcaggcaagagatgacagcaccagggtgcagaatggtaacagtagaaatggtgacatcatagatatgtatgaaagcctctcagccgagggagaagctgccctacccagggctagtgagttcttagagacactaaagggcacagctgaagcatgtctttcctatgcaaaccaacccatcccaaatcactgccttattgaattctcacacaccaagccaatgtttcccctgctgttatcccaggaccagtgcttatagagtagatgcccttatgtactatattctgagtgacttcattagatataatttttagttcactcatttttccttcaattatttaaacaatatgttaattcatccattatatttttaaagggctttatttccaaaaattatgcttaattcttttcaaatttgcctatttccttttctcctttttatcatttttctaatatttttatttccttg

SEQ ID NO: 471513 - DNA, 2039 bp, Homo sapiens
ctctttttttttttttttcgacaagatataacagccatggttctggttgaggaaggcagattgtcagaagggcatagatcttctctgctcacttctttcttctgcccctcgtctgctcccagacagcctcggaatgactttgaagaatccaagagctcagtagagaaagtaactgcagatgtggtgaaaatagcaagagaactagaattagaaatggaccctgaagatgtgactgaattactacaatctcatgataaacctcaaatggatgaggaattgcttcttatgaatgagcaaagaaagtggtttcttgagatggcatctactcctggtgaagatgttgtgaacattgttgaaatgacagcaaaagatgtagactattatgtaaacttagttgataaagcagtaacaagttttgagaggactgactccagttttgaaggaagttctactgtggataaactgctatcaaacagcaccaaatgctacagagaaatcttttgtgaaaggaagaggcaattgatgcagcaaacttcactgtggtcttaacaagatagtatctgttgttaaatatatttttgtctcaaatatacaagtaacatattcaatgcatagaactgattcttttgctagagcttctctaattatttatgcattggctagaactaattctttagtatttctctaaagaaaagtccacatgaaaaaattactacctgaactgcttcatgtttaaaacacagtactgtaggctttatagttgaagggcatcttgtctggatagaaaatctttggttcatgttctcctccgaatatactgtaaatgttcgtgaaatggattctgtcttctgtttttgtcaagatgtttgagaccaacttaatgctctttctcttagaagcagatatgcatttatttgctaacatcttctcaaccagttgccattattcaactaatccctacaccaatcagactaataattacatatttactatgaatacatgtccagtactatactttgtgctatagtgaattagaaaagtataacagtgctctgggttttgatggactctttactgtaatcagctcttacctgaccaatgagttgactctgttaatcctgcctatgatattggaaatacaccattattggagctgttcacattcctaaagtatgtactatgagaaataagaacgtgacagaaaaactaagcatttgggcttcatagctgtttaagtttcaaggttttaatatgttcaaaatattcccattataattgaatttatctttattattcatcaatatatgcttataaatggtagcaaacatgcaggctgcacatttgttgaaataaatattttttagcttaaataatgtaaagtcttaaaaacttaattactctagaagaagaaacagagattctggaagagttggatatcttttaagttagaagtcagaaaaacttaaaaaaaaaacttgaagattgaattactaaggtttcaagctttcaagttggttatctctagtgccttagaaacaccagcattttcacagaaagaatttcatgatccaacctaaattaatatcatatataattactctttctattatataagatgctattatattagacaactgctccattactgttaaattagaactactgcctagataataattatacctgcttaagtctacaacacagtaaaatataattttatataacagattttcacaaggtggtccattaaagttctcttacagagttatcaataaaattaagacacgaaagaagtaatctgtcttggtgtcaatctcaaatactaatttgagtggatgtttttattttaagaaagctttttggttgttttacatattatgcaactttgtcatttccactgagatcttgaaagaagtattgcttttcatgactttgtcattagctcttggtacctgacctgcatttagcgaatgatgaaatttgaatgtgaattatgaacatttaggcatattcacttttataaaaatcatcatcattcc

SEQ ID NO: 471514 - DNA, 1124 bp, Homo sapiens
ggcactttgggaggccaaggcaggctgctgggaggtggaggttgcggcgtgtccggagtttgttccttctgatgttcagatgcgttcggagtttcttccttctggtgggttcatggtctcgctggcttcaggagtgaagctgcagaccttcgtgaccttcacggtgagtgttacagccgtgaaggtggcgcgtgtggagttgttcgttccttctggtgggttcgtggtctcgctagcttcaggagtgaagcttcagaccttcacgtggatcctgcaccagggccgcaggtggagctgcctgccagtcccgcaccctgcacctgcactcctcagcccttgggtggtcgatgggactgggcgctgtggagcagggggtggtgctggtcagggaggcttgggcctcgcaggagcccaccgtgtgggggaggctcaggcatggcaggctgcaggtcccgagccctgccccgcggggaggcagctaaggcccagggagaagtcaagcatagcagctgctggcccaggtgctaagcccctcactgcccgggctggcggggcccactggctgctggagcgtggggcccgcggacacccacgcctacccagaactcacgctggcccgcaagcaccgcgtgcagcccgggttcccgaccacgcctctccctccacaccttcccgcaagctgagggagccggctccggccttggccagcccagaaaggggctcccacagtgcagcggtgggctgaagggctcctcaagcaccgccagatttccctttctccatcacttcttccctaacacttagtttccctgtccccgactttctcactactaaaggacccctacattcctctagaaaccttgtgggactagattcttctgtcacataccctattcttaaaaataacaacaacaacaaaagccaatttaaatactttagaagatcatacttttcaaagattttactaaatcatttttttaaacaaaatatacattaaatctcagatttacagaatatagaaataatttatccaaagaaatttgcatttaaaattgttaatattgcacccaacagtatgtctttgacacatttgcattgtcaatctttcccacaatttgcaaaaa

SEQ ID NO: 471515 - DNA, 818 bp, Homo sapiens
agaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaactgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcagactgcatacgaggattggttcatcaccctctacaacgtgctgtacaccagcctgcccgtgctcctcatggggctgctcgaccagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagccatcttattaacagattttaaaatttatagtaatgacaaatgacttatcagtgttcatcatctgaaagctaagtggttc

SEQ ID NO: 471516 - DNA, 2101 bp, Homo sapiens
tgggttcatggtctcgctggcttcaggagtgaagctgcagaccttcgtggtgagtgttacagctgttaaggtggcgcgtctggagttgttcgttccttccggtgggttcgtggtctcgctagcttcaggagtgaagcttcagaccttcacggtgagtgttacagccgttaaggtggcgcgtgtggagttgttcgttccttccggtgggttcgtggtctcgctagcttcaggagtgaagcttcagaccttcacggtgagtgttacagccgttaaggtggcgcgtctgcagttgttcgttccttccggtgggttcgtggtctcgctagcttcaggagtgaagcttcagaccttcacggtgagtgttacagccgtgaaggtggcgcgtgtggagttgttcgttccttccggtgggttcgtggtctcgctagcttcaggagtgaagcttcagaccttcacggtgagtgttacagccgttaaggtggcgcgtgtggagttgttcgttccttccggtgggttcgtggtctcgctagcttcaggagtgaagcttcagaccttcacggtgagtgttacagccgttaaggtggcgcgtctgcagttgttcgttccttccggtgggttcgtggtctcgctagcttcaggagtgaagcttcagaccttcacggtgagtgttacagccgtgaaggtggcgcgtgtggagttgttcgttccttccggtgggttcgtggtctcgctagcttcaggagtgaagcttcagaccttcacggtgagtgttacagccgttaaggtggcgcgtgtggagttgttcgttccttccggtgggttcgtggtctcgctagcttcaggagtgaagcttcagaccttcacggtgagtgttacagccgttaaggtggcgcgtgtggagttgttcgttccttccggtgggttcgtggtctcgctagcttcaggagtgaagcttcagaccttcacggtgagtgttacagccgttaaggtggcgcgtctgcagttgttcgttccttccggtgggttcgtggtctcgctagcttcaggagtgaagcttcagaccttcacggtgagtgttacagccgtgaaggtggcgcgtgtggagttgttcgttccttctggtgggttcgtggtctcgctagcttcaggagtgaagcttcagaccttcacggtgagtgttacagccgttaacgtggcgcgtctggagttgttcattccttctggtgggtttgtggtctcgctagcttcaggagtgaagcttcagaccttcacggtgagtgttacagctcatagaggcagtgtggacccaaagagtgagcagtgacaagatttattgcaaagatgaaagaacaaagctcccacagtgtggaaggggaccccagtggattgcctccgctggctcgggcagcctgcttttattctcttatctggccccacccacatcctgctgattggtccattttacagagagctgattggtccattttacagagagctgattggtctgttttgacagggtgctgattggtgcgtttacaatccctgagctagacacaaaagttctccacatccccactagattagctagatacagagcgtctacacaaaggttctccaagtccccaccagagtagctagatatagagtgtcgattggtgcattcacaaaccctgagctagacacagggtgctgattggtgtgtttacaaaccttaagctagatacagggtgccgattggtgtatttacaatccgttagctagacataaaggttctccaagtccccaccagagtagccagatagagtgtggattggtgcattcacaaaccctgagctagacacagggtgctgattggtgtgtttacaaaccttgagctagatacagagcgctgattggtgtatttacaatcccttagctagacataaaggttctccaagtccccactagactcaggagcccagctggcttcacccagtggatcctgcaccagggccgcaggtggagctgcctgccagtcccgcaccctgcacctgcactcctcagcccttgggtggtcgatgggactgggcgctgtggagcagggggtggtgctggtcaggga

SEQ ID NO: 471517 - DNA, 1005 bp, Homo sapiens
ccctctgtaatatgctttctacaattcacagtgagactaatgaattgggagagacctctggacctctagaatgtctaagaaggcagttggtatcctgccatagaaagggcctatggaaatttgcaaaggaagtgagggaggtctgccttctttctttcatatacctgagatcagtctggtccttcagagatgataagttgctcagtccctatgtcccaactccaaatttctgggagatatttcatttactgcaacttgggtcacattcactggtggtgcagtctgcagtaacgtgccccagtgagaggaaaaagacaggaaaaagtttacttccccatggaaatgatttatgctggacctcttggaaggtccagttgtctggctagaaacagttgaagtctaaaatacccatagctttctttctgtacaggagtggaagacaagtttcagaatgtttgagcccttcacccaaaggcacacaaggcaggtggggaggcaggaatctaacccaggctgaagtttctagatctagtatttgtactaagctgccatgctgctttatgtctgtgaccatgttggaaaaagtgttttagctgtaccatcacttagttacaactattctgattctgtttaatcatccacctaacttcatagaagttaggctcaagcttctattttcttaatgtttacatttttccaatataaaataatagaaaaaaattgctcattatactgggcccagcagtccccagtctttttggcaccaaggactggttttgtggaggacaatttttccacaaaccagggtgggggatggttttgggatgattcaagtgcattacatttattgtgcactttgtttctattattattacattgtaatatataatgaaataattatacagctcaccataatgtagaatcagtgggagccctgagcttgttttcctgcaactagatggtcccatctgggggtgatgggagacagtgacagatcatcactct

SEQ ID NO: 471518 - DNA, 800 bp, Homo sapiens
agaagctggggaaattaagtccttgggtctgtagcacagtttgagctgtgaaagtcgttatgaccagaagattgtctagccttctctgcgctcctgttctcttccgggtgacttcagctttcacatggcaggaggactgtctcgccttcttagtacagactttctacaacagcgctggggacaaaatcacaggaaagtacaagaagcagggtggaaacgtgcattcaaatgataaactggctgaaggatctaaattctatatcagcaaaccttcaaaaaacaaaggagtaattaagacatttacagatgaacaaaaactgagagaagtcatctttagcagacttgccctacaagaaattctgaaaggaatccttcagcataaaatgagagaaccctacatgttaaatccacatgaagaaataaaaagtatggtaaagaatgttcaagccatctccaaggagcaagaaaccagtcaggattcagtgaagatctgtccacaaataagaaactatgacattggaaggtacttgctttatcttgtgaccctcaagtccctgagctcagttaacggggtgcaagagaaccacgaggaaataggaagtgaggcctggtatgcagagggacgactcaaacaggtgattaaggaattaaccagtcacttgttggaggataatgcctcagtgagcaagaggcatcccgagttcatagcagacaaggacgcctgacagctctggtggtccctgacaagtctgacacccacggagaagcctgaggggacgaagctggcctgggtgatgggc

SEQ ID NO: 471519 - DNA, 606 bp, Homo sapiens
gtgacttttgtgcacctggatggggcccatagatttttcatgacacaaatggagactgaggtgggggagagtcggacagaccagggagaggggatgctgaggcctgaaggagaagagactaaggagctacacagtgtggggagagggagaaggaggcaatgggaggaaagagatgtccccaagagggaatactgtgcagctacaaagtacgctgctctgatctcccttcaaggcaacctgccgcatagagagaaactggtgcactgcgttctgcatattctgatctgtttcagccctcacagggagcccccagcacccccactgcactcctcaagctgctcccagtccatcactgagcagagtgaatgctcctttgccttgaagatctccatctgctgggcttccctgagattgctcctccccaggcctccttcctcccctcactcctcccacagctgcatggtgcttttcatcaacaaatggatctgaggtgcaattagtaaatgtgaaaggatctctcaggacagccacaaaaggggttgctaagtttggaagcttctctgagtacctcgcacatggtaagtcccattaaatatttgttaatgc

SEQ ID NO: 471520 - DNA, 1110 bp, Homo sapiens
atccttggtctgtgactttcagagatttccaggagctgctgtttcttgatttgagttctagaggctgctctggcctgtagtgtgggccctaaagccaaggtctggtgtccttatgaggaaagagagatttggagacacaaacacagagacacacagagaaggcaacgggacaacagaggcagagattggagtgatgtgtctgcaagacaaggaagtccatggatggttcgttccagcagacattgaaaggggcaaggaaggatccattccaagtgtcttaagagagtgcctggactggtccaggagattcaatattcaatccactcatcaaggtcgtctgtgtagacagccattcactacctatagacgctcctcaagaaacagatgctttctggttttctgccaagaatgtcaacatcagattactcctaagtatcactcatttccacgtgaattagacagaacagtgttaagtggtttggagccacagctggctctcaatactgcttcaactcacactctgagaagaacgacagttgactgagccagcttccacacctctcaagagagtttgctgttttattccaaggggcagtaacaggaacatttctgcttgctgcggcccctaaatgtgcagcattctttagaccattatatggtgctttccccttctcagcgttcagaaacgttgagaaggaaagagcctcatcctattttttagcttcttggaggttgcagttgcttatcttttttctccactgggatatatttttctcttgcccattttttatgctgaattttctaaactcctttataatgcttttgctggtcctgttggcacaacctactgacaaccctacaacaaccaagggcctagtctcccttctgttttaagcccatcaagcaagaacaaaagggatataaacacttcctgttccattggaacgtcgttaagaaaattagcctgattgtaaatattacctattgaatccgtccttatgtaactttgttaatcacacaaacagccacacatccatattcagaagctaaaaagagaaaacagcatatggctgacaaaaggcgtgtacccagtgcaagatttttcaaaga

SEQ ID NO: 471521 - DNA, 691 bp, Homo sapiens
ggagggacaaaaatgcaagccacaacacaaggagaggaccccagacaggcccacacctgccctgctggccttctactccctcttccccgagctttcccttcagccatagcactcaaagcccaaatccctcaaggaaggataaggaagctggcacttcaagaagttcattatctgccacccataataccagggcggtctgagttaggtatggataatgcagataacattgaatcccatgctgagaaagaaagaaaccaaaagggctcagagggtgaggcagtaggaacacaagcaacaattctactgcacacgattgccactgggttcacctcctgttacccacatttctgtgatactggctcaacactgaaattcctaggggaaagcttccaactggctgtggctgttagacacgaaccaggcttcatggagaaaagcctgattgcaggactggggtacaagatgggtcaagaatgcagctacccccacatgtgtgggacaccagacaaatagtttctgtaaactctctgtccatataaaatatttgattaaaaatgtattgcaaaattcatgagatcaggaaatgacttttattttattctccaatactttgcttgaagtttttaaaattatatttttaatttctaacaattctttttttgttgttttcaaaatgttccttatgtttagc

SEQ ID NO: 471522 - DNA, 528 bp, Homo sapiens
tccctgacctgctagtccagcgctagtctggattcctccagacttcttgtttggtcaaataacaagatgccatcattgtttaagccatgccaaaaagcgagagctgatcagtgtcaagaggataaaagccatcatcaaaagttacagaaagtcaaggaaatacaccaagaaaggcaggtcaaggtggaagcagggtcaccactaagtctgaggggagcagcttccaatgctcgcatagctaattttcttttccctcctccacaccccaagtttgcctatgagaagaacagaaaacaaagggtagaactaattgacaaagatccttcctgctctaacatctatgattcttttaattatatctgcccacaattcccagatgttcatagtctccccaaaagaagggatttttctcttgaaaccaagctagacagctacaaatatgttctaaatttcacaggccctgttccctatggaaacacttatgattaaacccaattcccaattcaaattaaaatttagcattagaga

SEQ ID NO: 471523 - DNA, 2602 bp, Homo sapiens
agaggggagagtccataatgaggaagccctctggggtgatttatttatgctgtcagccattggcagcttgcttcccactccaccccagtgcccttgagcatgaagctgtgccctactgcgtcctcctggagcaagcttggagtccccaccccccaggttttgatctgagcaccatcaatcacacacatacagaaaatccccccactgcccctctattttctatttatgttctcttcattactgtgcattacagtaaacagaattgtgcaaacggtgcttttagcaggaatatagttctgataagtgcttggatcaaggggaagacagacctccaaacatggctggggggctgtttggtggaagaaaggtttcaagtggagtcggggagcacagtcagggcttccaccgccagcaggtgaactagagtgccacctgccgggagtcttctaactgcactaagccctgcaccttccacaaggtccaagccccttccttcactttgttcctaatatccttgtccccattccccaccctgcagatcactacccatgcaagcattatcttcctagaagtagcttaaagggctttttcctggtcctttgaaactgtaacctctgcctcttctaattcattgccaaggagaaatcaacagttctgctgtcatagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcatcaccaccttcgataaatctagaaactggatttgatttcttgagagtctagtgatgaggctctttttaataaaaaccttgccactgcttctgtccctgaccccctacgaagggccagagatgttgagtgacttcctccaggccacacagtggagtcatatggcactggccagggtgagaactgacagtaggcactgacccctgactctggcctttttcaatcagttgctttgctttatttctggttttattccagagaaaagagataggagagtccttttggtcaatgattgagcacaactcacatctctttgggtttcgagtaaaatggtccttgacttcccaaagctaattaaaatgtaaaactcttgctttatttcaaataactttagttcagacctaatttattgctaaggtggttctcagggaggtagagcattggaatagacaagtgtgtctcctttaaaagtcaagggtatgataaatgagaattttttttcccctgtgacaatttatcttcaagttccaggtggccctttgtgtaaaaggagggaaaatccatcccaaaacaaaacaaacctggtagagcattcaaatttgatgttgaaaaaaattgtttctgtgtgtctaaatgcccaaaattttgttctaaaaatgagcaggaacatatctgaatcagatataaaaatgggtgttaaatgtattttgtaagctttgactaaagaagtttcttccagctgtgtagtcttcgaatctgtggacgtgcctttctcaggagttgttgggttccactgtcaaaaccttttccagtaaaacatggatttggcaacagtaagtgtagcctttttggcctactttatatgcatcactgcatcttactaaaatgaggcattacactctacaaggacttgtactgaatgcatttcctttgtagtgaactcaatatgcttttgaaaagatattttacagaactgccacataaacaagaccttttctattatctgttttgaccctaaatactgaaaagtgtgtggagtaagataattttatgcttttctgaatcagtgccatagatccccaaacctaaaagatgtaggggaaaaattcgtcttggatgcaattgcctcctaatgtataccagagttcatttctgttcatgttcaagggacaagagtgaattctgtattcactttcaatgactaacccttctcatcctttccttcattcttctgaagaggaagaggtggacttcctgttgaagaccaaatcctctcctgccttctcaggaccccatgcttcctgtatatagatgtccctgcttttgtgaagttttctctgtcctcctaaattgggatctctttggaccatccctccctttgcatttagaacatagataggtatcgcctgctgacttgtcagtgtcagcccattagattaagatccagaagaggaggttagatacagcatacaggaggcagccaataaatatctgtgaataagttaataaatacttttcttttatatgacactgtttctacccattgtatttccccca

SEQ ID NO: 471524 - DNA, 529 bp, Homo sapiens
tttggatgcatgaattcttttttttattattatactttaagttctagggtacatgtgcacaatgtgtagctcatatagcaaaaggcaagaatcaatcggaaaattgcctgtcatgaactggggcttagtcaccttgactctagaaagaatcatctttacccgactctcaactttccttgctgcttttgttgtctcatatggaggtcctgggaagcatcattcagcaaaagtaattttagatgataacttcacaaacacttttgagtacagttatgtggaagacatcatgctagattctggggatatgaaaaggagtaaaattcagcacttacttcagagcaactcacagtgcaatgaggacgatagcaagtcaaggggtagatccccaactggaaggatcatggaagggcataggagagaccttcaatccagacataggccttaaaagcttggggggaatcagctttaccaataaagctgatttttaaaaagactctcatttttgtgtcttatttctattcgatctaaa

SEQ ID NO: 471525 - DNA, 1693 bp, Homo sapiens
ctgcttcacaggtagtaagctgatgagggggtggagccaagatggccgaataggaacagctccagtctacagctcccagtgtgagcgatgcagaagatgggtgatttccgcatttccaactgaggtaccgggttcatctcactggggagtgtcggaaagtgggtgcagtgcactgagcatgagccgaagcagggtgaggcattgcctcacccaggaagcacaggggtcagggaattccctttcctagtcaaagaaaggggtgacagacggcacctggaaaatcgggtcactcccaccctaatactgcgcttttccaacggtcttagcaaacagcacacgaggagattatatcccgcacttggcttagagggtcctacgcccatggagccgtgctttattgctagcacagcagtctgagatcaaactgcaaggtggcagcgaggctggaggaggggcgcccgccattgccgaggcttgagtaggtaaactaagtggcgggaagctcgaactgggtggagcccacctcagctcaaggaggcctgcctgcctctgtagactccacctctgggggcagggcatagccaaacaaaaagcagcagaatcctctgcagacttaaatgtccctgtctgacagctttgaagagagtagcggttctcccagcacacagctggagatctgcaaatggacagagtgcctcctcaagtgggtccctgacccccaagtagcctaactgggaggcaccctccagtaggggcagactgacacctcacacggccaggtcctcctctgagacaaaacttccagaggaacaaccaggcagcaacatttgctgttcaccaatatccgctgttctgcagcctctgctgctgacacccaggaaaacggtctggagtggacctccagcaaactccaacagacctgcagctgagggtcctgactattagaaggaaaactaacaaacagaaaggacatccacaccaaaaccccatctgtacgtcactatcatcaaagaccaaagatgatcaaactactccgagctaaaggaggaagttcgaacccatggcaaataaaactacatgacgaatgcacaagcctcagtagccgattcgatcaactggaagaaagggtatcagtgatggaagatcaaatgaatgaaatgaagcgagaagagaagtttagagaaaaaagaataaaaagaaacgagcaaagcctccaagaaatatgggactatgtgaaaagaccaaatctacgtctgattggtgtacctgaaagtgacggggtgaatggaaccaagttggaaaacactctgcaggatattatacaggagaactttcccaatctagcaaggcaggccaactttcaaattcaggaaatacagagaatgccacaaagatactcctcgagaagagcaactcagtttggaaaagatgtcagtactgtttaaattggttcttaggttcagcaaaatctctatgaaaatattagaaagctttctttttgaagttaacaggatgattctaaaatttatatggaaatgaaaagcagaaatgaaatcatcaagaagataaagaaagggggaggacatgcacgggcgggcattttttaaacttataaaactacaatgacgaggaaagcgtgacacagcactgactatactaataaatcaatgaaatagaagtaaatctgtattta

SEQ ID NO: 471526 - DNA, 583 bp, Homo sapiens
aaatgaacacattaagtggatgcattaaatgagcgatgaagacaataaatgccagaggcagggccgtcacttagggcaggtaggcatcctcttaaaccaagttcaggttttactgaataggcaatgggagtcaaaggtggtttttgagcaatgcagtgatgaaggagttaacagtgaagacataggggagatcatggagggtgggaaacaagagcaaagcccacaagaagaaaggagcgtggctgtacagggcaagaaggatgaggattcacactggggaggaagcagtggagatgaagaggagtggacagatatgggatctactttggaggtggagtcaacaggactagctgacgggttggaactacataagggaaagtctgcacacaggctgttaacgacggcaggaaagaaacttggtgcaaatgtggccaagcacgttacagacgctcctccgtatgcagcccaggggcttcacctggtttagccatttttctgatgctatattttccggctccctggcatctttagagttttgaatttggcagccttccctttgatggaaggaagctggaagtacctc

SEQ ID NO: 471527 - DNA, 741 bp, Homo sapiens
ggcacactgcttctcagggtgatgcggtgcctcacgctcggaagcgctgactggttgttgagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttatgacctggccactttctctttggaggtatgtgtatgatagtgagcatgtgagagtgcagaataaagagcctgaagacagcaatcaagtgaagatgggggacagatattatgttcttgccccaaaaaatgagagagtaaaaggatttctgctgctgacaccgtcctccaccctcctgtcctccatgaccttgggccaaagtccttgggaagagaggaatttgaaatgcggtcagatgttatgggatcctggatcagaagatggcactaatggaaccacaggtgaaatgcgaaaagggctgtagtttatagcatgtcagcattcatttcctgactttaatatcaaaatgtgacgtcaccatttggtgagtctgaatgacgggcatatgggaaaactttgttatatttttgcaactgttttgtaaacctgaaattgtttcaaagtaaaaagttaa

SEQ ID NO: 471528 - DNA, 544 bp, Homo sapiens
gtggtgtaggcacccgagggaatctcctggtttgtgagttgggagggagttccctgaccccttgcacttccaaggtgaggtgacgtcccacgctgcttctgctcaccctccatgggctgcacccactgtctaaccagtcccaatgagatgaacccggtgcctcagttggaaatgcagaaatcacccaccttctgcattagtctcactgggagctgcagacctgagctgttcctatttggccatcttgtccggacatcagaatctgaatttccagcaggtccctggatggtgccactggccgtcaggcccagtgctgagaaccctggagtctcccatccgcctctcacagctcaggagtcaccagagaatctggaatcaaagcagaggaaaggtcaaaaggatgtccccgctttaggaaataactcttcatccacatatagggtgagaggagtgaggtggggcatagtcaggacaggggtcaggggagtggtggggagcccagtgagaaatggccctgagagagcctaaaccaggagaggcagac

SEQ ID NO: 471529 - DNA, 764 bp, Homo sapiens
ccgtcgagttaccctttgctaaaggaaccatttctgtattcagtacagatgccctttattgaggaatggcatacttagaaaccaagatctgggcaccagatgtgctcattgctattggggtagcaccgatcccaggccgtcttagtgatgtggtgctattgaaaatatgcgccgtgcttgtaaatcccagagagaggatgaagacgctgcaggaagctgtggagagtagaggagatgcagaggaaggcatgggcaacacggaagctcttgcaagtgcctcacagataggacacatgctgccagagaatgagggagaggagaggggagagcgaggaaacgtggaaaaagtccaaagggtggtcagtgtccaggccaccaaaccagctgtgccccctggcgggcagtcgcctctcaggatccatcttcccacggagaccccgtccttcctgagggccccgtttcccccgttgccagggagtggttctctggtccttgggaatgggcttgtttcacgtccctaaagtggcagtgttgagtccacagggaggcaagaactgaggttgctgcaggcccatacagattcgccatccatgacaatcatgtgggtagatacagatttttctctgactcagaccagagaaggcacttggttggcaaatcttttttccttagagtaatcagttaattatcatgataataatgtttatgtaaagtctggatttcctttgaaaagctgactttgcactcattctattaaagagtct

SEQ ID NO: 471530 - DNA, 593 bp, Homo sapiens
ccggcttttcttatccagaatgccaataatgtcacttacgtgtgttgatgagagggaaccctcactctgcccctgccccaaccgcaataaaaatcaaagccatgtggccctccctttgctcaagccattctgggcccacatgggagctggccctgctctaagtcccatggtcaccaccaccatacttgacagatcctgctggagagctgctgaccagggcgtcatctacaccctgactgaagtatccctggtcaaggacagcataacacaattggccggcttcagtcagaggcagagtttgtcctggccaacaccagccctatttgcacatttgcagagactcttgaagcattggcagtggtctggccttgtggtctcaccagtggcaacaacattactgtcttatccaaggttaccctctgtggggtaaggaacacttagaattcctcatctcacagagatacataaaatatgaatcaagatcttatgtgcctctgtatatgcaaaaaccacaacactaggcctcagaactccagactatgtggctctggttcagttcctctcaaggcatgccacggccgtgatcatagtac

SEQ ID NO: 471531 - DNA, 638 bp, Homo sapiens
cagaaacactgaagccacagctgtcagatgcctctgaaaccacaacaggctgattctgcacaaggcattcggcaaggcatcgtttcattcagtctcctccacaacacagcagttcaggactgcaaggtcattgatgtaagcagcagacctacaaattactcacccccaaaagtgcccgtgccacatagagcatctccatgttcaggaagcatgtgggcatcccagagggtgtatgggaaagccattaagaaaacaaactacttttcccaaggactccttcctgaagcaatgactgaatttgtatttgaatataacttgctttttccccagcaagagcatgatggcgttgtgtgtgtgcctgagagagagagaaagagagagagagagagcgcaccagttgaaagactatggaattcagaaatcatcaagtttcattatctgttgtcaagaggaacagcagctgtgaattctagagtgaatggctatgtgggccgtcccacagatttttgattattgacttcccttctaattgtcagcagcctttcagacagtttaggatgggtgtcatcttttctaactgtggctgtttttaaacagaaagacaaggggtatgtgtagtatgtctccctttcatgttt

SEQ ID NO: 471532 - DNA, 488 bp, Homo sapiens
gatgtctagcagagtgtcttgcatgcagccagtgagggctgcggagatgaaggtgactctgaagacgcgtcctttctgctgggagcagaagatgagtagggcagtcagtcaaggaagggtgtgtgggaggaccggagaggagatgaaggaggaagggagagcagacaatgtgggtattcagcaagcagcctttcatgtggtgattcagggactcaagcatcttctacctgtgtctcctcaagctctggggtcctctgttgattctgatgctttggatgcagatgagaaaaagagagagagagagagagaggaggatcactgtgggaggattttatgggtcagtcctaaaagaaaaaaccagtacttctgcctacagtctctgactggaactattacatggctacacctgcctgtaagggactgggacccacagacgagtcatgtgctcagtaggagaaggaaaatgatgttgtgaacacatcgaagtg

SEQ ID NO: 471533 - DNA, 701 bp, Homo sapiens
ttaatcaagacctgtggtcagcagttccttttacctggtacctcagggtcgtatgttcttaattaactaccctcagctttgcgggtacaagctccgaggagagaaaggaatgaagaagccaggctattgggtgattgcgggacaggggaggttcaggggaatgctggccctgggccattttctgctgcagagcggaggtcccagggatatcaggctagctggcactgcccaagggccacccacaccactgagaataggacgggtgatgatggtttcaaagtccaagaccctggttcccagtctgagatataagggagataaaggggaagcttgccgaattcacctcagtgtcaccaagtccagggatccccagaaagaaagaggcattgatgtggaaaatcctctatcctcttcttccagccacagctctgaaatggaggaagtttggaagcatgttggtcactggctgctgaggcctggacctccactttcactgttgatctcttcttttggtaacaaccagtcttttgcaaaatcaaatgagaggaggctgaaaaagagctgagcattgctggttccgtaagtgagaactttttatattgaaataataattctagttttaaaagacagagagagcaggaagattaagacatattaacatggtgatagaaagccaataaatcgtgctaatgctttccagt

SEQ ID NO: 471534 - DNA, 964 bp, Homo sapiens
tgcccacatattataatttagattgaaagggtcagttccttgaaatatgaaaactaccaaaactcacacgaggaaaaatagacaaccgaacatccctacctattcaaaattttctgcccttccttcctctaacacatattcaccggtacactgttatggagagataatggaagatgatggtgtcacaaggcgaggccttttggaagtgattaagtcagaaagctctaccctcatgaatgggttactgccttataaaagaggtggaaaggagtaccctagtgactttgtccttttcccttccacctcccgccatgtgaggatgcagcaagaaagtcctcagcagacacctgatctgaggcctggattttggacttctgagcctccagaattctacagtcaagttgctcagtatcattgtggaatccccagtccacctgtacttcagagccacgagacgtattcggaaactcttgtggaacattaaattattttattatgtatgtttaatatgtggatatatcttatttaatttttataaacttttattctttaattcaatgttaaaatttattattttatcatattttctaaaaatcatatttaggtatattttgtatattatttatataattacgttatgaatatattgaatgttttgtttgttttgtctttgcatagtattttctaacttattaatatagaaaattatattattatgttatgtaatttgaactattctggattacagaggaataataacttttttgcaagactgcattttccctctgtttctgcagtgtgctgctgattggtctgtgccaatctgtcactctgcatacctttgcatttatttttaagtggcattttgatgatatgtgtgactcatgcgatgctaatgatacttttcatattcaattcaattttgtcttatatactgtaccgacatagccacaaaattactagc

SEQ ID NO: 471535 - DNA, 715 bp, Homo sapiens
tctctgcaaccactgttttatttgcagtctctattactttgtctctttcaccggaatcaagccacgaatgatgtacgttcccttaaaaaactttcttctgattttggtgaaatctgtttgtgtcttctccaaaatttgtgatgtggccactccaaaatttgtgtttgtgtcccctccaaaatttcgttgcagagccgtgcggtcccctagccacgttttcaggcaaaatacctgtgtcagtgaacttcttccatccgtcacttggcaagagtctctgggaaagaccggacgggtggtgccccgcatgaggattgctgcagcagatcatgatggaaccctcgaaaatgaagaagaagagactgcacaatcagtaagtcaattagtcattgatacccacttgggatttccaagtttgagggaattgttcaggctaggatttcatcatgggacaacagttatcagctcaatagaaacagtatataaaagtattgaaacagctgcttaaagctagtggagcctcggttttgcaggctcaattaaggggcctaatgtaacctgttgtttcccataacccatggttcccagaagaaggcacactagacatagagctcttgtaacaagttgggagaaatcttaaataacataatgcacaagggcaacgggtcccagtaacatctctaacattatgggccttagttagggtggctttggtccc

SEQ ID NO: 471536 - DNA, 672 bp, Homo sapiens
cccctgaccatctgtgtggtaatgactactccgtgcatagccctcatccctagtcagctttgcgctagagcaatcacaattttgtgtcaagataaacatgtagatcaaagggacagaatagagtccagatatagaccagtccccatatggtcaactgattttcaacaaagattcgtaggctgtacagaaagcataacattagcatctgatcagcttctggtgaggcttcagggagcttttactcatagcagaaagcaaagtgggacccagtttgcagcagttggaaaaaggctttcatggggcagttactacagaaatccagagtttctagctcgctcacaaatgtatggaatcagatttcccttggccaaacagaaacttgtggtcacagtgcaagaaactggcctaagatctaaggaaatacagacacctacagaaaaagatgaaatgccagaacttggaacagatgtagcttgacacaagtaaaaagaagaactatgaagtttagctctcagttaattaagtaaaataaaaatatctccaaattccttgtcttaagtgaaaaacattgtgatttctctaaatgaaactaaagaagaacagtgtagcaatttaacttatgtagatctgaccaagacaatttacttcccatcatctgactggctttattaa

SEQ ID NO: 471537 - DNA, 793 bp, Homo sapiens
tctcttcacacggactcgagagcacacaacctatatccctgcatgcgcaattcacaatatggttcgagctctaggacaatctgttgccatccctgatcagacagaaggtggagctcaggcggtaatgctgcctcacctgctgctacctccctgtggagcccagttcctaacaggccatggaacagtactgccagtcaatccatgtccccagattgttcatgaccctctcctgaatcttctcatgaatctgctgatatgtccagcagaagtcgtgtttacatttggagcattgcatgtgattgcagcctccattcttctcaatgcagatgttgtattcgggacagtctttagtgtgagcactactgtagtcggctgtttcagagttgtctgcacacttcttgagccattttcggatggtgatgcggtctgtgggtgcgtgatatatttgatgacacttgaaacagaagacctcgttgcaccgattgcactatactcggtgagctctaggctcctgtacccgaacaaccatgaggcagtctgcaccagggcacagctggagctagtaatgactcttcacatagtccctgaagaggtagcacctgtatttctccctcaattcttcattgggaagcaatggaaacacaaagtcctctggtgtatggagtgggacagtcctgagccatgcaagcgactcccacacccacaccatccttaacgagaactgagcagtgctgctcccagcagctacggcaaaactggtgctgacagaccagggagagtaggtttttctttc

SEQ ID NO: 471538 - DNA, 1918 bp, Homo sapiens
gggtattttttcagactgagtcttaaaaacgcattagactttccatctgttgttactgcaatggaatgctaacgtagcagggcggcggcgggggaggtgaagtatgcaaatgtatgatttagacatacagaagaactttaaaatccactcccattgtctcagacaacagaacatatgtttaccagaagatcttgatcctaaacagattgctacagacacaaagatgaagggtgagggtatacatcctattagcagctccaagcagctgctagcatgtagcagagaatacagatgtcagtggcccagggcagatggctatcaggctctgctgaatgcgggctccagctccctttatcctggggcagctttcctagcacactggtcagcctgctccctaggctataagacactgtgggctggagttctgctaggtcctggcgttgtgacacttcggcatctaggtgaatgtggggagatatcaaggttccctgtcacttgcatgctgaattttagtgtctgtctctcttacaagctctattcatagtatggttacctgttcgctgtttggtccttatctgtggagaagattccctccattctgtcaacatcaaaatatactcaagtagagtatttaggcttattggtgaacttagagtaaaatttatgtattattttttattcatagaattgaaacaacagtatggttacttttctttatttatacttcaatgggataagattatatttttacaaaatgagttgaatatacaattattaaactgatacatttgcatattaatgtcctattttagcaataaaaaaattaccagtctgatatcttattgtttagggttaaaaattaaattagtgaaaaaatactagaaataatgttatagaactggatataaaactgttggttaaaaattatatctacatctttaaagctgaaacaagcctgataacaaaagttgatgtattttaatgttttaattgattggaaaacttgctaaataattgtgcaaattttctagattttaggatatataattttttagattataacaaattatgaggttttccttcagcataaatataaggagtgtgcggaaatgtgggtaaataatagaataggtcatctttatatcacttagttatgggtttaataagggaaatattttgttctttcttgcttttgtgccttgttttgattaagtgctattgtttttctgcattgttcaagttcatgtaaaaagtagaataaactcattctgagagaaatattccatttttctaaaacttcccacatatgtgcattactgtttttctcaaagagacttcgaatgaacaaactttatattatgagaaagtttgaagttgacttcagcgtaacagtgttttgtcttaagcatcagattcactgtattcaccaatagcgggaaagttacaaccgagtccaattttcaaagctcagcaagaatgtgctacttcagaaactaaaaattaaaaaaaaaaatgtaattttaattttaaaaagtacaaatttgtttagagtaagtagaggacatcaatcatttatttacttatttgacaatcatatttgagaaaactgggcatctgcttggcaatgaaaatttaaagacaagacaatgtttatatcttagaggagagtatgtggcaccattagcaatggagtttcctcaaataatattataaaggctttatggcaagtattttctatagggtattacatggaaattcaagaatggctaaatttattagagacaataaacctaaattttcataaaatgtcatttgtcaaccagaaactcgttatttggctccttttaccaatgatgctgtaatggcttttgttcataaataataccttaagaagttactttaggaaataacagaattc

SEQ ID NO: 471539 - DNA, 495 bp, Homo sapiens
agcattgatggttcaacttgaatgatgagtagggcaaggtttgcagagtgtggacgaagggtgctcctggatgtaggaatagcatttagtgaatttctgaactcgaaaagagcactgagatttttaaaatctgaagaagacaggaagacgtgggaaagtttggaacttcctagagacttgttgaatggctgtgaccaaaatgttgatggtgatatggacaataacatccaggctgaggtggtctcatatggagatgaggaacttgttgggaactggagtaaaggtcactcttgttgtgttttagcaaagagactggcagcattttgcacctcctgccctagagatctgtggaactttgaacttgagagagatgatttaagggatttgcataagtagcgaagagccaaatgttaattcctaagacaatggtgaaaatgtctccagggcttgtcagagaccttcatggcagccctcccatctcaggcctagatgcct

SEQ ID NO: 471540 - DNA, 1268 bp, Homo sapiens
agggtgatgtttatgattaagaagacctgtttaaacatggttatacctattaaatataagttggtgctgctgctgtttttgtttctctgggaaagctatcttgcttatgtgtggaagcccaaggatatagcagacacgatccctattattaagcagcttagagagacaagccctacaccacagatggataatataacaatgcacgatagcagtgacaagacatttagcagcacccctggcctctacttttttgatgccattgcacctcgtccccattatgacaataaaaatgtctccagacattgtcaactgtcctttaggggggaaattatccctgatgaagagccactgatccagaaccatcttagactgggaggtcctcttgggaaagagggaaaaagcctgggtcctcaactacttggtggggcaccagccacagacagcctgcctccagattttccaaataggagaaagaaattacccactattactttgagtctatgctagttgcagtcatacttaattctaattggttaaattgtctgtattttgaaatacaaaataaagctcaatagaatttattcggcagccataacaaatgaaatcatgtcctttgcagcaatatggatggaattggagggcagtatccttagtgaactaactcaggaaatcaaataccacgtgttttcactcataagtgggagataaacaatgggtaaacatgaacacaaagatagaaataatagacagtggggactcctgaaggggggaggttgggaggagggcgagggttgaaaaattacccattgagtacaatgttcactatttgggtaaagggtacagtagaagcccaatccccacaaatacaaaatatactcatgtaacaaacatgcacatgtaccccctgagtctaaaatattataaaataaaaaatggattgcattactattaaaatagtaaagcattggaattaacttgaatcagtaatagaacacttaaatgaactaccatatatatccataggatgaaattatatttgctgaaaaaggaatgacaaatatctctattttcaattagcacatgtatgtatgtttgtttgtatgtatgtatttaggtatataagtattgattcatggttttctatattatttgagaggacatattactgttattatttattttcatgctcaaactgtcccaaatttagccagtggaagttctttcaaactgacttctgtgtctttttcagttttccccgatcattcttc

SEQ ID NO: 471541 - DNA, 484 bp, Homo sapiens
cccagttgtctgcaaagagataggggacagaaacttacatgtacctaggacgaagatggctctttctgtacctttgtcccttcccttcatctgcactgcccaccttctgtgcccttttgcatgctcacacatccttctgtatgatcaacggacttgggcacgctgcacactccttggcttatgaaactttcacactgtcagcagagggcgccagagaccctccaaaagccacggaatgctccatttgctctgactgccagcaccctgccactgccaccactggtgcaagtgtaagcatggacactggcaaccctgctcccacctgcaccctgccacaggtacaagtgcacacaggaatgcagcagctcgacttctgctggtaccccaaccccaccaaggcataagcaccctgcggcgctgccacaggtgccagaacaccaggttcccaatctcacggggccagataacaaagctggggtcctgg

SEQ ID NO: 471542 - DNA, 510 bp, Homo sapiens
atcaacccatcatctaggttttaaaacttccaacgttacgatgaacagaagtcgagagaactccctcaactggatgtctattactgcatttcatacctatgacctctgggacaaacctctgaaaggtttttctgggtcttcaccttctaatggggacttttctcctttcttgacagatatcattcttaaaatgagccagagggatgccagtggcaagtttggagatgtggaaaagggacacaggcgtatttgtggaggactgacgtctcagaagtctgactctgcaaactacaattcccaggagcccctggccattggccttcagctagagagtggaaggagggaggaagaggaaattcagggcatcttcccccttctctgtgctttgagtggcatcttgggtggactggagctctttccctctggcagcctctccctccatggtccagctcccactcttctgccccagcagctgtgttccagcagaggtttcgcctactttctttgatc

SEQ ID NO: 471543 - DNA, 4226 bp, Homo sapiens
ccgaggccgaggaggcacccagagcgggcgagggctgccacacgctgtcacctctcagtagtatgtcccaagctggtgtccaggttcttgacaccatcacaagaaagaattcagggacaaatcggaatgaggcaaaagacaagaagattttcttgcgaagtgaaggcacccacttgagagagaagtgtgggtgtgttccagaaaatgacctaacattcttggatcctccttctgaaataaaaggagaaagtattcctcatgggactgtaaattacatcaactcactacctgctgtcctttcactgttcacacaggtagagctgggtcctttagccctaaatcagtttgaaaaacaaacagtctttcataaggctacatctctagaaggggaggattcagggtacagaccaaatgccttggccaaaatgtcttggctagaggcaatgagacagaaaatttcggtcacaaagaaaatgacttgcccagaagtaaaggagagtgggaatacccacatcaatctagacagatttctctaggaaggaatatattttaagataagttaagcagaataataaaagatcttatctggttaccagtgcattgaaactattccaattggaaccatatagacaaggacaatgcatcactttagaaagcacatagaatctgacagaattaaaaataaatatagttaaatttgggaaagagtagtgtaacagaaaaaacatcatcgactggatcactaaaaccaaattctggatctttgaaaagactacaaaattgttaaaaagaaaaacttaagtctcatcaataagagaaaacaaaatatatcaatagtattaccaataatatcctttaactgcacataaagaggggatttaccgtattaaaaatatataaaacatatataacaatacatttgaaaaccataccaaaactgactcaaaaattttgtaaacctaagaaaacattttacgtagataggcaaagcctgacaaggtatacttctaagaaagaatgaatccaaatgattttgcggatttttcaaaaccattaaggaaaagccatgttctgaattagagaacagaaaaagagggagggcttctcagttgattttaaaacctagcattgtctgtgtcctaaaataaactaatgagaaggacaaaaaatatatagtatatgaacactgatgcaaacacacgtgcacacacacacactatttttaaatagaacaaagggatatattttaaaataaacaaagggatatataaagagcttaatgtaagctcttaaaaattaagaatggaaaaaaaactttttaacctgataaatagtagttaccagaaacctataaaaacatcatttttatcattttcaatgttaaaatgattaaatgagatacattttaatgtatcttattaaaaacatcagacacaagatattttggcaaccattactaatattcagtaattttagtgaagtaaagatgcttgccaaagcaataacacaagaaaaagtaatgtggaaaactatatagaagataaaagctatgctaatttagatgctaagaattcctacttaaatacacatggcaagaaacaagatcaacatagaaaagcaagctttttatagcacaataattagacaattcagttcaaagaataaaaacaaggaccccattcagggaaaaataaaaccataaagcatccagaaaataacctaacaaatgccaacctacttgatgactattttaaaagtttactacagaacaaagtaataaagataataaggtatttgtagccaatactaccaaacagttttccaaagtggtggtataaatttagactccctccattccagtaatatatgagagggccagtttctctcctgtacttaatattgccttcatggttttaattttcatgtctttaatgagagattgaaacgtttttcaactttcatggaactgacttttctacatggtataagataggactcaatattttctaccaaacatatatttttatggttcagaaccatttatttaatagaccatcttttctcaactacattgcagtgtctcctttcctataaatagttcaccacacatgtgagtctgtttttggactctattctgttttactaatctacttgtttatctttgaatgaatttcagtttgttttaattgtaatacctttatagtaggtctccagatttagtagtgtaagtctaccaactttattcttcttaaagactgtccttactcatttggacttttttagtttttatatattttttaaaattagattgtccatttcaaaaaagcatgctttttgtaatctaactggggttacatttgatttaataataaattcaaagaaaattaatatatttaatacattgagtcttacaatatatttattttgttcctgatttctctaggtaatgtttcatagatttctgtctacaggcatttataaaaatatattctattgatttattcctagttatttaatacttttatgctattttaaataatatgtttttctattttatttttagttgtttcttgctttgtacagaaatactattgaccttgcatctaatggccttgctaaattgacttattggtcctaatagtttattggtagaatattttgggttttatacataacaattatgagttttaagtcttcctatccaattctcatactatttatttttatttatttatttatttatttatttatttatttatttattttatctgctttatgcaatgacaaatctccaaaataatgttgaattgaagtggttatattggcaatcttgttctgtttttgagttcaagaggaaagctttcagtatttcattattacgtttgataatgaaatatcaaatgccattgagaattttcatgggtattctttagaattttcatgggtattctttatcagattagaaaagttctatttatttactggttactttccaagagttttaatcataagcaaatataacattttattaaatgccttttctgaattgaattaatcatctgatttttcttctttattcagttaacggagcattacagtaattgattttcaaatattaagccaaacttttgttactagggctaacccatcttcattgttattatcatttttatacataccagattcaattgatttactaatcttttccttggaatttttgtgtctatgtttataagaaaaattgccatgtaatttttgttggtatcagtgttgtgccaaactcacaaaatgagttgaggagttcagcctatggaggatttatgtaagtttgttgttatttattctttaaataattgaaaagattaactgcttatgtcctttgtgccaggagattttcattatgggaaagtttttaataatgaaatcagtgtctttaatagataataggactgctcaaattttttttatttctttatgtttttgttttgttagactgtgattttcaatgattttcccaattcacctaaattttcaaatttatgggttaaatgttcatgtttatcgcagcattctagccaagtcatgagtaattttttacttgacagaaatacaatagcagtgtctaaaatcataaatggattcagtaacctagtacagattaatgacagaagtccaataaatcatttttttgccttgcttaaatatgcaagcctaatgccttcccatgtcactgacacaacaataatgaatcaatgtggtgtcaccatcaaaacaaataagaaaaattttagctaaaaatcagatacaaagttttttttcttcttatgctacattatttggggaatagcagaataagagttgaaaatgatgtaatgtggcatattttcagatatagtacataatcataggttcagtgataaaggacagaaattttagtatttcagtgtacagtgagtattttttttaacttttattttagtttcagaagatcatgtataggattgttatatatgtaaattgcatgtcaggggggttagtgtacagattactcaatcatgcagaataattgtggttggttaaatgtgtgtcattgatgtgtctaagagaatttagtcaatttaacttttaaaaaacatcaaaactgttaaggtgttgaagtattgatggaattatttatgttataacttgttatttatttttaatcctttccaagcagtcattgtcag

SEQ ID NO: 471544 - DNA, 2435 bp, Homo sapiens
agaccggagctgttcctattcggccatcttggctcctccccggaaactgcaacttttaaactgtcagatcttaatgtgcactgaatatttctttgaccttttatatttcccttggtggtatatattcaagcctccggcacccagtcaaaactccccacctattacctcttattcccactccataaaaaagggaagcaaatacccgtctatgttcagtgaatatgagctgcatctttggtggtataatgtgggaggtgagggtgttatatcctcacagacagctgtttcatacttagataaatgttatatctgtcaaacgtgtcggcaggataaagagaaagacctggaaaatgatgggttatggcctctcaaagaaaatggagccagatgtgagaaagaacactgtagggagatccagtcatctctgctcatggactctcctgggccagtcaaggaattgctttgtagcacaaaggtatgaagttgatttgacagcgaaatactaccctgttgatctaattgatctgacagttcctcttctttctctatatgaagctacaaggatggctgaagagggaagatttcccagacaaaaagaatcattactttagccttggggagctgagcaaccaaaatgtcactgaagcattttcatgtaactcctgccgacgtccatgtcctttttaaagtatccagagtttatgaggaagagtccacagctctggaggaacacctggagagcaagagggagccaatgagaacacatacaactcacttacaaattacatacacggtcatttcctgtaaacacagaaagtatagtaatcattcaattgttttgaaaaagaacaaattggaggagtcatctattgagattttgaacataatgtatatgcttgggacaattcatttgataaagcttaatagaaagttatgtatcacaataacatcataattgcagattctaatttaattatgtgattgtacatatttatttactctaggttctatagcaaatacacagtaattaaacagcatagtaaactaacaggctaaagttggggaggataacaagaaattcgtgaagcctcttgcacagtaaaagaatattaaaaaggtcaattacaagcttagggaagcagagtctattccgatttaaaagataattacagtcagctcattgcctttttctgtcataccagacattcctttcaagagtgtcaagtgaaggagaaagttacaggaggagattttcaggttcgagtatcttcatagcttagaaagcaaccaccaagcccctaatgatttccacaaaattccctttgtgtaaatagagtcatttgaggattaagtaatctgcagctcagacctttgtcctatcctcctgtgcttcttttagccttcgggtcctcataatacatttctggtcctaaactcacaagcttttgagtatctattgttttcctaatataagcttaatagcttttttcagtataatgattatcaatgtaaagggtaattaactccaagaaattaccattttttaaagacttggactctatagcaacagtacaggtatactaaacagtattttgcatcctattaagctaaatactatatttaattttaaaatacatgcccacaagtatgccgggctttgaagagaactcaaatacaagacataagaataccaaaaaataaaaaataaatagaaaatcacagataatttagaataatagaaatggtactcatattatacagaaaaatgtttcactatattctttgattttcagtttctttaaattataagctagtctatggcatttaaaatatggtttacttttcaaacttcaaaatatacacagtataataatgaaactgttgccctttcccttcctcatgtgtttattaagtattcctttcaaggtatacttttgccttgtagcagttaatatttgtattaggaacacgacttcactgagaaactaaaataatgatatttttataattatatcccccatatttatcataattataattatgttaaagagttaatttctatgtgttctcctattaatatgtaacagacaatttacaaacactgtagagctttggggaatatgtttggagaaaatgcttaattaggcaatggtgtgaattttgacatctttcttcatggttcagagaataatctcttgctgacacatatcttcaagagtttgatgaacagaaagtcttatttttccaatatgaaaaacagtattacaggatcacaatatggtgagaaatgaaaaaaatgtgttttattttttaataaatgacatattgctaagtaagccaaaattatctaatagcattgaaaaacaaaatttgcaataaaatataccattcacaaaatgtgatagatatgtgatagataaaactgactctaaaat

SEQ ID NO: 471545 - DNA, 2216 bp, Homo sapiens
aagacttgcaaccaggtagatatcaagcatgaaaagaggcagagaaagcagtttcagagaaggaattaatggggaaatggcgattgctttaatagaaacagaggggaagggagaagattcagagataagagaaaagagatcttggattcaagaagccttatgcctcttggctaaaaagagtttgaaaatcctgactcggcccattgaatgggaaggaggagaaaatcctgagggacacagccctttgcccacagacccacccaccatggggaagggtccagcctcaggagggcctggccaaggacttccaaaaggggcttcctcttacccaggtctaagagcaaccctgacaatcacaagaccatttctgctctttcagtgttactttaaagatctgcgtgcctggggccttgggcttgatgaagctgagagaaacgggaaagcaagctttgctgttactgtgtgagctttgggatcccacatgacaacaagcaggtgtatagctaataatggctaacaggaaacctctaagactttagaactcctgctaccaacattctgctgattacctccaccaggacaatcaggtcaaagccaataaaatttagctcctattaattgaggactactctgacatttcaatggaaagattttagattccctgtatcttttcttgctccaaatcccaaatcctgctgaagacacattcctcagcctcttttttttttctatgtctgttgataaaggaattttaaaataaagcaagggaatttgagacatttgagatctgtttcaaagaaaatgaattttttaaggagtaatacaaatgtaactcaaactgctacttgcggtcttgatactattgcctaaaggttttggccaggaagaaattgtttttaaaatgacttaggataagaaataagatttgctactatgactttttccttttcataattttatttattcaaatattaacatgcatatccttcactctttacctactccctccctttttctatccccttcaatacacacatatgcatacccacaccaataaaccaagagctgatgagaattgtaatagctccattttgtttaaacactatatttaactattaataaataataagcttagcaaatacatatttttggtacaaatcatgtaataaataattatacttctaaagtaataaatgcccagctaaaattaacttatttttattaaaatattaaaattttattccagtgtagctcctagaaattctgtattaaaacacaaaattcagtggtctggattttatgtagacaagcaacacagaaggtaaagtaaaaagggaagtctgccagtaccttccttagagaaaattcctctcagtttctcccagagcacacatgtattttatgacaaattggcctccttcactttgaggccagggttttattcagcagcaaagttcactgttaactttacatgaaggttaaattaaagattgtaaaccaacaagagttttcaatatcacacttaaaattacgtaaatagtggtcagtagcaccaataccttcgcgaaatacaagttccctttgctaaactgcttatgtgatagaaaattatgaatgacctatctcttggcaaaatcgaagttagtttatttggtggaagttacatttagcatgggtaactgagattataccagaaacagagcatcagaggaatacaactctgtatgcaaaattatgagatatgtttttgttttcctagaaaaatgagagcagtgttgacctaaatgaaagtgtcagcttgttctaaactataaaacatcacagagaagaacaaaatttaagtttgtctagcaagttgtagacattttgagggaagtgaactttatttaccttggtttataatatccaagtctgaaaataatgaattatgttaaaattttgaaaaagtttgcacagccttaatggacttattcttgttaatttgtaaagaagcttgagaacactttactgccagctagaaattaacacaaacaagtattcatgcaaactagaaagtcagtttctgtctgttgaaatgacaactgatcttaaaatatttagtctgaacaatgggtaataaatgattattcttcacttctgtgtaacctgtccaaatagtattccatacagcagattaattttctgtgctttgtgttgctttacaatgtctttgatta

SEQ ID NO: 471546 - DNA, 845 bp, Homo sapiens
cgcggctctcgcgcgaatcctatccatttcctccagaagatgtccaacagtcaccagtctggcagcagggtggggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagctgcgcacgcttgacctctcctgaacctaacatggtccccaccgccagctgctcagccctcagaatgcccatctcccagcccccaaccccttcctcccgaggacacaggagccgggaccccaggcaccttttccctcccacagacccaagagcctgggccttccccgctcaaggcccaagagacctcttccccaaattccattatatcactctgtgtatcttcgcaccctcatagcttacttagcttccacttataaagtgagaata

SEQ ID NO: 471547 - DNA, 870 bp, Homo sapiens
ccactcagcttctccgagctcacaccccggagatcacctgaggacccgagccattgatggactcggacgagaccgggttcgagcactcagggctgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggaggataagaatgagcatgtgtgagtgtctgagggaagacatggcagctgttttgtcttccttggcccggacaaccccctct

SEQ ID NO: 471548 - DNA, 1110 bp, Homo sapiens
acactgtgtttatcagcttctcctgcatttagaatgggggcatggcctctggacattgccatcccccttcacctctgcacctgcctaattgtcattaaactatcgggacccagcctggttgttgtcccttgtcccttcctagaaattcaggggatacgtgtgcaggtttgtgacatagatatattgcatgatgctgagatttgggcttcaatggatgccgtcacccaaatagtgaacatagcaccccacaggaagaagattattactgctggatgcatcgatcatgttttgtctgtatctgatagccagcagatgcaagcaaacctaacccaaagaacagaagcagaaatcagaaagcagacacagattgccccaacatttcctgctcattctctgccaggtattgctcttactatccctgaatactgcactattatctatagtttccagtttcctctaactacccaatttgagcgtgcacccgtaatagatgatgcttaataaccattaagatgatgtcagatagaaaagcacaatttaccaacaagtaaatttacaaatgtcatgtttggttaagagaacatccacgtattataatgtaattagcagatatctctcatattaaagcattataactcgacatattctgtgttcataactagttcatcaaatttgtggattacacttgaaagagcaatgacttaattttttattttttgaaaagatttttgcaaaagcaatgattttaattctgaatttgttgtgtatatttcatttattactgacgattttgctatttgctcgtgtttattcattccacaagtttgtttttcagctaaattgtcctggctgccattgtggcttgaaattaaaacgtttttccttaggcacatcttatttaagaaatagtcataatggaccagcacaatggttcacaagctttgttgcatattagaatcaccagctgagtttttaaaaacccagatcccttccacttctgggtatatatacaaaataattgaaagcagagactcaaacaaatatttgtaaacccatgttcatggtagcattattcataatagccaaaaggtggaaagaacccacatgtcc

SEQ ID NO: 471549 - DNA, 627 bp, Homo sapiens
aaggtttatgattatggcttaaaaatgagttgtgggggcgggaagtaccagcgacttccgtgtgcatgttcatgttggtggtggccgtggcatgggccaggggtcaaggacactggcatctttgcatgcatttgcactggcagctgtgtcagcacaggggcggggcactggtgggaatgtgtttagacaagggaagccaccatcaatcaagcttcctgtggatcacgacagcttggtggatgcccggactcagcaagaatgcctggaactcatgcacatcatagctcagtgcattgccggtttgtggctgaagcctgtattaccagggtctttagtaccagactctggtacctccatccctgctccacatccatacctcaccttccaccctgtgtcccgtgtttctgctgatgctctatactgccactgtccttactcagtgaacttacaccaggagcaagacatgttggatgaattcttctgctctctcatcttgctcacaagccatggttcagagatgcagtaattttttttcaggctctctgaagacatccatttaggttggaaattttaatgtttcatgaaacttggtcatacattttcatgtattctctttcttccttgatt

SEQ ID NO: 471550 - DNA, 808 bp, Homo sapiens
gtagtcccagtgagatgaaccgggtacctcagttggaagtgcagaaatcacctgccttctgcattggtcttgctgggaactgcagactggagctgctcctattcggccatcttgcctgccttcataggaaaatagctatgaaagagcagaaacagacaaatagtgttcaagcctttatttgttcttggaagaaaatgaatgttttaatttttatacaatgcacacacctttactgtgtccttgaatgtaaaatgcaatgtaatatcacacagggtaacttttatttttctgggtactgcctgcaaagcaaggcaaaattgtttgggaagaaaaagaaaatctttgaagaacatttttataaagtaaaaagaacttcattcttaataattccgatcgaatgcatctccaaagagaaaacgatcagtgcagttgaatgtcctgtcatattccgacagaaacttatttctcctgggtggatttcagctcttcctgtggagctcttgggcagtggcagtttttaggcaccattccttgtcttaatactttgctgctaaaataggaaggggaacaccacactctagggactgttgtggggtagggggaggggggagggatagaattaggagatatacctaatgctaaatgacgagttaatgggtgccgcacaccagcatggcacatgtatacatatgtaactaacctgcacattgtgcacatgtaccctaaaacttaaagtataataataataataaaaaaacttgattgttcttaaagtattggtcatatacagtatacaacatattccaga

SEQ ID NO: 471551 - DNA, 1412 bp, Homo sapiens
gactcaacttggactggaatctacaccattggttgtcctgtttctgaagccttcgggctctcaacccctcgcagggtggggagcatgcaggtgagcgggttcaggggctgagatgaatgctctgggcactggcagaagcataactccatgcaatcctgcggcagcgtctaggggggtgcccgtgaccctccagagcccgagaggacatgtgctaacagtgcactattttagcttcgctgtccatggatggcttatgtgtttaacagctcagtgtgacagccctctgtatcctgagcccttgctcagaatccaggaagaatcaggtcacacgaatgaattgaagatggtaaatgtgggggattttattgccaatgaaagtggttttcagcacgacggagagctgaaaaggaaatggaatgggaaggtggcaggagtttggctgccccaaccagactctctccgaggtcccaccatcaagctttttgtcgtggaacaaatagcctttgtgtcttttttctttttggcccagaattaggtaatttcattttttatgtgtgctcaagtattcatccccctcaagcaattacttcacaagtgctatgtcagcacaaagtaattacatacttttacagattacttgataattatttctgacatcactaagtactttcaaatataaatgtgcaatgttgctagaattcaggatgacaaaccatttaaataggtatctgaaagagaataaacccacattggaaagcatttgtattctattttcttaatttgcacgtgaaaagggaataagtgcatgtgtagctaataggatttattgaacataaaatgattgttcacaaaaaaaatagtgctaaattctgatgatacattggggaacaaaagaaaacttggtttctgttcttttttatttttttgtcagcccgttggcataaagattggtcaaatactcacacaaatagattattaaagttgcaactttgttaagaaatacaaatgagtgatacatagtgccaaaatattacattgaaatttaacctagtctatgttgagggaaaaggcagaatattaactacttattcaatacttgaaggatgaagaagatataaatttgcaagtaaattccaggcaaagacttcaattttggagaaaatgcaagaaatatatatggcaggctcacagaaaggaaggcagtgtctgacacaagatgtgagagacacgttcccattgtggaccatatcaaatattacactggtgcaaagaagatttggggggcatatttttatggttttaagcatgctagaaatatgatcaccagttggaggtgcaatggctcatgcctgtaatctcaacactctgggagtctgagctatgctagaagaacagaagccacggtaagaaac

SEQ ID NO: 471552 - DNA, 883 bp, Homo sapiens
agtgttcagctcgattaggacgaacctgggcacttagccatgcaggaacaatggcaagccgctagcccgatcaggagtggcaatgggcgcctcactggatcaggagcacagcggacaccctgccggttctggagggatggaagtcagcggcagatacctaattatattactagtagatgctatgatgaagccatgtctacttttgtaggaaattaccaaccacctgcagcgtggctgtaccagtttgcattctcactaacaaagaattataatggagcttttattgtccctgaagaccttccagtgacacaaaacgtggaggtggaagacagtgatattgatgatcttgaccccggaaaaactgtcaagaccagtgaacacctagtgttacttgcaccaagaatagtaaccacggctcttgcagaacttgaagaaatcttcctgattgatgaaaaaccagtgttgtatttgggtaagctggtgacaatgactccaaagatcatccagaaccttcacaccaaggagggattggctaaccatggactgaaagaaggggacaactggatgaggagctggtaaagccagaaaatctcagaatcaagcacatagatctcaagcctttcaatgatacttactaagtaagactttatggctttcaatgaagagatatccagttgtcccagaaccatttgttgaaaagatgttgttcattattaaatgattgagcatccttgtccaaaatcagttgaccaatataggggtttatttggggactcttaattccattccattaatctttatgttttttcttatgccaatatcacacagtcttgatttttgtaactttgttattcatcacaacgaagattttcacttaatagca

SEQ ID NO: 471553 - DNA, 1333 bp, Homo sapiens
atgtacagactttctttgccatgttagacaacccagacctttgcaagcattgcacaactgaaccagcccttttagcaatcatatcaggcaggcccaaagataataataccccaaaattagagaagcaacttccaggagaaccatctgaggatccctcttatctggggccccttcgtgatcccttgtcaatacagcaccttagacaaataaagggagacttaggccaattttctaatgaccctgataggaatatagctttccaaaatttaactcacgtatttgacctctcatggagggatgttgtgctgctcctaagccaaaccctaacagcagctgagaagcaggcagctctgcaggcagcggatcaagcttttggcttctctctacctatgcacactggcaaaatggataataccgctacccatacgattgaatggtcgaaatccaaaacactggcaataccaaatgctgacaaggatgtggagcaacaggaactgcaggtaggaatgtgaaatggtaccgctactttggaagtcattttggcagtttcttataaagctaaacatactcttaccacatgatccagcaacaacactccttgatatttacccaaatgcactgaaaacatatgtccatgcaaaaacctgcacacgagtgtttatagcagcttttttcagaactgccaaaacttgcgaatactgatacactcatatcttgtgtaacatcttgctgtaagaacttgaaaactttccccctctgggttaaggattcttctttcattatttctgcatgggttgttccatggacaatgttttatagatgctcatcacctcaagttcattgttgttaagccctaagtatttcttgcagtttcattttttctgaatattaagtctttgtttgcaatatgtaatgaatttcgttggttattcagggccttttgtggttccatatgaattttagaacctgaaaccacagaactcctagaagataatgtaggaaaaaaaaattctttgacatttgccttggaaataactttttggatatcataccaaaatcgcaggctacaaaaccaaaaataagtaaatggtattgaatcaagttgtaaataacattttatagaagttggtcaaagcacaagaccttttaaaatttttattgtaattgacgaattattgctctgtatatttattgggtacaaaatggtgttttaattttttatacaatgtggaatgattaaatcaagatagttaacatatccatcacctcaaatgtttaccttttcgtgatgatgacattggaaacactgtctttagcactgttgaaatgtgac

SEQ ID NO: 471554 - DNA, 1842 bp, Homo sapiens
agatttccatctccgtttcttgccatcaagctgactgtcatctcactgttctcagattgagtccatgatgaaacataaaagcatgaaatcactacctgtaggtaactctggttgtgcgagaaggagaagaggggttggtgtggttagaagagatgaaagactagcagaaataaaaagtcagggggctgccctcctgggcgcagctgcagctgcccaaaccgtggctgcagactcaggcatccctgctaggggagagcccaggaagaccccgtccccttgcaggctcggctgctggaggcagacaggctcctgggctaaggagataggtcccgataagtcccgaccttcagctcagggagggcctgaaggctccgggccaggctgccagtcccctggaccagagtggggacttgtggtgccttttctagcccacccatggctgcccatggaccagtcgccagacacttcctcctctctgggtccataaaatagtcctggactcatctagaacaggaaagcagatggacaggtgataggacaaccagctgcagagaggagctacccaccctggtacatcttctctgctgagcgtttcagatgtggaaatgacctgcctgcagggaggagctacccactccatggcctccttgctgctaagagctgaatattcaatgggacagcctgcttacagacagaagctacccaccgggggtcttttctgagctgttctaacactcagtaaagcccctctgtgtcttgctcacccttcacttgtctgcatacctcattcttcctggacacaggacaagaactcgggcaaagcaaagatcccttctgttctgagctgtagcctgaagtcagagtctaactcttggagcaagtacttagttttgttatgtttcaatcagctcaaaggtgtgtggccttgtgcttgccaatgagggtgtagagtggaaagaaaaagcacttgcccttgccttaatgactactagcaggtaaagctaaatcaataagtacttagcatctgtggaaacagaaggtatttatctgctaatcagtgtggtattgaggtgtttcatattttagtaaactgtgtgataacaaaggttactgttactttgggttgatttatgttatgtcaaagaaatgctaatcctagaatgtttctctgatgtcctgaaggccattgcctataaagtataaaaagtttaaataacattctgtatttcccttttcctttgtcggttagagttcattttaggtttgctctgtgatagctctaggtcacgtactgaccagtactggtggtagctcttctcactgtgtcggtgttttctgttaacatcccatgatagcaaaacggtcaagagttcaactaggtagaacatcaatcaaacaagaaactgacatgatgtcaaagtttgaactgctaaccgttggataaagtaaattttaatgtttcattttattattaagaactgatattctgaaacagatgttaaaatggcaggtgaccaaaatactgtcttacaaaatagctcgtaatctcagtttacatttgtatgccaacttgacctccactgttctttaggatctgagaagagtaaattttcttgtattctgaaagctattccagtgaaaactgaagaagaaactctgaagacactgctgtgatcaaagctttggctgtttgtggtttgttagtacattcagaatatgtgaatatgaatgaataaagacacataataaatataatgtattatttagagttgtttttcatatattgttgaatgtaacaaatatttaatacatttgtaacaagtgcgttcctggccttattac

SEQ ID NO: 471555 - DNA, 729 bp, Homo sapiens
tccccgaccccttgcgcttcccagaatgctagcaactagaaatatgcattatatctggccttaccaattgagtagtgaatattcttgtagaaagaatttaagaaatattcttctccctctgcctaaattttccagaatttgtaaattatttatgaatattcttaattcatggcaatgtggttgtttgcataagttcaaaaagaatctgtcttcatttattaggggacacagttggacaaagtggtcattttcccagggctgtggcctaaatggccttgtgagaggttccagccaagctaatttaggacagcctaatgtggacaacgattcttgctgtactttgtgtgggagtgagctcatcgcctatttgcataagaacacaatcatgaagaccttgaagttggaaaatgggagaattgtaatctgtgtcatgcaatgacatcaatttaacctaaataattatctatagatacttgaaatgaagggctggtcaaagtcaagggtttggaaaatcaagctgttgttatattcaactcttgtggaaataaggataattacaagaaaaaaggggcatgctgcccacttctgaagattaaatattttagaaatactttgaagctatggattttattatttttctccagagacttttcaaaatgctgattttggaaggcaattaaattggcgccagtttacctaattcaaacagagattgcactattttggtgt

SEQ ID NO: 471556 - DNA, 513 bp, Homo sapiens
cttgtaaaggtggggcaggagaacagcgtctggagcccaaacaagtgagagtccagacacccatgacataatgcatgtggtatcagcttatgggatacaatacaagctcctacgccccaactcctcttcctgccaaatttctcccacctgctgcggctgtctgctgcttggaataactttatctgggagctttgccatggtaacacttgtgcagcattccttttcgaacagtgcccattctcttgatgtctacagtatcacctttcttgtagattggcacttatgcggccaaaggaacaacaccatgttttctaaaaggctggagaaaatagcacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagggttgacaaactat

SEQ ID NO: 471557 - DNA, 696 bp, Homo sapiens
cggacttgcattagtactccaagttgatgaaggaaatcataccagttgcatatgcatttttcatacacttacataaagatgcggctacaatcacatatagtttcacacatactccaaaacctgatgaggcagatattagtactccgcattttgtacatgagcaaataggggcaacagaggcaaataacctaagaagcggtggagccacagctgaaacaggttttgcattccaaaatatgtttcacttttgctgtgctgctttcaagagcagtggttcccaaaaagtggttctcagaccaattgtgtcagtatcagctgtgaacttattagaaatgcaaatccttgggtcccacccatacctcctgatcagaaactccggggtgggcccagcaatctatttaacaagtcctcgtggtgcttctgatgaatgctcaagtttgaaaatcactgctctgaaaagtagttatggaaatgctttggtagtgatgacagcttgaccaggagtgtaaaaggtacgataacaggatcacttctaaaaatttcaacaagatatctctaatatttcctgaagtaccagcatccatctggaaaatgaaatgtctttccacttaaaggcaaataatataatttttccagttttcttttttgtaagaggaaaatgataaaggaatgtgctttctgactgtatcatatttg

SEQ ID NO: 471558 - DNA, 682 bp, Homo sapiens
cacagcttcatctcatgccgcgatgtagcctatcagaccgccggtgggcgccccagccaaggaggacaaggatagggcggaactacggaggatgcggggtgcgtagatcctgctgggataatccgtggggcggcaagcgctatacagccgccgtctccccagtgatactgcaaggtgccggtgccgccgccgccgccactgcagtaaatcagctgacaccagccccaactgccgtgactttcgctgcaactgtcgcaaaaatgagggggcgggaaagactcaccatttccctacttgcaaggcctaagccggcgccgagagagccagccgcgttacgatggagaccgaaagtggagaaaaggccagctgtgggcaaggagtgcacggccgccatcttggttgtgggaaatgtgcaggctgaaatatttatggatgaaattgtcagatgcctagcatttgctccatgataatctgagagaaaaggccatgtgaagacacagtgagaaggccgccatttaaaagtgaagaagagaggccttaggagaaaccaataccagcagcacttggatcctggactccaagtctccagaactgtgagaaatacatttcttctgtttaagtcactcagtctttggtattgttatagccaaagactgagttgttatagcaaccctagctgact

SEQ ID NO: 471559 - DNA, 1432 bp, Homo sapiens
ttccctccattcaattcagaaataatggattcctacagaaaagtcacttccagggacaatttggtggtacctgctgattggcatctctttggaggatttatttatgggcacacagttcttgaaacctactggaaggtgggcccagcaccaaggacccactggggcagggcgtttctggaagtagtgcagctggttcccacgggaatgcagatgcagaggaggccaacccagcttctcccagctctaagtgaggaaagaggtgccactcactcccaggactcaccccatccgctccccagagtgagccttctcaaagcctcagaaggaggaacattccagaagggaattgttcctgtgcttgagatggaaagaaaccagatgcagatttcaatcaattcaatcaatgggcaatgtttgccggccataaaaatagcccagaggttgctggtcagcggctctaagatggatgaccagtggccctggaggtcccaaaggtcaaagatgactatcaccttaaaatgtaatctgtgccggcccccagccctgcggctggcgggtggggcggcatctgcagccatgccccaggccaggccactctcagccacagcctggcagagggccttcctggagccacagcctggcagagggccttcctggatcctgggccgtggggtctgcctgtccatcctccagagccctggcctgaggctgctgtcctgcccggcagggatgctgcattttctccatccgtcactgctcgccatgatgtcccataggaggctgcaaaagagcagggctgccgtttggctttcaccaggcaaaccctcgcctcctgccgctctgtgtggctgcggcagtttcttaggtatcatcgtctttcatttgtcgtggtgagaagggataatggcagccatccctctgtccctggtaagcgatgattgagaggccttgccgtcctcggcttcctcccctccttgactacagctccctcatttcatttggctttttcctccctcctcagtcgggaatcacctgctgcttcttcatccagacattctttcccgggccttcctgcatcagcataggcagggagccatgtgaagtgaatctcagagccttgcagctcatcttgaaacctctttctcctctccctgttcactgtctgaggaatgccacctttcttctccccatctttggttcagtggtctcgttacttttcccatctgctgtgttgcattcggacagtgcttaaggatgaggaaggcctgataagcactttgttgagttgcattgtctcctgaaaagggctgcttccctttctgtccactgttgctgactggttgctggggttgtgcactcgagagcagggtctgcctactggttatcaacgtccttccacaaatcatcgctgttcggctatttaatggttgac

SEQ ID NO: 471560 - DNA, 1076 bp, Homo sapiens
tctttagggcactgagacacaaacgtgaagctgtaaagtgaagtggttcattatgctaattttctctcccagtctctcattccttcattatacaccatgaacaagagagcaagaaaatgaaaaagacccagaactttgagttcaagtcactatcccgctttccccagtgctgcatgttgttgagtgggcagtattgcttggaagtggaatccattgcactggaagaaggaaaatatcatggcgaattagtaaaactaaactgcctcctcactaaacgtttccctggtgaaggtagaagcctccagggaatgaacttctcgggagataatgacatcagtctagaaatattcacacttcccggactgggcatcaaaaagacctcaggaaagagttcaattaaagagacttctctctccttttcctggaacctcacctccaatttcctattcctgaactgcctctctttctggcatttagaacctagtgaacagtcagcagaagggaggatcgtgaacttctgctatgagtatttgctatagggatctcctctgttaactttcatttaattccacacacttgtattgagtgcctaaagataaatatgatagcaccatggttaagagcaagaacttcaaaatccagttgcctgtttgaaatcctagctctgcccctatgcaaatgccacagccaagttatttaaacttttggtgactcagttttctcaactttgaaatgggtatactataataataccatggactgtcatgaggataggataaatatatgcaaggtaagcactatgtcagtgttttctagagttgtttctacagagcagaacttctgtccctccttgctgtcaaggattgcacaggtcagccaggtgggagaaaggtacacaagtaacaattccaccagacaggctgtggtggatgctgaaatagaaccacagacagctgtgggacaaggcaagggagctagaaaaatggaatattgaccacattgtaaaactgcaaactcatgtgtattaggctgctggggttttgcctaaacctccagtctttgaaatctacttccaa

SEQ ID NO: 471561 - DNA, 641 bp, Homo sapiens
acccctgggaatcctttgaaaaatgccttctttttttctttcttctctcggttctctcttcactaataggaagtgctctagcagggcctctggcctagcaagagtccctgtttcccccttttcttccttttcgcccaataaaaccctgctttactcactgttcaaaccacctgcgagcctaaattttcatggccgtgcgaccaacaaggaccccacatctttagctgaagtaaggaaatgtcctgcaacagcactgtgtctaaatcttcagaattttcttttgttctttaggctcaacccctcttattggagatttcttgcctttatcccgaccaccaaggaaatactttgttgcccccctgatgtttcttaccttggtctgcacagagagttacctggtcgccgcgccttacattccatctctgatgaactcagagaattcaaagatgaaagacctaacttggctctgaacattcacacctaaacactgtaagatattgaaccaacttactaatattttctcatttgtaaagtggtgataatatcagctctacttagtaatgatattcttttataatattttattaacgataaagcttatatattttgtctttcaattacttagtaaaatggttgttatt

SEQ ID NO: 471562 - DNA, 633 bp, Homo sapiens
gcctgtcaggtcgttctgaggaaggtttggcaatgattatattccctcaccaggaaaaatgcagcggtcaagtatgggggttgtggaatcctacagacacagatccaaatcttgctttattctgttatttgccaattgtgctttattgggcaagttacttaactcctctacgcttccattttgtcatcagtaaagctaagagaataatagcacctaccccttgtgagaatgaactaaaactggaagataacaaatttgtgttgtttggagccaagtttggggcaatttgttatagcagcaatgggaaactaatccaaggggacaatgttgtcagttctgtagactgctccattttgaccttcaaagaatacgtagcaaaggtgaatttttatttaaaagtgagtgtgattcactcagcagaaataattatgtttcggaggaaggaagtgtctgggtttcattttaaagatggtggaggaagggagttggaggagggccagtattaaatcttgttttttatatcattttcaatgaatgaacagtgatgttcaaaagagggagttaccagaatacagtcaacccctatctgtcacggagcctttgcatacacagtaggtcagaatgggttgaaaa

SEQ ID NO: 471563 - DNA, 555 bp, Homo sapiens
gctccgaggactggtctttgaatttctgagggtgaaggattggctttggtcagcagaggcggagctcaggcaataatgcccgcttgcccactgctctcctcatgctgtgcagcccggttcctaataggccatggactggtactggtccatggcccgggagctcctggcccagctcagactaacatacttggccatctctgatcctttctcgtttccaactaacaagctctgctgtgtgactgcaattctctgcctgtgcatgaatgtatgcctttggattcgctctggaagagtaacccttgtgggttacgaccacaaaaaggaacgcataatgattgctaagccccttgtccaaagtgaaggttgggaggaggctcacttctcacttggggaagtcatagtctgtgaccttcagaatgaaataagccttaagacacaagcaaaatgccttgtggtcatcaagccacatccactcatatttgggaaccccttgcctgtggaatctccaagaccattgacagtactcacagatgacattctttttttctagaagtt

SEQ ID NO: 471564 - DNA, 1668 bp, Homo sapiens
atatatgagggagctcccagtgaacatgctagcagagatgcttctgtgggttgagggtgaacggtgctttcagttaccacctggagtcagccaagcacaggtcaccagcattgaccttggccgtgtgcatagtgtggccacctgggaacgctgtcatcctcaggacccgctagtcaccagcattgaccgtggccatgtgcatagtgtgaccacctgggaatgctgtcatcctcaggacccgctagtcaccagcattgaccgtggccatgtgcatagtgtgaccacctgggaatgctgtcatcctcaggactcgctagtcaccagcattgactgtggccgtgtgcatagctcaccagcattgaccgtggccatgtgcatagtgtggcacctgggaatgttgtcgtactcaggacctgctaccctcccgtcattgaccacagccgtgtgcatagtgtggccacctgggaatgatgtcaccctcgggactcgctgcactcccgatattgaccacggccatgtgtacagtgtggcacccgggaacactgtcatcctcaggacctgctgccttctcggcattgacagtggccaggtgcatagcccagtgaccacggtccatctgtatcttggattaaatctctgtattcctacattgcctcgagagtttgctgtggccttgctccagctgcctgacaaaccaaaacacagcccaccttaggcattaccaacataacttgtacctttgattaaagaaagagctcctcataagaactatggaaaaacgtacttgatatttgctgaaaacgttctcaactgaatttttatactaattacaatttttaaataaaactattagaccagacttttaatgagcccttgcatcatattcacagaactttaacatccacttcattagtatgggtccttaaacattgtattagtccattttcacactgctgatagagacatacctgagactcggcaatttacaaaagaaagaggtttaatggactcagagatccacatggctagggaggccccacaatcatggtggaaggcaaggaggaccaactcacgtcttacacggatggcagcaggcaaagaaggagaacttatgcaggggaactcctctttgtaaaaccatcagatctcatgagtcttattcactatcatgagaacagcacgagaaagacttgtccccatgattcacttatctcccaccaggtccctcccacaacgcacgggaattcaagatgggatttgggtggggacacagccaaaccatatcaaacatcaagggatggctcttagagttgcacttgttcctcctgtttaaggctgcaggtgtagtcccagaacttaagaaccaagcacgtttcacagaaatatgtttatatggcaagacagtttaggtatattaaaaacttttgtaagcatcgaaataaattagtttatacctctggggtctttatttcattatattatttagactttggaataatgttagtgaagttgatacatagaagtaaatgtaaaacaattctttcatctttagatcaatgcatttatgcagtacacagtaatgtggattcttggcttctctataataatgtgacctaatcaaatatgtaacaaatgtagcatgaataaataatattatgttaaggattt

SEQ ID NO: 471565 - DNA, 2294 bp, Homo sapiens
cagtgtatagccccaagggtgaagatgttccacggttttgaggaggctgccatggggaaaattggtatcctcaggcggtttggcacacagaatgcccggaacgcccagaatgcctggaatgcccagaatacccagaatgcccgaaattcccggaacacccggaatacccagaaagcccagaatttctggaacatccagaattcccagaacatccagcatgcctggaacgtgtggaatacccagaatgcccagaattcccagaacacccagaattcccggtccacccagcatgcctggaatacccagaacgcctggaatgcgtggaatacccagaatgcctggaacacccagaacgcctggaacacccagaacgcctggaatgcgtggaatacccagaatgcccaaaattcccagaacacccagcatgcctggcacacccagaatgcccagaactcccagaatgcctggaacacctggaatacccagaatgcccagaattcccagaacacccagaactcccggtacacccagcatgcctggcacacccagaatgtccagaatccccagaacacctggaaagcccacccagaatacccagaattcccgaacacccagcacgcctggcacacccagaatgcccagcacctggaccatggctgaaccgccaaggacaactggcattccagacaaaattgaaaattcctagtctaagtgtgtcacccatggcaaagatcctagataataataatatttaaagtacagattagctgttctcttccggggcattcagtctgattttcttattaattcaagaacacatttttctggaggaagaaggaaacgtgtgcatagagaggggcatggggaggctcccttggaagcgggagctccacgccacctgcgccgccacccccttgtccatctgacgcccccacgcctggggcagctgcaggcgttgccctgctcgggcctcaccccaagggggccactgcactggggaaggcccagaacccacatcctgcacagcaagggggactgtggctgaggagggcacggggtggcagccctaagcccaaggttccggagacgccactctgtaagcacctcacatgtgccagagtcactgtcatgtacatcagggtcaccctcatgtcaacatcatcctcacacgtgtcaccagtagcatcacatgtgtcgccatcacccacatgtgcatcttcctcccccacacgtgtgtcaccatccccctcagtcagtcacatccccctcagtgtgtcaccatccccctcggtgtgtcacatccccctcagtgtgtgaccatccccttcattgtgtcaccatccccctcagtgagtcacatccccctcagtgtgccaccatccccctcggtgtgtcacatccccctcagtgtgtgaccatccccttcattgtgccaccatccccctcagtgagtcaccatccccttcattgtgtcaccatccccctcagtgtgtcaccatccccctcagtgagtcaccatccccctcagtgtgtcaccatcgccctcagtgagtcaccatccccctcagtgtgtcaccttccccctcagtgagtcaccatccccctcagtgtgtcaccatccccctcagtgagtcaccatccccctcagtgtgtcaccatcgccctcagtgagtcaccatccccctcagtgtgtcaccttccccctcagtgagtcaccatccccctcagtgtgtcaccatccccttcattgtgtcaccacccccctcagtgagtcacatccccctcagtgtgtcaccatccccctcggtgtgtcacatccccctcagtgtgtcaccatccccttcattgtgtcaccatccccctcagtgagtcacatccccctcagtgtgtcaccatccccctcggtgtgtcacatccccctcagtgtgtcaccatccccttcattgtgccaccatccccctcagtgagtcaccatcccccattgtgtcaccatccccctcagtgtgtcaccatccccctcagtgagtcactatccccctcagtgagccactatccccctcagtgagccaccatccccttcagtgtgtcaccatccccctcggtgtgtcacatccccctcagtgtgtcaccatccccctcattgtgtcaccatccccctcagtgagtcaccatcactctcagtgtgtcaccgtccccctcagtgtgtcactgtccccctcagtgtgtcaccatccccctcagtgagttgccatccccctcagtgtgtcgccatccccctcagtgagtcgccctac

SEQ ID NO: 471566 - DNA, 1974 bp, Homo sapiens
tcctttccagggcccagtgccaggaccctggacggcgtcaccctaggacgtcaccccaggacagcaaattcagcctcggtgctttcatgggaaggcgtgggcagtgccatccccagtgactcgcagccacgcagtgaaatggtgaggacggagggggacaaaaagggcgcagagccgacagtgcccagcccctctcggaacagaggttgctgcacccagctcctcttgggacgtgggatagccatgcccagctctgcagcccatgctcttgtggacaggacaggtgccagtgtggtactgcgtgtggcctcacagagcgagtctgtgaatgaacgagtgacaaaacctggaatctcaaaacgcgaagcaagtacggagctcgctgccgctccacaaggatgagaacattccaaggactgaaaaagcctttttgccgcagttttgtctggctacatccccggagcagcaggggcgaagtcctggggtccagcctgtgctcctctaatgcagaaaagcaaccacaaaggcaaaacatgcagtctccaaatgttacctctgctgccaggtttcagcttgtgtccgccaggaagcaggtgtgacaccatggatgtgactgtggcgtgcacaccacgggctctcaatagtaaaggtgtcaacgtgggcacgcgttttgaccagagagaggccacattcactgctcatccaaagcttgaatttcccattgacttaaaacttccattaaagccccagatgagggtaaacgaggctccatgtgctctgcctaatgggaacgttctggctggcaccgactgcgataagtgtcctgcagcaaacatcaatgtgactcgtgcacacggcattggggctgcctgcccgacagagcacgatgtcggccaggaggaggatggacctgaggatgccagcccgacagagcacggtgtcgaccagcaggaggatggacctgaggatgccagcccgacagagcacggtgtcaaccaggaggatggacctgaggatgccagcccgacagagcacggtgtcgaccagcaggaggatggacctgaggatgccaggccgacagagcacggtatcgaccaggaggaggatggacctgaggatgccagcctgacagagcacggtgtcgaccagcaggaggatggacctgaggatgccagcccgacagagcacggtatcgaccaggaggaggatggacctgaggatgccagcccgacagagcacggtgtcgaccaggaggaggatggacctgaggatgccagcccgacagagcacggtgtcgaccaggaggaggatggacctgaggatgccagcccgacagagcacggtgtcgaccaggaggatggacctgaggatgccagcccgacagagcacggtgtcgaccagcaggaggatggacctgaggatgccagcccgacagagcacggtgtcgaccaggaggaggatggacctgaggatgccagcccgacagagcacggtgtcgaccaggaggaggatggacctgaggatgccagcccgacagagcacggtgtcgaccaggaggatggacctgaggatgccaggccgacagagcacggtgtcgaccaggaggatggacctgaggatgccaggccaacagagcacggtgtcgaccaggaggatggacctgaggatgccagccgcacagagcacggtgttggccacagagcaggacgggcctgcgctgctttcctgtcatcacgcagggataatctttacctctcatttaaaaaggccaatagtgcccatgtcacagggattatcagcagccgctctgacagtgctgaatggagaacactgctccatctcgctgttattaagacgcacggaggcctcaccgccaacagtccatgcgtgtttcttggcagccctggccgggtagtggtgacggtgctctgaatagggggcacccactgcccctcgctgctgcccccatgaccc

SEQ ID NO: 471567 - DNA, 1139 bp, Homo sapiens
ctgtcacctgggccatggggcggcgcccacatgtggacggtgctcttgtgtggatggtgctcttgtgtggacagtgctcatgtgcaggtggtgctcatgtgtggacggtgctcatgtgtggacggtgctctcgtgtgggcggtgctcatgtgtgggtggtgctcatgtgtgaacggtgctcatgtgtgggtggtgctcatgtgtgggtggtgctcatgtgtggacggtgctctcgtgtgggcggtgctcatgtgtgaacagtgctcatgtgtgggtggtgctcatgtgtgggtggtgctcatgtgtggacggtgctcatgtgtggacggtgctcatgtgcaggtggtgctcatgtgtggatggtgctcatgtgtggacggtgctctcaagtgggcagtgctcatgtgtggatggtgctcatgtgtggacggtgctctcgtgtggacagtgctcatgtgcaggtggtgctcatgtgtggacggtgctctcatgtggacggtgctcatgtgtggatgtgctcacgtgtggatggtgctcatgtgtgggtggtgctcatgtgtgggtggtgctcatgtgtgggtggtggtcatgtgtgaatggtgctcacgtgtgaatggtgctcatgtgtgggcggtgctcatgtgtggacggtgctctcgtgtgggcgggcgcagaccactggcccccaggtcttacggcaggtcctgggccggagactggtctgcagccaacgccaccagcgcccaggctctccttggccggccgggtacactgttgccatccaaagcacacaatattggtggtgtcaagagagtggacttcaagacaaaactacttgtttcgtgaaaatagtcacacactgacacggactcctttaggactgatcctctagcttgtcatgcgactcttccaccgtataatggaggctgaaggaaacagcacgaggtagatattctctggtgaggatgcacatagttaccccgagtggtgtaaagttagaggagatgtgtgtctcagtctcactgtggtgaccatgaccctttctttctgctatgaagttgctggttatttttaaatgtgagtgacacgggattgtaaagtttgtacgtggctacagcatggcacagggttggctttgc

SEQ ID NO: 471568 - DNA, 666 bp, Homo sapiens
tgccgccaaatgatttcaatttacagagatctaaattataaatatggagaaggtgttttatcatcactaaaactgaaagtgcacgtgaagtttaagaacccccggaagattgggaattacctctgcaaacaccaagctcccgcagcagctgatctgggctctgcctcggacgtcagaggagacttgagaatttttcttacctctcctcaggagacagttgcacaagtacccacatttaaagatatgtgtgcaaaacctcaccattgccaaacttacacaggaacagaaaaccaaataatgcgtgttctcacttataagtgggagctaagtgatgaaattcagaggattcaggcaaatatcttaggcagaatcatggccgtcctccgagccctaacggcatttgagatgtgtccagtgggagtaatgttcccccagctcggcctccacgcaaggagccggttcctcaggaaccgtaagcgggagaaacactcagcttcagacctgctctgactcggagactgtctggtgaaccagagaactgggttattggcatttcctacctatacttaaccgtttgtaaaccctatacatattttctgataagctactttgtccacgagcaaagataaatgtcttagatatttccattatgtttacttggcctca

SEQ ID NO: 471569 - DNA, 1047 bp, Homo sapiens
acaaagacagcagtcatgactccttctcctgcccctcactgtcaatggtggcactggggggtgtgaggagggcgtcagggtgcgaatgggagaaagtaaaaaccaaggcaggctgcaatgggtgggacaagtattgagggcagcagatgggcatcctctcctgggggaagtgcctgagggaggcaatgcaggggccacgaagctctttggtctcctggctgcagaaggcaccgtgttacttcctagtgtgtctgcacccatgaagattctgaatgtctcatgtctcctgtatcatcagcctcatgggcgagtgagcatgcaccacaggcctcgtctcaacaaccctcaggggccatcaccacaggccgtcatcacacttcgatatcctgaagaaactgttttagttaaaccaacaacaacaaccaaaaacagaaatcaacctaaaaccttgcccaagcaagtgcaatattatttgaaggacaactctaacctctaataattaataaatctttattttatcattttcattataaatcgctagagaatcatttgaaaatattattactattggtaatcctattactgaatttttttattgctttcaggaattcttcataaataaatgtatataggacaccactgatggtccacatgtaggaacattgtgtttgatttaaagctaatttttttttctaagtttgcatttgtttgttttttcatttgccaaagtatcagacttttcatatttcatattgtgcttaaaataaagctgagacaattattggaaataatataaattcagacattctgattgcttgggggcatggactgcaacacagagagagttaggtgatagatggatggttggatacctagatagatggatggatagatagatagataaagatggatatttgacttggctaatcaaagatggtttatttgccaaaacaacttgcgttcataaatataatttttgatttcatgtgcattgactttttactttgtgtatttaacattttaacattttattttctgattgcatca

SEQ ID NO: 471570 - DNA, 952 bp, Homo sapiens
agtccaggaaaagacaaataccttttttttttttgagacagggtctttctcttttgcccagaccagaatggagtggggtctgctctgcctgtgtggtccctatggttcctggagattttctaactttatttctttgataattttcactggttcattgtctccttttccccttgattttaacaatggcaacctctgcactgtcacagaatgcagagctgtggccttgagatgggaagctgtttgccaccataggatgggccatgggtggtcgtgtagggagttgtgtgccatctctgctgctgcaaactctccacgctcatgcttcctggttcaattccccaccccgcagatgctctgcctggttccatgtgggtccctccagcaccttctgcactcctggccttctccccaggttcccagccctgactgctcaggaatcctcccccaaggcagcttgctgcgcatgctcaggcttgaaacaggacctgaagagagagaggtgccaagcctgcagcaggccaggtccaggggagaaaatcacagaggaaatcactatttttctaattcctataaaaaaaaatcaacctagagcaatgtaattcactaaaagctcaagaagatagaacgctaatatattctttgttcttttattttttttaaatgccttttcatttatattttcccaacttcttcaacttcaaagcaactatgggacgatattcatcgtaaataaaaacagctgagcacaacagcagtttacaagtcttaaatgaagcaaacgtattaatcatcttgttttgattcaattactctgctcttttgctttcaataataaatgaattttcatttcccttcctttttattgctcaatgaaatctgcgtttggagaggtggaggacgagctgaaggagatggcgggagacgtgggctcctccagctgcacgtggcctgc

SEQ ID NO: 471571 - DNA, 678 bp, Homo sapiens
agaacgtgcttttcccttgaaaccttctacttgtttaaaatcaagtcaggactgatacttctgctgctctgattaaagccagcatgttaactttaggagataatgtttcagacaggaggtgtccagaagaaggcattgttgtcacaggaggtgacagctccatgcgtgttactgctcctgaagatcttccagtgggacaaaatgtggaggtgaaagacagtgatattgataatcctgaccctgcgaggtgtctagaagaaggcattgttgtcacaggaggtgacagctccatgcatggtactgcccctgaagaccttccagtggaacaagatgtggaggtggaagacagtgatattgataatcctgaccctgctcccatgagacgatatcgaaaggtgctgtttccaaaaaacactcaagccgtgtttgccgtttgctctcatgctgacacaacgacagtcaacacagaagacttctgtcatcccaaaatatgcggagatttctccccatcaggaatcaagcaaccaattcttcagcagaccccaactgcatgtcggatcccacacattgagctcccagtcccggaagactgccccacactttccaccagtcacaagtccaggcctccaattgaattcaagttggggctcctataacccctgctttgggtttgaaaaa

SEQ ID NO: 471572 - DNA, 529 bp, Homo sapiens
atctcacaggtagcctagagatgtttgacacaaaaccaaaagatgaggaagggccaccccaaagaactcaggtacgaaggagctacactaggaaccttgctggtaggttctgacgtggatggaagtcagcaaccagttcacgcctctcaagccaaaactggagacagaacaaagaactgcttcctctcattgcacaaggccctgattcagacccgggggttagaaggggcagacccatggacatggcaagaggcttcagatccaccagagccaaggggctgtgggacagatgtggacatcccagtgaggatgttccgtgggaaaaaaagagcattaatgaatcaccgcgagtcagacaagtgtgcgtcagtgagggaggtgctcttccccaactcggatttatttatttttgtaaagttaaatcactccttcagtcacccctttggcagagtgatgccgtcagcaacttcatgacagcttcgagtctttatgtgaatgacacatattatcaaatggtcctaatgaaacc

SEQ ID NO: 471573 - DNA, 666 bp, Homo sapiens
tgccgccaaatgatttcaatttacagagatctaaattataaatatggagaaggtgttttatcatcactaaaactgaaagtgcacgtgaagtttaagaacccccggaagattgggaattacctctgcaaacaccaagctcccgcagcagctgatctgggctctgcctcggacgtcagaggagacttgagaatttttcttacctctcctcaggagacagttgcacaagtacccacatttaaagatatgtgtgcaaaacctcaccattgccaaacttacacaggaacagaaaaccaaataatgcgtgttctcacttataagtgggagctaagtgatgaaattcagaggattcaggcaaatatcttaggcagaatcatggccgtcctccgagccctaacggcatttgagatgtgtccagtgggagtaatgttcctccagctcggcctccacgcaaggagccggttcctcaggaaccgtaagcgggagaaacactcagcttcagacctgctctgactcggagactgtctggtgaaccagagaactgggttattggcatttcctacctatacttaaccgtttgtaaaccctatacatattttctgataagctactttgtccacgagcaaagataaatgtcttagatatttccattatgtttacttggcctca

SEQ ID NO: 471574 - DNA, 565 bp, Homo sapiens
gttctcaccctcctaaccaccatggccccccaacctcagtgatcacagacacatggcaggaatggtgttatgtatggcaccaacgctcagctacagcctttcagaactggactcacatcattcacggggagctcctgcaaccacctgttctgagaaagccccacatctgtgtggtggtgctggactccccacacctgtgctactgcaggactatgctagcagtcctgggccccttgtgtccactcagggcaccattagtgtgtgcccactgtgtgccaggccacctagccctgaggtccccaaggctggccctgctccagcccacccaccagcttcaggagagcaccacgggcagccaatggctgtggatgggcaccaggaggactctgacagtgctggacagggtgctggggttaagcgaagacccaactggtgggtggagggttggggctctggggctgtcactactggagcgggagggtacacaagctgcggcaaagtaatccctgcagtcctggatcaaggttggtgatgccagtgtgaacagctgcatggtgaccatgga

SEQ ID NO: 471575 - DNA, 880 bp, Homo sapiens
cctgcctctctgcgtcatgggtcccacgagcatccctgaccccagtgctgtccttgggactgggaatgtcatgggtcccacgagcatccctgaccccagtgctgtccttgggactgggaatgtcatgggtcccacgagcatccctgaccccagtgctgtccttgggactgggaatatgccaggtcgcgggtggtgcaggaatgctgggaagggccctgaccccggccctgaatcccgctcccgaggcctgctgtgcgaccctgggagctgcaccctggagactgaatccggttcccgaggcctgctgtgcggccctgggagctgcaccctggagaaagagggctctttggtgactcctccaagtcctgcaggcttttctccatgtttgaggtttgctggatggtttgatgggatgcctctcaacatccaggggactgtcacgaagggctactgtggtcagcgtggactgcttccgttacgacaatttcataatcattgagtaaatggatgttctcctttgaaaggttctgtaacatgtatgttggatcaatgaaggcaagccaatagtgcattgctcaatcatatttattttgaattgataaagtttaagctaaatcatgaatgtgagcatggaatgaaagttagggaagacgctgtctaactggagacctgtacactccattgccattttccttgttgccttgggggacaggggagtggattttagacgacttgggctctgaatgaatacaatccccaagctaggctgtgtagcatgggttcttattgggacaattcctgcaccctcccccctacccatcccagagaacactggcagttgctggaacattcttggttatcttaaccggagcgggagtgc

SEQ ID NO: 471576 - DNA, 1774 bp, Homo sapiens
atgcctgttctccctgtttcttgcccctctactggtccctctgacactttagctccctttgtctccccacttaacccctgctctctcatcctgtctcctctcctaatttctagcctcttctgtttaccaatcccattgcttttcttcccaccaaaaaaagagcactggctgggtgtttttccattgtgtgttctctagatttaatcaattggccttgcaaaagtaggcatgaggagggcaaggttagtccggacagagtccgttccgtgtgacatcaacaaccctctacggaagccacctcgctattcagacctgcacatcagtcagacgctccccaaaaccaacaaaatcaacaagtcaaattctgaatactcagggcatggaagtagcttgatgatgaagaagacagagaaagaggagaaggaagaggcaggaggaataggaagaaggaaggaggaggaaaggaaggaggaagaggaagagaaggagaaagaaggaggaagaagaggaagacagagtggggtggatgaggagaatggaggagggggaaggaggagaagcagcaacagtagcatctgccaattccttatgggaccaagctacaacccttgtacttccacatcaagccatcaaaaataccatctgcagtagtggcagaggctgaatctctgcctgctgtattcaagctgtttgaagtggctgcatgctggtttgcttttgttgttcctactccttatgacctttggcttctttgttttctggcctgttgtggctcccctgttctctttgaacctcatcttatctcagcctttgctcctaatgctctctgctcttcttcctaatggcctatctcatcattccatcccatattataggtcactggtcagctgccattatgctctggcctatgatcctgtgttgggagtgggctatggaggtcataagacaagtgtgtctgtttaggacagtccattgaacaaaggctgttgggttggaggttcattcattcattcatataacattgattagttacctcctatgtttttgtttctgtgcttagttttgcagattccaagatgaggaaaattctatagcttgggaatgttaattgtccatggggccagtatccatttgtttgtctacacaatcatagttgagtttccctttctcagagactctctggagagggtctagtttctccctccagagataaacacctaacttgcaggtttgctgccaagattaaatgaactaacaatattagttactctgcttccaggaagatggagtaattgtacttttccatattcctcccactaagttcagttgacccttgaaaaatgtgggggtgagaaatgccaaccccacccccacagttgaaaatccacatataactgttgatgcccccaaaacttaactactaatagcccactgttgatcagaagccttaccaataacacagagtttattaacatgtattttgtatgttctatgtcttatatgccatattcttacaataaagtaagctaaagaaaagaaaatgttattaagaaaattataaggaagaaaatatatatttactattcattatgtggacacaaatcatcataaaggtcttcatccttgtcgttttcatgttgagtaggctgaggaaaaggaggaagaggaggggttggtcttactgcctcagaagtggcagaggtggaagaaaattcacatataagtggaccattgcaatgcaaacctgtgttattcaagggtcaactgtacagct

SEQ ID NO: 471577 - DNA, 1314 bp, Homo sapiens
cctttcctagccaagggaagccgtgacagacagcacctggaaaatcaggtcactcccaccctaatactgcccttttccaacaatcttagcaaacggcacatcaggagattatatcccacgcctggctcggagggtcccacacccacggagccttgctcactgctagcacagcagtctgagatcaaactacaaggtggcagcgaggctgggggaggggcacctgccattgctgaggcttgagtacctaaacaaagcagccgggaagcccaaaccgcagctcaaggagaactgcctgcctctgtagactccaccaatgggggcagggcacagctgaacaaaaggcagcagaaagttctgcagacttaaatgtccatgtctgacagctttgaagagagtagtggttctcccagcacggagttagagatctgagaatggacagactgcctcctcaagtgggtccctgacccctgagtagcctaactgggaggcacctcccagtaggggccgactgacacctcatacggccaggtgcccctctgagacgaagcttccagaggaacaatcaggcagcaacatttgctgttctgcaatatttacggttctgcagcctccactggtgatacccaggcaaacagcgtctggagtggacctccagcaaactccaacagacctgcagctgagggtcctgactgttagaaggaaaactaacaaacagaaaggacatccacaccaaaccccatctgtacgtcactatcatcaaagaccaaagatagataaaaccacaaagatgggaagaaaccagagcagaaaagctgaaaattctaaaaatcagagtgcctcttctcctccaaaggaacgcagctcctcgccagcaacagaacaaagctggacggagaatgactttgacgagtggagagaagaaggcttcagaagatcggtaataacaaacttctccgagctaaaggaggatgttcgaaaccatcgcgaagaagctaaaaaccttgaagaaagattagatgaatggctaactagaataaaccgcatagagaagcccttaaatgaccttatggagctgaaaaccatggcacaagaactacgggacacatgcacaagcttcagtagccgattcaatcaactgaaagaaagggtatcagtgattgaagatcaaatgaatgaaatgaagcaagaagagaagtttagagaagaaagaataaaaagaaatgaacaaagcctccaagaaatatggggctatgtgaaaagaccaaatctatgtctgattggtgtacctgaaagagaactttccccaacctagta

SEQ ID NO: 471578 - DNA, 516 bp, Homo sapiens
atttgtaaatgatgaagttgatctggctgctacaatgtgttaaaaagaagaagaaaaaaaaggaactccccggcaaatccaaggtccggcagctgggagtggcagccctgggatccaaggcagccttcttaactttgccacccttcttccaaatgtacgtagcaccaggagaattttcaagagccttgacatctacttttagagacatgctatctgataatgacaagtgttcacaaagagctttgtctttctctggatctacaatcccatcacagtcttctgatcatgaacagcggcaaagatcttcagcttttcgtaggattttcgtgacctggttcagctggccttgtccaatcagcgcatgtgcagtgttgtagcacagctcatgtgcaccttcttggaggcccaagttctctggaaccactttttcccaattgctttgaggagtaacaactgctgaaagaaaataaataaataaataaataaataaaatatataaataaataaattgaaaga

SEQ ID NO: 471579 - DNA, 1069 bp, Homo sapiens
gatgtgggctgcagctctggaggcctgggaaccatggcaggtgatgggttagccccagccctggctgctggaacagaattgatgctcattagcattccccttctgcccaagacccttctccacgactggtttttaaatcccctttggcaccttccatcaccccttggtcttgaatcctcagaaatggaagtttttggcgagatcaagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaataggtggttcttcaacccttgccttcctcccttcttcctcttggagtccccagtgtctattgttcctgtcttgatgtccctgtgttcccaatgtttagctcttgcctacaagtgagaatacacagtatttggttttctgtttctgagttatttcacttagggtaatggcttccagctgcatccatgttgctgcaaatgacatgctttagttcttttttatggctttgtagtattccatggtgtatatataccacagttatcctgttcaccattgatgggaacctaggttgattccatgtctttgctgttgtgaatcgtgctgcaggctgtcctgtttaaat

SEQ ID NO: 471580 - DNA, 1421 bp, Homo sapiens
gccgccagcaaactttctgtcagcaggcacagtcaagaatctgtaccaagacgtgatgttggaaaattatagcaacctggtatcactggggtatcaagttaccaaagcagacacattattctggttggagcaaggaaaaccatggatactagaggaagaaatccagagtcaggtttgtccagaagatgcctggcaagtcaatgatcacacagaatggcaccgagaaaaccaaagcagccttgaaactatggacagacaccacaaatatcatatatttggcaacataacatctcatctgagctcaaaccttcataccccttttgtacttgggaaacacctgaatcctaatctagagtactttattcaaaacagaagctatgcaagaaatgaaggtgaatgtaatggatatgacaaagtttttctttatcctaagcatgagaaaattcatgctgaagagaaatacaatgaatataatgaacgtgtaaaggctttcagtcataagtcacagctcataaaacactggaaaactcaaaaacgagagaaacagtatgactgcagtgactgtgggaaagccttttcccagaagttggacctctttaagcatcaaagaacacaaagaggagagaagccctatggatgcagtagatgtcagacagccttcagatggaagtcctgtctcattttacacgagagaacccatacagaagagaaaccttatgagtgcaataaatgtgggaaagcttttactgataagtcatgccttaataaacatcaacgaactcacacaggagagaaatgctttgagtgtcatacatgtcaaaaaggttttagtgataagtcaaaactcactttccatcaaagaactcatactggagagaaaccctatggatgcagcaaatgtcagaaaagcttcagcaataagtcacagctcatgatccatcagagagctcacacagaagagaaaccctatggttgtgatgagtgtgggaaaacattcccccttaagtttaacctcattttacatcaaaaaatccataccggggaaaaatcgcatgggtgtaatgaatgtgggaaagccttcatccagagatctgagctcagtagacatcagagaactcacacaggagagaaaccgtatcactgcagtgaatgtggaaaaggctttagtgtaaagtcattcctcaatactcactggagaactcatatgggagagaaaccctatggatgcaacgaatgtgggaaaatgttctccatcaagtttagtctcatcctacaccaaagaactcatacaggggaaaaaccctatgaatgcagtcagtgtcagaagactttcagccaaaagtcacacctgaatattcatcagcggtctcacactggagagaaaccttaggaatgtggagaatgtcacaaagccttcagcc

SEQ ID NO: 471581 - DNA, 1154 bp, Homo sapiens
gcctcaatggtacagaggcaaagatgaggctggggaagggatgggagagtaacgggagaccaggagcgattggtcaacaggcacgcttacagttagaaagcgcaagttctagtgttctcttacaaattaggcaaattaacactggaacagaaaaccaaacactgcatgttctcacacagaagtgtgagttgaacaataagaacacaaacggacacagggaggggaacattcacacactgaggcccgtgggtctcaggctcaactgggaggcaccttataaacacagatcgttcatctaccccactaactggagagaaggaaaacgctgggtaaatagaatgcagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccaccgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgcttcctagcttgtttgctttcgaccagccaaggagacctggtggcagggttggtgtttctgattttatactattgtataggatgatttaaagagtattccataagctttatgcctagtgactctgcttcataggttcctcaaaaaaaaaaaaaatgcaatattgtgtcagcgtgtgtatgtatattaaaagctcttattacttacttttctcaaaaggcaaaacactgttttacaccaacatttcataccctcatctgaccacagtgcaatgcttcttaaa

SEQ ID NO: 471582 - DNA, 3332 bp, Homo sapiens
atgatgatgtgtcttcagacaacagcagagagaaaatcaaaggattttccaggccattcctacaaattcgatttgttcagttgaattttataatccacttccgcacctccaggtcacaagtgtcctgtggatataggagtcctttgctgaagtgagaaactgcatgtgttgggcaagatgaacttttctgtaatcacctgccccaacggtggtaccaaccaagggcttctgccttacctgatggccctggatcagtatcagctggaggaattcaagctttgcttggaaccccagcagctgatggacttctggtcggccccccaggggcacttcccgcgtatcccctgggcaaacttgagagctgccgaccctttgaatctgtcctttcttttggatgaacacttcccaaaaggtcaggcatggaaagtggtcctcggcatcttccagacaatgaatctgacctcactgtgtgagaaagttagagccgagatgaaagagaatgtgcagacccaagagctgcaagatccaacccaggaagatctagagatgctagaagcagcagcagaaaaagttggttctactgggggcttccattattgctggcccattttcactctggggtattttcatatctcatcgtcaatgtttatttcagggaatatgcagacccagggatgccaagatccaaaccaagaagaactagacgagctagaagaagaaacagaccacagaagaaaatacagagagaacatgaaggctgaactactggagacatgggacaacatcagttggcctaaagaccacgtatatatccgtaatacatcaaaggacgaacatgaggaactgcagcgcctactggatcctaataggactagagcccaggcccagacgatagtcttggtggggagggcaggggttgggaagaccaccttggcaatgcgggctatgctgcactgggcaaatggagttctctttcagcaaaggttctcctatgttttctatctcagctgccataaaataaggtacatgaaggaaactacctttgctgaattgatttctttggattggcccgattttgatgcccccattgaagagttcatgtctcaaccagagaagctcctgtttattattgatggctttgaggaaataatcatatctgagtcacgctctgagagcttggatgatggctcgccatgtacagactggtaccaggagctcccagtgaccaaaatcctacacagcttgttgaagaaagaattggttcccctggctaccttactgatcacgatcaagacctggtttgtgagagatcttaaggcctcattagtgaatccatgctttgtacaaattacagggttcacaggggacgacctacgggtatatttcatgagacactttgatgactcaagtgaagttgagaaaatcctgcagcagctaagaaaaaacgaaactctctttcattcctgcagtgcccccatggtgtgttggactgtatgttcctgtctgaagcagccgaaggtgaggtattacgatctccagtcaatcactcagactaccaccagtctgtatgcctattttttctccaacttgttctccacagcagaggtagatttggcagatgacagctggccaggacaatggagggccctctgcagcctggccatagaagggctgtggtctatgaacttcacatttaacaaagaagacactgagattgagggcctggaagtgcctttcattgattctctctacgagttcaatattcttcaaaagatcaatgactgtgggggttgcactactttcacccacctaagtttccaggagttttttgcagccatgtcctttgtgctagaggaacctagagaattccctccccattccacaaagccacaagagatgaagatgttactgcaacacgtcttgcttgacaaagaagcctactggactccagaggaagacttcacaaagaagatgttgggtcgtatctttgaagttgaccttaatattttggaggacgaagaactccaagctttaaagcactgtaaaaggttaaataagctaaggctttctgttagcagtcacatccttgaaagggacttggaaattctggagacaagcaagtttgattccaggatgcacgcatggaacagcatttgctctacgttggtcacaaatgagaatctgcatgagctagacctgagtaacagcaaacttcatgcttcctctgtgaagggtctctgtcttgcactgaaaaatccaagatgcaaagtccagaaactgacccaagaaaacgagatagaaggcaccatgaggagaatgtacttagtatattcaaatgatatcaacaaagccatcaggccttctattaccaattctggacatgtatttctgtccagtgacatgttggagccagctgctacaacctggtgcaaatcggtaactcctgagtgggttctgcaggacctcattattgcccttcagggtaacagcaagctgacccatctgaacttcagctctaacaagctgggaatgactgtccccctgattcttaaagctttgagacactcagcttgcaacctcaagtatctgtggttggagtcctgtggccttacctaccagatttgtcagctctttctcaaactcactgagaacacaagtctcaacttcctcagcctgggagacaatgatctctctgatgtgagaagcctgagggagtcctccacgctaccaacgtgtcccctgaaggagctgtccctggagaaatgcaacttgtcggcagccagctgtcaggacctagccttgtttctcaccagcatccaacacgtaactcgattgtgcctgggatttaatcggctccaagatgatggcataaagctattgtgtgcggccctgactcaccccaagtgtgccttagagagactggagctctggttttgccagctggcagcacccgcttgcaagcacttgtcagatgctctcctgcagaacaggagcctgacacacctgaatctgagcaagaacagcctgagagacgagggagtcaagttcctgtgtgaggccttgggtcgcccagatggtaacctgcagagcctgaacttccatgaaacaggaacaggctttttggctcataagtagaataacaccccaaacccttctcagttcctgaagacagctgcctttttgctatacttcaccctgcttagagtttatctatttagctgacggtactccaaacagcccctcaaatttgtctaaacatcttccatgctctgcctgcccctctcactttgtcctatgcacttaaaaccacaagcctttttccaatgttctac

SEQ ID NO: 471583 - DNA, 4563 bp, Homo sapiens
gctgatattctatcctgagttgatgcaaacttggtaaagttggttatcttgtggggtttctccccttcaactatagttctcatattccgccctggacattctcttgctaccccggctccccatgtgaaaatggggtcatgctgtacatgagaaacgtgagccatgaggagctacaacggttcaagcagctcttactgactgagctcagtactggcaccatgcccatcacctgggaccaggtcgagacagccagctgggcagaggtggttcatctcttgatagagcgtttccctggacgacgcgcttgggatgtgacttcgaacatctttgccattatgaactgtgataaaatgtgtgttgtagtccgcagagagataaatgccattctgcctaccttggaaccagaggacttgaatgtgggagaaacacaggtgaatctggaggaaggagaatctggtaaaatacggcggtataaatcgaatgtgatggaaaagtttttccccatatgggacattacgacttggcctggaaaccagagggacttcttctaccaaggtgtacacaggcacgaggagtacttaccatgtctgcttctgcccaaaagaccccagggtagacagcccaagaccgtggccatacagggagctcctgggatcggaaaaacaatcctggccaaaaaggtgatgtttgagtgggccagaaacaagttctacgcccacaagcgctggtgtgctttctacttccattgccaagaggtgaaccagacgacagaccagagcttctccgagctgattgagcaaaagtggcctggatctcaggacctcgtgtcaaagattatgtccaaacccgaccaacttctgctgctcttggatggctttgaggagctcacatctaccctcattgacagactggaggacctgagtgaagactggaggcagaaattgcctgggtctgtcctactgagcagtttgctgagcaaaacgatgcttccagaggccacgctactgatcatgataagatttacctcttggcagacatgcaagcccttgctgaaatgtccctctctcgtaacccttccggggtttaatacgatggaaaaaatcaagtatttccagatgtattttggacacacagaggagggagaccaagtcttgagtttcgccatggaaaacaccattctcttctccatgtgccgggtccctgtggtttgctggatggtctgctctggtctgaaacagcaaatggagagaggaaacaatctcacacagtcatgtccaaatgccacctctgtgttcgtccggtatatttctagcttgtttcccaccagagctgagaacttttccagaaagatccaccaagcacaactggaaggtctgtgtcacttggccgcagacagcatgtggcacaggaaatgggtgttaggtaaagaagatcttgaggaagccaagctggatcagacgggagtcaccgccttccttggcatgagtattcttcggagaattgcaggtgaggaagaccactatgtctttaccctcgtgacttttcaggaattttttgcggccttgttttatgttctctgtttcccacaaagactcaaaaattttcatgtgttgagccacgtgaatatccagcgcctgatagcgagtcccagaggaagcaaaagctatctctctcacatgggacttttcttattcggttttctgaacgaggcctgcgcttcggccgtggaacagtcattccaatgcaaggtgtctttcggtaataagaggaaactgctgaaagtcatacctctgttgcataaatgtgacccaccttctccgggcagtggggtcccgcagttattctactgtctgcatgaaatccgggaggaagcctttgtaagccaagccctaaatgattatcataaagttgtcttgagaattggcaacaacaaagaagttcaagtgtctgctttttgcctgaagcggtgtcaatatttgcatgaggtggaactgaccgtcaccctgaacttcatgaaccccaataaccagatgcagatgaactgggaaacaagagagtctatttctgtaactgggtacacagggagaaggccaagaaatatcaccagaccaattaaaaattacaaagttttccagagcttatatgccttctaagctatatgtctacgtgtaagtgttcattcctctgaagacaccccaataaaacttgtttgtggaggtctggggagtttcttcagacccctaataaaaacttgtttaatcctgaatgggtcctgttgagaattccttcattatcctgtcatacttcaaggcccaggaaaggcctgggcaaaactcttggtggtcttttgttacattccagcctttgtgtgagggcactggctctgtcagcttttaatatttaacttacccactcagtcggtgctgaaactgttgtgatggaggcctgcctgttcagctgctagcgagacctggcctgccacaggtagaatgaattctgttcactcagatattgaatggctacatcagaccatgtttttttcatgtctactcccaacttatgtgggcaattccaacacattccacaaaatcacattcaaggggccctccagtccctgaggaccttttattagggaggggaataaacaccagagcttgttgttcaacttggggataactgttggtcacccgactaagacctcaagaatctaagcacagtgaatcacaatgtctttctatgatgctgcgtaaagacctgacatccgtagaaatcttaagacacgacatatttctttcatgttggttagtccattgatcacttttgtatgggttcctgcagggagttgatatcattcctacttatttgcatttctatgtatttgacggatgtgaaaatggatgaatctatttcatgggatttaaattttatgcaaaaattacgctagtgtaaatattctaaaaattgctttttcatctcatgtgtcttggcaatgtctatacatgccattttcaatgaagtattctttgaaaaatagagtgagactctgtctcaaaaaaaaaaaaagatacatatatacatatatatgtatataaagatacataagatacatatatacgtatatacgtatataaagatacataagatacatatatacatatatacgtatataaagatacataagatacatatatatatatatgtatataaagatacataagatatctgcatatgtgtacacatatatgtacagacacatatatacttattttataaatatttatatgtagatacttattttatatattatacatataagcaatatattatttatatataagtatatataaatatataaaataaatacgaatatattatatgtaaatatatgtaaatatacaatatattatacattatatacttacatattatgttgtatattatatatttatatatacataatttatattatataaatatatgtattatatatttatatataatattaaaatatatattaattatattaatatatttatatatgaaaatatataatgtatatatttccctgttttttgtggtctctttgctaacatgtataccagccagtgatataaaagcattcgttctgtttttaattctttggttaccttaagtatttggaaaagacttgtaaacatctcctctcatgatcaaaaaatgaatctaattttacctctttcaatccaaattttttgctctccattagcatagtcttggtatttaatctagctcatttaaattattgtcttgtagaacatctttcatttccaggattagtttggataatggtgttcatttttgttgatgatttgcttctcaaatgaaattcagtatgaattcactgccagtcatgattctttgatgcctcaaatctagtttgggttttaaatgttgatttatctcttagattgagtgaaatatattttcaggtagaaaagaactttctacacttgaaagtgtttatgcagtattttctaagcctttgcttgtatgagattattattatttttttcagatcacaaaattaattttatgtttccagtatacctgtggggctaacaagacagttatctgctttgggtccttttcatccacctgtcccctttgggtttgctgtttaatttaattttttttaaatttttttattatactttaagttttagaggggggagggatagcatttggagatatacgtaatgttaaatggcgagttactgagattattttttaatctagttttggtcatgagcagtaacttggctcagtgtaaaattcatggaccctatctgtcttagtctgttttctgctgcttataacagaatacctgaaattgcatgacgtataaagaaaaggactgtggaggctgagaagtccaaggtggaggggctgcatctggtgagagccttagtgctggggggattctctgcagggtcactagtgagtcactgagcatgctgtatactggctcagatctctttccctcttcttatacagccactcatcccactcccatgataacccgtt

SEQ ID NO: 471584 - DNA, 535 bp, Homo sapiens
tgaggtgattgagcaggttcatacattcagagctgagaataaataaaggtagaagaagcaagaagacgatgaagactttgtctatatcctgtcttagccttgagattctgggctcaagtgatcttcccacttcagccccccaaatagctgggaccacaggcatgcgccatcatgcccaggtgatttgtaaaacattttttaatgtagatggggactccctatgttgcccaggctggtcactaactcttgggctcaagcaactctccaccttaacctcccacagtgctgagattacaggtgcaagccactggcctggcccccattgttctctgagcattgtcttacttctggcacaagatgttccaagcccattctgtacattcccagcaccaactgtggagtcagctctttctctgaagattcttggttcctttaatgaggaacggtacttagaaaacaatacctgagcaccagtgtgctgtttctatgataccattgtttctacacttaagtttctttttcatggctgaatagt

SEQ ID NO: 471585 - DNA, 794 bp, Homo sapiens
ccagctctgcatgaattattctctattgcgattccctgtcttgacgaatcagctctgtctaggcagtgggcaagctacatttttttttctgtcccccgggctggagtgcaatggtgcgatctcggctcattgcaacctccgccttccgggtttaagcgattctcctgcctcagcctccagagtagctgggattacaggcatgcaccaccaagcctggctacttttggtatttttagtagagacagggtttcaccatgttggccaggctggtctcaaactcctgacctcatgtgatccacctgcctctgcctcccaaagtgctgggattacagaattcagtgatgggcggaggcgagtggtcacagagtgtggctacatgaaatacacacgttggagaaagatggttaattgtgagtgcgagtttacatttcatgggcccctggggtgtcgatagttcctcaatggatgtagatccgttactcaatttcttctctaaagatggggctagattacaatggttctcaacctaagaaaactttgcatttcaggaaatattttctactgcccagagacatttttgatcactgttaactgtgaggatgtgagctggtatctagggggtagaggctagggatggtgccgaacaccctggaaatgtacaggacgtttcccaacgagtagtgatccgatcccaaatgtcaatagtgtggagaaggagaaacctttagtttcttcacgcaatgtcctttttaaactttgtgcctctctttttaccaaccttcccccttcttccc

SEQ ID NO: 471586 - DNA, 899 bp, Homo sapiens
cgacacgataccgtccacaccacattatatcgccgcacgcgccgcttactgcatccgcgccgtcgaatatgactacggctctgcgtcgcatgttctcgccgcccgttaactgccgccgcgcgctctaggtgcgcgccctgacgaacaccgcaccgacgtgctctattgagcgagagtcgaacacattcgtcacgccaacattgatctcccgcgtgaatattgttcgccgccgtctacttccctcaccgagttcttcgccaccgaggagatgtacgccggcgcgattcgtcccccgacgctcataccacccccggcaactcgcaccccgactgacaccccacccgcgatttctcccccccgcgctactcccccctcgagagtggtccccgagctatacttccccatagcatcaccgccggagattcacgacccgcagatagttccccctgactacgccgcgccgcaattcccgccccgattgacccacacgtttcacgccggcaacctcgccccgcagaggccccacgcactcggccccgcctttgtccacctcggtcgccccaccgttgtttccggcacagtcgccacgataccgccgcccaatttacgactcgcctgcccactcccaactcgccagcggaatcccgccgggaccccacctctacctccccagatctctccaagtgaccgccgacggtccgccccgtactcgccagtttacccccctggtcccgccgcatcccacaccttcccgcattgctccccgcatcgatccgaattctgccctggggagccctgaggccttttcctgatacttggcaaggatgatctaatctcatctcatgacctggcggtggtgacttccccatctcacctctggggaaaccgaggcaggcttc

SEQ ID NO: 471587 - DNA, 1226 bp, Homo sapiens
ttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcagggcccacatccggagctgcccactggtcctcgtgctgcacagccttggaggatctgaggctggctcagggtccctggcagcaactgccctgctaggtgggggctgctgggttccacagctgggccctccctgccggctgccaccaggcggcgctgcacgcccacgctgagtggggcaggccctggagcccctctgcccgggcagcctgac

SEQ ID NO: 471588 - DNA, 787 bp, Homo sapiens
gggaggccgaggccctcctgctgcaaggctgtgggtgtcatgtttgcaggtctagttccctggggccggccctggccccagctgcccagctctgccggctcccgggagacgcactctgctgacaccggactctttcctggaccatccagccgcctggccgacactcgatcccggccccacttccaggccagtgtccggccgaccagcctgccttgggccagggccccacgactccctgctgcgggacaagaggccgtctgtgcggctgtggtcgtgggagggtgtggtgaggccgtgaaggtggggacggtgcctgggcctgtggccgccagagctgctgcggctcagaaggtagcaccaggccccgtgggtgctgtgggggccatcgcctgcccaccatggggaccctcagctgcgactccaccccacggctggccacagccccccttggccggcgagtgacggagggccagattccggagaccggcctgaggaagtcctgtgggacggccaccctggagaacggtgcgtgccagccgtgggggatgggtgggaccttttcctgctccactccccatacttctggggcttctggaatgttctgggagcccagcaggaggcaggagtttcaggcaagtccttgcccttccccagacctcagttttccttccggcaggatgggtgtggacacggggttgccgtgagccccgagtatgtgtctgtccaacggaagctgcgtgctttgccagccgggtccccttccaggggctgtgggtacagcagtggg

SEQ ID NO: 471589 - DNA, 525 bp, Homo sapiens
caaggacacagctaattcttaatccatgtcccgaagccttgtcgactcctggacccttcttgggtgcgctgtgcctactgtgcgggcttctgctttggggtccttcccttccagctccccctcctctgccccactgccgactccaccactgcttgttttctgctctccttggccgacctttccagcgttctccttaggaggcggcccgggcctgattccaatgcatttggaggacagggctgggcaggcactcaccccctacgctgccattggtccctgcgggcagcagggtggctggaatgagggatcacgaggaagatccggaggacaggcccagagccagccactggcctgctgctttctgggcctggaagagggagttagagaagactctgctccaccacctcttgtggaaggcctgacattagtcaggcccgcccgcagccatccagaggcctaaacgtgcccctgtgatgctgtgcttcagcggtcacgctcccgtttacaacatcagtcattggattt

SEQ ID NO: 471590 - DNA, 2445 bp, Homo sapiens
ggctcgtgccctcgatcagccaaggtcacagagcttagaatgacactggaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaagctggggttgcagggggtggtcctgaggcatggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggttggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccgatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtctggtgcctgctgggagcccattcattgagtgtccctatgtggcacagaacccttgctgagtttcaga

SEQ ID NO: 471591 - DNA, 1455 bp, Homo sapiens
tgtcattagtgcccaggagtggggtcagcaggaggaactctacagctatgggagaacctgcgttcacctcttttccaagcctgcctgttctggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccagtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggcaacaggtcagagttagagtggcaggaagtgcctatcagcagatgctactgcacaccagcccgggcgacagagcaagactctgtgtctaaaaataaatatataatttatatataattataaatacattatatataatttctatataattataaatacattatatataatttctatataattataaatacattatacataatgtatacataattataaatacattatgtataatacaattatatactatataattatattatatactataatatatttcttatataattatattataatataatttatatgttatataattatattttatattataatataatttatatgctatataattatattatatattataatataatttatatgttatataattatattatatatataatataatttatatgttatataattatattatatatataatataatttatatgttatataattatattatatattacaatataatttatatattatatacttacatatattatatattaaaatataatttatatattatgtaattatatattatatattataattatatttatatatcatatttatataattatataatataatgatataatatatactatatagatatatgtgggatcctctagagcgaccgcagca

SEQ ID NO: 471592 - DNA, 1172 bp, Homo sapiens
gatcacccggcgtctggaaagctctcgtggtgtccccgggagatgaggccaaccacgtcccatccttgtaggaacaaaaatgagtcaccaattggccagagaggggcggtgggagctgacaacccattcctggggttggcccccctgccacagctggaaaccgcccaggggtgggctcaagcgggctgcgcacacgctcagcaccagctctgtccagagattcaccggctgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggagctccaggcattgacactgggtcctgggacctcatcgggctgatgcgaaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggcaacaggtgtaaggagtggatggttttgtg

SEQ ID NO: 471593 - DNA, 520 bp, Homo sapiens
gctgggggcttttatgaggcaggggctccatcagattgagagtgcagggccccgaggttccattgggttccctgaaccccgtggaaatgtggcccttccgagaaacctgggctgggctgcccagggccgtgggaatagcctctatgggtccctggttctccttgggcagacttttgagtcagaggaaagccagcttggggaggaaagcaatttcctcatctcaggccccccaaagccaaggtggtactttctagatgctggccccagagctccgggatgtgccgtggacctctacacagatgttcatcaattcctgggctctggtcaacatccgttgaagttggaatggttgttgggaccccctctgatgtccccccaagacagggccaggaatgtggcaggggaattctgtggctagtgggggaccccaagtgagggcttgtctggggtcttgtctggggctcagtcctgctgctgacttactgtgtgatgtgagcagatgaaagaccttctctagaca

SEQ ID NO: 471594 - DNA, 1632 bp, Homo sapiens
agcaaagggaccactctagacccacattttggcatccctgaggaaaacgggaaagggacaggtaaaaccacaactttaaaacttttcaaagggactctcctcccacccaaagaaggactgatttaggaatcactgtgagatgttccagcccagattagagtaagtcatggctactttttccagctctgcctgtctgactgtggggcagcagatgcatcaaagacagtgggaccacctgggcaccctgaaaggaaaggggttgatgaaagacagatgctcgaccaccttcaattatccaccgacagacttctcttcattactgagaatggggctgaatcagggtgttgaccttggccacatccatgtcatagagctacttcacatgctgtttgatctggtgcttgttggcttcaatgtccacaatgaacaaaagtgtgtcattgtcttctatcttcttgatggtggactcagtggtcagcggcaacgtgatgattgcagagtggccaagcttgtttctcctgggggtgctctttcgaggatatttgggctgcctccggagtcacagtgtcttgggctgctggaagacttcattctggtgggcctcttcagtcactcaggatcacgccagctcctcttctccctggtggctgtcatgtttgtcataggccttctgggcaacaccgttcttctcttcttgatccgtgtggactcccggctccacacacccatgtacttcctgctcagccagctctccctgtttgacattggctgtcccatggtcaccatccccaagatggcatcagactttctgcggggagaaggtgccacctcctatggaggtggtgcagctcaaatattcttcctcacactgatgggtgtggctgagggcgtcctgttggtcctcatgtcttatgaccgttatgttgctgtgtgccagcccctgcagtatcctgtacttatgagacgccaggtatgtctgctgatgatgggctcctcctgggtggtaggtgtgctcaacgcctccatccagacctccatcaccctgcattttccctactgtgcctcccgtattgtggatcacttcttctgtgaggtgccagccctactgaagctctcctgtgcagatacctgtgcctacgagatggcgctgtccacctcaggggtgctgatcctaatgctccctctttccctcatcgccacctcctacggccacgtgttgcaggctgttctaagcatgcgctcagaggaggccagacacaaggctgtcaccacctgctcctcgcacatcacggtagtggggctcttttatggtgccgccgtgttcatgtacatggtgccttgcgcctaccacagtccacagcaggataacgtggtttccctcttctatagccttgtcacccctacactcaacccccttatctacagtctgaggaatccggaggcttatgagaaggtactcaacatcactgatcatcagagaaatgcaagtcaaaactgtgaggagatatcatcttaccccagttagcttacatccaaaagacagacaataatacatgctgacatttatacagttctcatctcattctgggcacacggaagatcatgttggcctcatctccttgattttaaaaa

SEQ ID NO: 471595 - DNA, 1586 bp, Homo sapiens
tgaggcagacaaatccagtctgtagagaagagatgacagcctttgggcaggcagggctgggcagggacccatcctcttggctgcattgtgatgtcttaagaagactgaaggggcaccgtgacgtcatagattgcgggcccacccctccccctgtctgcctgccctccccactggccgggcctcaacctcttctccccacaaccccaaccccagaggaaaagccccctcacctggcgtcccgcaaccatggatgcaagtcgccccaagtcctcggaatcccagtcctccctggaggcccccaggcccggcccaaaccccagtcccaacgtggtgaacaagcccctgcagcgggacttccccggcatggtggccgacaggctgccaccaaagaccggcgtggtggttattgacatgggcacaggcacctgtaaggtaggttttgctgggcaggccagccccacctacaccgtggccaccatcctgggctgccagcccaagaaacccgccacctcggggcagtccgggctgcagacgttcatcggcgaggcagcccgcgtgctcccagagctgacgctggtgcaacccctgcgcagcggcatcgtcgtggactgggatgccgccgagctcatctggcgccacctgctggagcacgacctccgagtggccacccacgaccacccgctgctgttctccgacccacccttcagcccggccaccaaccgcgagaagctagtggaggtggccttcgagtcgctgcgctccccagccatgtacgtggcatcgcagtcggtgctgtctgtctacgcccacggtcgtgtcagcgggctggtggtggacacgggacacggggtcacctacacagtgcccgtcttccagggctacaacctgctccacgccacggagcgtctggacctggcgggcaaccacctgaccgccttcctggcggagatgctgctccaggccggcctgcccctgggacagcaggacctggacctagtggagaacattaagcaccactattgctacgtggcctccgacttccagaaggagcaggcccggccggagcaggagtacaagcggactctgaagctgcccgatgggcgcacggtcaccctgggcaaggagctgttccagtgtccggagctgctgttcaaccccccagaggtcccggggctgtcacccgtcggcctctccaccatggccaagcagagtctccgcaagttgtcactggagatgcgcgcggacttggcccaaaacgtgcttctctgcggtgggtcctcgctcttcaccggcttcgagggtcgcttccgggcagagctgctgcgcgctctgccagccgagacccacgtggtggtggctgcccagcccaccaggaatttctccgtatggatcgggggctccatcctggcctccctgcgcgccttccagtcctgctgggtcctgcgggagcagtacgaggaacagggtccctatatcgtgtaccgcaaatgctactgaccagggcagagctggggagggcgtgggggcagtaaagcctctgctacagccggctctgtcctgtccttcctccagggcctgccccatcc

SEQ ID NO: 471596 - DNA, 997 bp, Homo sapiens
attattattattattattattattattattattacatcagggatcttgttagattctagataaaaatactcaaactccaatcatggggagagctcatgggatggggggctcatctggactggtactgaccctgagaaccagatgcccctggccaactggatcacttggactcaggagcatcgcctgcccccaccagatctgggggctgggctagttcttggctactccaagtttatcagagccacaaatgtgtgcagggttttatgatctggaggatgaggatggggattcttctgttgcattcacccaaaaagcttttgtatttgggacagagcctgtcatgcaagtgtgtgagaaatattgttgaattgaatctgaggtttgataaggaaacaggagccatgttatggggcagagggagacaaagaaggagggtgtcacaaacaatgaaatctattccttttggaatagatttcaaagggtggcccttacagaacctgccctttgataagaagatggacaaccttcagaatggggataattgtagttcctaccccccgagggctgtgggagaagtcgaggaggtgacacccacggggagtgttttgcggccagaaagcgccgcgtcacggatgatggataactgcattgacgtcatttcgcgtaaaagttgattgtatcagaaggagaggttcctggaagtgccatagctgggccaggtgtttgcggctggaatatgtcctgtatagggttgtaccaatttccctccccactttcaaggcaaaacagtactagtttccccagagtctcaccaacggatctttctctgtcacacaagctggagtgcagtggcatcaacgttctgaattccatgcccttgagcttggaggtgctgccccctggtgtggaggagaagaaatgtctcctcaacaccccatgacctcctggtaggggattctgtgcattctataggttgagtctaccttggggagagccc

SEQ ID NO: 471597 - DNA, 663 bp, Homo sapiens
cagccagatggaagacatgcacagggcaaggtatgggagaagaggtgcagagcttccaagccctctttagaggtgccaccccggggacccacacatgttcagcaatctagaatctcctagacagcttaacaaatcttttggatttgtatggagggaaaataacaacaccatcggacaccataatggattccccctttggtgttttgcaggaggaccctgtgctgaccgtgatcacccaggtggggctgaccatctctctgctgtgcctcttcctggccatcctcaccttcctcctgtgccggcccatccagaacaccagcacctccctccatctagagctctccctctgcctcttcctggcccacctcctgttcctgacgggcatcaacagaactgagcctgaggtgctgtgctccatcattgcagggctgctgcacttcctctacctggcttgcttcacctggatgctcctggaagggctgcacctcttcctcaccgtcaggaacctcaaggtggccaactacaccagcacgggcagattcaagaagaggttcatgtaccctgtaggctacgggatcccagctgtgattattgctgtgtcagcaatagttggaccccagaattatggaacatttactcagtaagcataatgtgtgtctttat

SEQ ID NO: 471598 - DNA, 1156 bp, Homo sapiens
gagtgggatatgtcttggacccagcaaggtcctggctacctccctctctgtcccttgcctcctcccttcaatcaccaggtttacatcactcaactccctcgatgtgcctgtggtgtgcccacctcccctgctcgcctgtgtgccccccactcatccccccctgcctgcaagctaagagagggcgtccagtttgctgggtctaaccccagtcctgagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgtgccctacgcgctggtactggaagctggttcctcacgcaattgccttctgtttgaaggagtcggggagcaaaccccccatgatccgataccgcaaggaccgtgtggtggcgcgacgtgccccctgcttcccgacggtgaccagcctccaggacctggccagtggggccgcgctggccgccaccatccactgctattgtccccagctgcttcgacttgagggtccgcgagaccagcaacgatgcagtggtcatgagggcagcttccggaactggcaggcctgagtttgtgtctctctcttccccaatgagctttgtgacctcacacaagtatataaacctctctgtgcttccaggagttcattcctgcagcagatgaaacgtatggagtgtggactgtgtgccagaccttgttttaggcactggggatccagccagaatagagacacactccccacttcacagacggctc

SEQ ID NO: 471599 - DNA, 746 bp, Homo sapiens
tgcatatcagaccccagctgcctgcagctctcctgaactctggtgcctccaggtccctgatgagactcttggcttctgatgggcccccactgccctgcatggtcacgagtcttgtagggagcaatccacaccccaggagccccgtctgccaggcctggactcctcaaccggaggaggagaaggaggaggaggaggaggaagaggaggaggaagaggaggaggaggaggaggaggagaaggaggaggagaaggaggaggagaaggaggatggggaggagaaggaggagggggaagaggaggagggggagaaggaggagggggaggagaaggaggagggggaggagaaggggggggaggagaaggaggagtgggaagagaaggaggaggagggggaggaggaggatggggaggaggaggagaaggaggaggaaggaagaagggtttttccaggatgtcttgcaagcccttggcctgatggggacctgcagctgaatggtgacctgaaggacaacctcgtgttagtcagagaccagcagggcaggacgctagagggaactgccaagtgcagagtatctggggcaggaggtgcgggggtggatagcggaagatgaggccatcaaacctcatggaagggatgtacttcagtcatccctttgcctgtgatgttccccttccccaccaatagaggctgagcaagcacctcagacttgagagtggaccaagcctccttgctgcaggcccccaag

SEQ ID NO: 471600 - DNA, 660 bp, Homo sapiens
gcggtgggcggcaagcgtccgtcagaaagaggaaagagcgtggatagtacctttacgtggcaatgaccggcgccagccagaatgcactggcgcagaaggcccacgccaacaacttggcgaacgtttccaccaatggttttcaacgcgacctggaacaggcgcgctcgatgccggtgttcggtgacagctttccggcgcgggcctttgccttgaccgagcgcccaggcacggatttttcccctggcgcgatgattgaaaccggccgtgacctcgatgtggccgtcagcggcgacggctggatggccgtgcaaaacccggatggcggcgagtcctacgtgcgcagcgccagcatgaacgtcgatgcgctgggcgtactgcgggccggcaacgggatgccgatcatgggcaacggcggcccgattgccgtgccgccccagcagcagatcgaagtcggccaggacggcaccatcagcatccgcgccatgggcgaaggcccgcgggtgatggctgaagtggaccggatcaagctggtgcagcccgacctcaagaacatgaccaagggcctcgacggcacatccacaccaaggatggccagccggcccaggccgatgccaccgtcaagctgacgtcgggcttcctgcaggcgagcaacgtgacgcc

SEQ ID NO: 471601 - DNA, 4299 bp, Homo sapiens
gttctccatcccaggcaaacacctctggtggccaagcccagccgagaaccataacagaaagtggactctgtgaaacatcactctggttctgccaagttgagcacagcactgagccaccacaggcagcattccaagccacaccagtgggtaaaatctctactgtgtctttgcctagagatcattaaattgccaaatgatgatattcccagatgagtgatgtggatgttcctacaagggggccatttaaaagtggaagagttggactggaatggaattagcttagtcggccgtgggctccctgaggacagggcgtgtgtcacttctcgcaaggtttcccaggcgcccttgcgcagggccctgcacgaagcgcatgcgcactacccgcgacctcgttgaccggaaatacttctgcctgggtctcaccacaaccgtcctctgtgactggagctcgactgaagagagctgcgactctgaggacgtagtcaatggaggccatgacttcccgtctcttggggagataccgccgatgtcctccagacggcagtgctggggattccagtcggcgccgggctgcaggcctcgcgctgagacccagcccgtcgtggttgggcgttacccaggtgacctgataatcacaggactcatccgccagacgtggtctcttctctgccttgccccaccgacggcttccagttttgcagctagagtcttcgaaaaaggcgagcaacttcccagaacggctgctgaagtctggggcccatccccttacccctagtgcgcccattctacgctagcgtttctcagaacttgctatttccgattattagcattgatttgactgggggaaaagcctgtgagacgcctagcgcggaggataggaaatggctttcgacaagaagcagttgctggggtactcagcctcttttacacagttctgtggagatgcagattacgtcaaaatgtacccagtgtacaactgaatattttttggtaaatgtatgagttgtacagccatcaccgcaacccacttttagaatgtttacgtcaaccaatcccaccatccccagttccctcgagcccatttgaggatcagccccaggcaagcactaatccactttatggctcttgagatttcccttttctggacgttccatgaaaactgaattgtacagtttatgatgttttcttcttacctttagcagaacacttttgaagttcatccatattgtaacgtttatgtggagtttggtctcttttagaggaagctagttttggttcagaactgctttgctgaggaaccattcacctattttctgtctatagatttgcctattctggacatttcatataaatggaatcatacaaggtgtgagcttttgtgactgcctttttttacttagcctactgttttcaaagttcatctatgctgtagcatgtattagaacgttgttcttttctattgccaaataatattctgttgtttggctatacattatttatctgttcatcagctaatggccatttgggttttttcccctttttggctatgttatgaataatgctgttaagaacattgatgtgcaagtttttgtgtgaacatgtgttttaattttacctaccagtagaattactgggtcatgtggtaactctatgtttaacgttttgaagaactgccagattgttttccaagtggcacccagatcttttataaagcacttactccagtgcctggcacagggtaagtatcccatacaagatagctattcttgtaacacattttcattgtaggaaatatgttcttgaaagccactcttctaatttagttcaatgaattggcaagccctcgtctttttcttcttaatgtcctgggaactatctgtgcagactaagaataatttgttccttaggcattggaagaacacttacagtcaaacagatttcaagtaattttgtttccctagaaaattatgcatttctttaaggttttccagtttattaatacagaattaatgtaggatagtggttgcagagtctgacctctggagttacttactggatatgcttcagtttccttatatgtaaaatagaggtgatgagaacacctatctcaggaattgtgaggatgagctgcaaatacatgtaatgcttgatgcagtatatagcacacgggaaatattcaataaatattagttttatctcatggagcctgtgggggctagattattaaaatgtaccagaaagttttaacatacaggattctttgtaagaaggcttttcttaccttttttcccccccatttggcagtcagtttgctaatttttattttccttgaaaatgttccttttcattaaaattttcatatgtactcatctaaaatcatattgaatattaacttttttaaacttttaataggtaatatatttgtgtggtttgaaattcaaaaaggagaaaattcctcctcccatctttccctctctatagataaccagtgtctcagaagatgtgtttgagtcagaaaaagaaaaaaaaaaagataaccaatgtcaatagttttgtgaatatccttccagtgttattccatgcatatagaagcaaatatgtatacagtgtgtttctctttttatttaataaatgaagtatactgtgtttactgttcaacaccttggcttttcatttaacaatgtatcttggcgattgttccataagagtttttgcatgcttttttatcattgtagatttttctattaaatgtatgtgccataatttattcatccagtctcctctttgtgaacattttacttattgttagactttgttaaatctgtatctcttagctccagatgtttttctgctttctgattcatgttttacttttatatcaattattgcctttttctccattcttcttaggtttatctcatgatgggcctttaaaatgaaccagataaaaatgattttctctacctgcacgatgatctgcattgtggaagccagagtagctctccttatcattctggtcatgttcttaggcattgacatgtgagtatgtgtggaaatcatgctgtttttcaggggacctgcttgagatgtgagtgccgatctcacctgggagaaattcttgtagtgtgctacagttgcgggttgtatgggatctccagtcgttaaatggcctacaggtcttgcagggtctgactcttctgtgcttctgtagcctttatcttatgccattctgtattctagctacacaggtttctgtactcctccagcctcataagccttgtgcacaccgttaactaggcatggaatgtctttctttattacctagtctgggtcaggctctctgatatatgtgttatagcacaatatttctttcatcacatttattgcttgttacttatgttatttatatgcttatttgattgtttggcttcatcagtgagctataagccccatgaaggcagagactgtgtctccattgtttatcactgtgtctctagtgtctgaatgtagttgatacgcattacctgtttattagatggttggataaatgaacatctaccattttgccagttcagggttagagctttctggctggtaagccaacttgagcaaaaagtggatgagtaaccctgcattttctacatgtactactttggttaccatgttatagcttgacttctgaatgttttagcttctcatgagaaatggtgtccagtgcccttttggacagggacatataagctgaactttagttctgaaccttaacactgtctgccagacttgacatattttccttttataatatctgattcatgatggaggtggtcttttgcctgtctttaatcctgtatgtaattaattgcttttgggaactgttcttttaatatttggacttagtggtactttttgtgaaagggttggttactttaatatgaatgtttggctttatactgtcctgaaactcctacttgagaaagttaaaaaataaaagttttccttaaggaaaatttgttagatttgcactactgaggaacggtgtacaaatttgtatctgaagatatttatccagcagcaccgaatatatacacatgaattcgaaatacttaagaactggtttatttatttatcttgtaaagtagtgtttattttaatctgaccatgcaacaaatcagctatgtgtggaggacttcagagccctggcagagacctctccagaatccctgctcagtgtctccacttgctttagtgtaagcattttaaatattacatgtcccacatagcttttgatgttatgctctt

SEQ ID NO: 471602 - DNA, 881 bp, Homo sapiens
gtgtagatcatgagatagggcaatcttggtgaggtcctactcatagcgtcatccgcaaggatggtgccccctggatggtgccccctggatggtatcccctggaaggtaccccctggatggtatcccctggatggtgccctctggatggtgccccctggatggtatcccttggatggtatcccctggatggtgccccctggatggtatcccctggagggtattccctggatggtgccccctggatggtgtcccggatggtgtcccctggatggtacctcctggatggtatcccctggatggtgccccctggatggtatcccctggatggtgcccccagatgaagaagaagaagaagaagaagaagaagaagaagaagaagaagaagaagaagaagaagaagaagaagaagaagaagaagaagaagaagaggaggaggaggaggaggaggaggaggaggaggaggaggaggaggaggaggaggaagaagaagaagaagaagaggagagaggaaagagagagggaagagagagagcgagagagcaagagagagatgcaaggagcagacagcctttctaaaggactcacaggagaaatagacccggaactccagactgccaaagaggtccatctgtaacgcagcctctgctgagcacctagcagcctcccctcctatctctctccccaccactcattatgtgccgctgtgttgtctgggcacctcaggcttcttcctgactttgcacctgcccacaacttcttccccagatcttcccattactgggtacttccgaccctttgggagtgagtgctaccgtgcattcgcctcctccaggaagtcttcctgacctccttttgaaagtaatatttgcgcagtatggcca

SEQ ID NO: 471603 - DNA, 593 bp, Homo sapiens
tccttgccttctgccaggaacggttcaagtgagtgactgctattagcaatgactctgattgatttttgttctggtcggcttctcatctgctggaatagaagccccatgagggcaggaatacgtgtctttacccacgtattcccagtgcctagcaagatctgcatccctgaaggtgagtctttgggagatgtatgggttgggggagtggattggcctgaggcttgcggaaaggtgattgacagtggcgaaaatgaagtgactgggagattaatcaacctatgtgacctgctccctctcctgaccgtttatctgcccttagcaacagagggaggctcagactatcaccatggaaactgcagctggagggcggaaagcctgcaggccctcgcccctacttcatttatgttcaaatacaaaggagcgttgcggaatgggagcgaggtcggggaagcggccccacttgtcctgtggacgtctccgggacccactactctactgcaggctccggtggtctagacattacttgttccctcattcactcatcgagtcagtcaacagacaccagttgtgcatcagatgctgttctaagcatg

SEQ ID NO: 471604 - DNA, 584 bp, Homo sapiens
cagcgagggggaatggcaccgagagccctcttcgcgggagtcacacaggaggcaccgattcctccagcaaggagttgcaacaacacctgtgaaatgtcatctgctgcggaactcattagagactcgatcatcataatcaaccattatctgctttcatcatttgtttcttcatttgtctatgcattaaccattgattttaccccaacagtagtagcagacacgcttctagaaaatggagatcttgcagaggtttctaaccagggaccattttgcttacaaagaggcattcggaaatactttcagtcggcacagctggaaggggtccttactgccacgcacgcgtgcagtctcatgaaaaaggggaatactgtgaccgcccctgtttccaaacggatattgggcctcttttcaagcgtacgttttcagtttacactttcagagtttgttgatttcatcatttacaagagccaaaaggtgggagcagcccaaatgtccatccatggatgaagagaaacaaaatgtggtttgtacacagcagaatgtacaagctgagcatccctcatcggaaaatctaaaatccgtaa

SEQ ID NO: 471605 - DNA, 1776 bp, Homo sapiens
cccagcaaaattgttccacataatgattcagaaaagcctaatgattcagaaacttttgttgacccagcttcgaggaaaattccacagagctcacttcctgcatagctggcactctcttgggtcatcatcactggtaggcttctgggctgtctccatggaaactgtagccagcgtttccatggagaaagagcccgcagagtctggaattttccaggctctaaaggtgactgcaaaaacatctcagcacatctccagaactgggctgcccaacatggcggccactggccacagcttcaaaaatattctcttcggttttcttgccatgactgcagaatggaggccacgagcccacttccttgccccaagccctgttccctactcacacggcgcgagcgctgccccccctactcagacggcgcgagcgctgcccccccctactcacacggcgcgagcgctgcccccctactcagatggcactctagaactggaatgtcccacagagcagccgcaaaccacagatggctgttaagcacttaatatgtggctgctgtgaattgagccttgccacacgatgagtttcaaagacttagtattaaaaaagaatgtaaaaaatattattacaatttttatattgattacatgttgaaatgataacactcaggtcctgcaagaagaccttggttactgcaggaagaatttgggctcaaataaatagaagttcagatggtagaaatctttctaactggagactcttggtctttgagaagtagtttgaatgtcaacatctcacccagttgccagataaaacctcggttcaacaacccaccatggaatttttccctgattaatgagctaaattctgtactggaatccaagcaatatatatgttgccatccaactcaggaagagactggctttctcggaaagagcacaacccacccagtgttctggagacctctatttccaaaccataaaaatattaaatactagccatctgttttgcagatcgcgtccctgatttccatcattcatcagtttcttttttcctccctctcgtttcctggggtgaacatcctgccccctcattttctgggttcccctcatgaggatctgttaagggacctggcatgaagctgctggttgtatgtgatgcataatgccagcctacttccactgaacaaaattctgttatacattcagagcaaaactaaacaaatgagaattcactaaaatttaataacagctttgttgagatagtcacatactatacaattcatcgtttaaagtacttataagtcaatggtttttagtatactcatagagttgtgaaatcatcagcacaatcaattttagaacatttagaattttagaacatttagatcatcccctaccaaaaaatcccatgccccttagtcgtaactcagcatttcctcccagtgttccccagccccaggcagcacatgaatctacttcatgtatctgtagatttttgcattttgaatcatatgatatatgacttttgggtaagattttttcacttagcttaatgtttttgagctcatctgtgctgtaacatgtatcagtacttaattcttgtttatggcagaataatatttcattgtatgggtgtgccacattttacatatgtattcataagttgatagacctttgggctgttttcacttttggctattatgactaatgctgctatgaacatttgtatagaagtttttgtttgtgtagatgtatgtttccatttctttggggtatatatct

SEQ ID NO: 471606 - DNA, 488 bp, Homo sapiens
agccaacatgacgcagttacctggccatttctccacattcctggtgagcgccccacacccagccgcagaaaagcccctcctgcattccgtcctcacacacaggcctgtccatctgcttgctactgtcacactcttgccagcagaagaggcccctctaatggccgatatcaccgcccaggctatcctcaccccacagctgtgcagcgggaccctcctgctggcccacgtggctgccagagcccatgctgacaccaacctccagcatgtcggcatccctgcgggcgacactaccggtgacatggccagcatgaccctcctccctggcagtgacactgttgatgtgagccccaatatttactcacctttttctctttcactatgtctgccgtggtctcgacgagagtgcgccacataagattcccccattaaaagtcatgaattgagtggcttttagtatacttgtggttgtgcacgttcaattttaattc

SEQ ID NO: 471607 - DNA, 1107 bp, Homo sapiens
gcacacactcctggaaaaacttgtgggccccacaagggcaggagatgagggaaatctccctgaacctgactgtgtatctccacgtgtttccagaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacacggggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtagcagcttctatcatcatcatcatcatcatcatcatcatcatcatcatttgtcaagcatctggggccatcgctggtattgtcatcgggatcctggctgtcattgctgtggcctcagaactgggctattttctctacatcagaaatgccagacggaaaacaacagaaggaccccagtcatgagacctcacaacccatcccgaaggaggagcaccccacagagcccagttccgggtgggggctggcatgatcttttgagaaaacccagtgccaggttaagtctctctgcatctcctcctctgacttctctgaggatctcaagaccctcccgggttttttcatctcttctcctcgtcttcttattctttgacatgacaattcctagctttgagccctctgggaatcagaagtgctataattgcctctgaggccaaagctatttctgagcatctcttggggt

SEQ ID NO: 471608 - DNA, 869 bp, Homo sapiens
ccagcgagttctcgcagccatggcctctggcccccgaggaagctgcggtttggggcgagccgattgcaccagcagggccgggctgctgctcccggggctgacgcgggccacgccctcctggacgcggacacacccccatttccccgggcccacagagccacgcctggccctgcagccaaacagcgggaaggcagattggtggcagcagcggcggtggcggtcccgactggcagagcctaacgagaacagggcctatccccaggggccccgggctggacgcagaccagatctcgcgggggtgggctgggaggcgcccgccagaggccggaggctgacagtgcctttcctatcctatgggtctattgtgggcccgcggagcccccatgggtgggtccatccccgggcccaccccagcctggctagccacgtggggggctcctgtgccaaggagtgcccagctgccggcttctagaggctgccttcattctgtagcttgtggtcccttccttcatccccaaaaccagaagtgtagcatctttagatcccctcacccttgtttttctggactctagtgattccattgcccaccctccaccctgcagataatctccctattttaaggtctactaattcaccttaattccattggcaatcttaaacccctttgccacataacctaagatactcacagatcccaggtttaggatgtggacatatttggtggcattattctgcctgccacatctaggtagcaactttatctactcaaacaattgttattgaacacatgccctctttcaggcactaggatatagtagtgaatgaatacagaaaagccccaatcttgtggagcttacactccagtgaag

SEQ ID NO: 471609 - DNA, 1007 bp, Homo sapiens
ttaatgccccagagcccagcctcaaagctggaaagggggctctggaccatgagtacttccatgcgacaagtctacacaggctttatttccctgggatgcatctatacaggctttgccgtgaccaacttccttcttgttttgagaggccatgggggaaatccccaaagggggcctgaggcccctggcaccaactcgcagagaagaagaagaagaagaagaagaagaagaagaagaagaagagaagaggaagaagaggaagaagaggaggaagaggaggaagaggaggaagaagaggaagaagaggaagaagaagaagaagaagaaaagaagaggaagaagaggaaaaagaaggaggaggagaagaagaggaagaagaagaagaagaagaagaagaagaagaagaagaagaagaagaagaagaagaagaagaagaagaagaagacgaggaagaagaagaagaagaagaagacttgttccacagaggagtttgggagccatctatactggcagctgctctctggggcctgtgtgggctccgggccatgccttccctccccaggcctcgacctccccattcgaaagatgagggatgggggcccaggatctgaaggcctgctgtgcaattccatgattcctaaaagttcctcaccagggaacgtggcccagactcatttccagccaaggcaggatgcccctcagagggacatccgagagcagcagacctggaatgccagccccatgtccagcacccgacctgggcccctgaagcaagtgacagccagccagccaggctcccaggggacaccccctttccagctttgctaagccgtcctccagtgcagagaaggtgtcaaggtcagcagatggcatggcctgcagaaggtttatggagacatctccggctttcccagattcctggctgcagaagtgtgttctgaatggacacccttggacatctggaaaaatgatactctctcaccaaaaatagaaggtggttggggcagaaa

SEQ ID NO: 471610 - DNA, 1498 bp, Homo sapiens
attggtggtatggagaacgttcgagtggtctggatagaagatcaaaccagtcacaacattcttttaagccaaagcctaatccagagcaaggccataactctctttaatcctgtgaaggctgagagaggtgaagaagctgcagaagaaaagttggaagctagcagaggttggttcatggggcttaaggaaagaagctgtctccataatataaaagtgcaaggtgaagcagcacatgctgatggagaagctgcgtcaagctatccagaagatctatctaagatcattgatgaaggtggctacactcaacaacagattttcagtgtagacaaaatagccacctattggaagaagatgccatctaggactttcagagcttgagaggagaagtcaatgcctgacttcaaagcttcaaaggacagactaactctcttgttaggggctaaggcagctagtgaccttaagttgaagctaatactcatttaccgttctgaaaatcctagggcccgtaagaactaagctaaatctaccctgcctatgctctgtaaatggaacaacaaagcctggatgacatgtgtttatagcatggtttactgaatatatatatatacacatatatatatttttttatagtctggaggtcttttttttttttttttttaacaagtattatgccatgagttcatacggaataggttccagcagctcaggctccttctcattggttctcacaaagtgtgcttctctgggtggagcaggctggcacttcagttgaacccaggtacctttctctttggcttctttctttttctgatcattttccttcatgtatttcaggaagctatcccagctctcagagtgcttaatgtgctcaatacgcacattaattctcttggcaagaatcttgctcttaacttgtttgtttacaacaatgccaacagcatgctgggtaacattgtagactcttccagttttaccatggtgacacttgtgaggcattcctttttgaacagtgcccattcccttgatgtctacaataacacctttcttatagattcgcatatacgtggccaaaggaacaactccatgttttctaaaaggcctagagaacgtatatcgggtgcctctcctctttccctttgtcttcgtcattttggcaaattactggaagatggcagttccggctgaaagggtggtttactgaatattttaaacccactgttgagacctactgctcagaaaagaagattcctttcaaaatattactgctcattgacaatgaacctggtcacccaagaactctgatgcagatgtacaatggattaatattgttttcatgcctgtgtaggggagtcagagatcaccttcaacactcccttgagcacttatgtgggctgttcggctggatctagaaaccaatgcacacccagaagccccagtgtgtgttgttcccctccctgtgtccatgtgttctcatagttcagctcccacttgtaagtgc

SEQ ID NO: 471611 - DNA, 877 bp, Homo sapiens
ggacacacccaggacgacacctggggatccaaggaagactgggtgagcatggaggagaagactcattggtgcagcaagatgaacttgtgcatgcagattatgagtgatgatagggtttggggtgataattgagtgtatccagcaccctacctcctcccttgtgattcaagctgaagcagccgtcattgtccctctgggacacttgtatgcactgctgctgcaccaagagagggttatggaacgagatgggcatttggcagcaactttccactgcagccagccctatgggaatctctccagttgggccacttatatgcaggcagcactggagccccagaaacacaggactcgatttaccgtgtcactctgcaaccagaagctgggacaggacagcagtggtgatgggctgggtgggggtgaggtaggggtgtctgggaacaggttccacagactccaggacccatggtggttaccagaaagcggtctggatccagaccccaagaaagggttcttggatctcccacaagaaagaattcagggctatctcttccttacatgcaaatccatgcgcacaagcagagccctgtggctgaagccccggactggaccagaggccctggtgttcaaggggtcatctgaccccttggaactgccctgtcagggaggtaaagcccatcccatcttcatctccaaacggggaaagcgaggaccagagacgtcaagctgccaggagtcaagcccaggcttctggctttgaagtccatgcacttctttctccatcacacagtttctattcgagcattttgtgctcagggatatttatttggcaatgacatggaggcagagctaggtaagagctccagagccaagacactgg

SEQ ID NO: 471612 - DNA, 1372 bp, Homo sapiens
aagtgtctggtccccacctgtcaaaatgcctatcctgaagaatctgggagtgtcagaccctaaggtgccccgggcggggaccctgcccctgaggtcctctcggaacccctttgaagaagtttcagggctggaggaagaagaggccggggagctggggtccctccccaatggaacatcttgtcgccgccgcgccaccctggagaagcttgcgggcctggcccccttccggctgggctgggccccgggccggcgggcaggcagccctggggatgggcagccccgctctttcttgggccgtgtgctggtaccagggatacgcaggagctcagcagattttggcctcctggcccggctgcatgggacccgagcccacggcgacgaggaggcagcgggggaggccgcccggagactggccttcctgagactggggcgtggatccaagccccagcgtgcgtccctggctgagagagtggtgcctgcaggcgaggcagctccagagcccccacccaaggtcccagagcccccaaagatgaaggagccattgtcagtgctggagatcctgagcctgatccagcagcgcgaactagcgcgtgcggacgagcacatcctggagctagaggccgaggagctggcgccgtcgaggggcggcgcgcctgggcctcccaaggccgagggcgctggcgggggccgccgggcgcgggacgtggcgctgctgtacgaggccctgcagcgcgagctgtgggcgctggtgcgcgagacgctggcgggccccgggccgggagcgtgcgccggggctggcgcggtggcgcagctgggccaggtgctggtacaggaggaggcggccgacgggcgtcggggtcccggggcggcccgcaaactacgcgcacgctgggccgaagccgtggcgcgcgcggcccgggagcgcctagaggcagcggctcccggggcgcccgggggcctggccgggcagctggaggcgctgcgggcgcggctgctggaggatatggccgtggtgcggggccgcctggcgcccgcctaccccgccggcctgggcgccttcggcgtctacctgcgcggctaccacggggccctggccgagtggctgggggcctccgcccgtcgcaggctgccgctggccgaccgctacgcgctgctgcactggcacaatcaggtctaccccagagaggtcctagggctggtggacatggccgccctggagaatggggagctggggccccttctctcccctggcaccctgcggggtttggaggatgaatgcgtcacagatgttaagccacagaaatcagtcaatgctacttaagagcctagaaccatagaaaagagatctggatccttaaactcatcaaattga

SEQ ID NO: 471613 - DNA, 684 bp, Homo sapiens
gtcctccttcccttaagggctgtgcataccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctgctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctcgcgacctcgggcccagcgctgagggtcacccaaccgccggccttagtgaccccatctatgctgctgacaagccaacctcccgctgaggcaagaatgtcctgagggtgcaccttcctcactttgccctctgaaaatgacattttctttttttttttttttt

SEQ ID NO: 471614 - DNA, 675 bp, Homo sapiens
tggggtctcgctatgttgcccaggctggtgctgaagacgcggttgaccttgcgtcggacgggccagtacaaggggctgctggactgcgccaggcagatcttgcagcgagagggcacccgcgccctttaccgcggctacctgcccaatatgctcggcatcatcccctatgcctgcaccgacctggctgtctatgagatgctccagtgcttctgggtgaagtcaggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagat

SEQ ID NO: 471615 - DNA, 2095 bp, Homo sapiens
ccccttagccccccggccttaggacatgcctggaggcagggccaaaattggaggcgatgctgccacgacagtgaataacagcactcctgattttggttttgggggccaaaagagacagttggaagatggagatcaaccggagagcaagaagctggcttcccagggagacttcattggcagaggaggtgaacaaattaacaaaatccaacaggattcaggctgcaaagtacagatttctccagacagcggtggcctacccgagcgcagtgtgtccttgacaggagccccagaatctgtccagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagggtgttgtggggacaccatgatctctggattgttcatgtcgtcgtgctgcgccgggagccaccgccctccggagacagggcagctcccctatgaccctagcgcctccgccctccgcggcccctctcctctcttcctgctctgtccctccttctccatcagggagcagcgtgacttcagcgagcagcctagttacctgctcctgtgtctccttcgaaagctatgaggcatgcacactgcaagcaaatatggttctaatacttttttcctcctc

SEQ ID NO: 471616 - DNA, 2336 bp, Homo sapiens
ctgagctgagagaagccccccacagctgatcttctcctgggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagggctggtgctgagcgtgtgcacagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacatgtagatgaagcgcagtcctgggctttcggtccctttcttttaatgcccatcctcattcctactctgaattgtcacacttttcccttccccaccagttctttaataaaagtatttgaaaggcaacaggtcagagttagggtggcaggaagtgcccatcagcagatgctactgcacaccagcccgggcgacagagcaagactctgtgtctaaaaataaatatataatttatatataattataaatacattatatataatttatacataattataaatacattatgtataataaaattatatactatataattatattatatactgtaatatatttcttatataattatattataatataatttatatgttatataattatattttatattataatataatttatatgttatataattatattatatattataatacaatttatatgttatataattatattatatattataatataatttatatgttatataattatattatatattataatataatttatatgttatataattatattataaattataatataatttatatagtatataattatacatattatatattaaattataatttgtatattatataattatatatattatgtattataattatatttatatattatatttatataattatatgtaatatatttattaattatataatataattatataatatataggtatataattattatatataattatatatattaattatataatataatatatattatattatataatatataattatacataactatattatatataatatataattataatataatatagatataattttatataattatattatattatatatattatatattatatattacatattatatatattatatattacatattacatattatatattatatatattatatatactatataatataaattatatattatacataatatataatataattatatataattatattatagtatattatatatattatatataattatatattattatatttaatacagttatgtataattatatattatataatataatatatattatattatataattataatatatataattatatataattatataatatacctatatagtatatattatacaattatattatataattatataaatatgatatataaatataattataatatataatatataattacataatatataaattatattttaatatataatatatgtaagtatataatatataaattatattataatatataatataattatataacatataaattatattatatatataatataattatataacatataaattatattatatataatataattatataacatataaattatattatatataatataattatataacatataaattatattataatatataatataattatatagcatataaattatattataatataaaatataattatataacatataaattatattataatataattatataagaaatatattatagtatataatataattatatagtatataattgtattatacataatgtatttataattatgtatacattatgtgtaatgtatttataattatatagaaattatatataatgtatttataattatatataaattatatataatgtatttataattatatataaattatatatttattttt

SEQ ID NO: 471617 - DNA, 699 bp, Homo sapiens
tctgggaggtgtgcccaacagctcattgagaacgggccaggatgacaatggcggttttgtggaatagaaaggggggaagcgtgggggaaaagattgagaaatcggatggttgccgtgtctgtgtagaaagagatttgattgttaagcacctgattgtagccaacttcttagctctccgctgtaaaggagtcccccagacaatggcagcttttggggttagatattttctcaatgctcttgggtgcaaacttgttttctatctccatagagtgggcaggggagtgtccattggcaccacctgcctcttgagtgtcttccaggtgatcacggtcagctccaggaaatccaggtgggcaaaacttaaagagaaagcccccaagcatgttggcttttctgttctcctgtgctggatcgtgtgcatgttggtaaacatcatctttcccatgtatgtgactggcaaatggaactacacaaacatcacagtgatgaacaagacagggtgaacttccaccccaatgataaacaataactagtaagaacaattgtaaatgaaatatgatgcaattattatgtaaatattcatattatcaaagttttattaaggcctgcagtagagtcattaaaggtctacgcaattaaaaaaattaggtcctgaatcaatctggcaatgatggggatctctttgagtgtgcaaccttc

SEQ ID NO: 471618 - DNA, 1738 bp, Homo sapiens
gagaagcgccgttaaagacagagctcatcctgttagctgtccctctcatccccgcccctgcaacctgagtttcccagattccttacgtcccgcaatggtctcacaaggaccgaatcccggggtcagctgcctgggcttttctctccaagctcgggggagaatctgcttccacgatcatttaggcggctgacaaatctccttttcttctcatgatttctacctgcctatcctcttcagagccagcagcagcctgtgaaatccccctcttccctctaagccgtgacttcctcttctgcggtgtctctaacttctttgtctgctttaagagctcacttgattaccatctagtatcccccatatgcttagctccttgcacgcttttcccctgtgcactcttaaaacctgcagcgtactctactgtctgaaaattaacctccttgtgcctttaagcctctgtgctctgtctcctgttcagtatcagttccctgcatttacaggcactctgtctcaacggcatcctttccatgagcccgcagatttaccctatgtcacaaacccgtgcaatgtcacactctctgtcacacactcatgcaatgtcagaccctctgtcacacacccaggcaatgtcgaccccaattctccagcttttctacttaatgccttgggccaaattagcaacgtgcacatcattttatacgttgcacatggtgacgtcatcatcatgagtggtgcaaagtggaaagaagtatacaggctgaatcacaatagagccatgaccgccgctattctccagataggaacctggtgtcaagatacaaatacgtgtgctgacgctgcgagtgtggtgtttaaagatttgattgttaagcacctgattgtagccaacttcttagctctccgctgtaaaggagtcccccagacaatggcagcttttggggttagatattttcttaatgctcttgggtgcaaacttgttttctatctccatagagtgggcaggggagtgtccattggcaccacctgcctcttgagtgtcttccaggtgatcacggtcagctccaggaaatccagcatttcttgtccgctggatctgatggtgatgaatgctgtcaacttttgtttgtccgggaaagacagtttcctcttcctatttgaagggtagctttgctgtataatatttttggatggcagcttttttttttctttcagcactttgaaaatgttgccccacttcctcttggtctgtacagtttttgttgaaaagtctgttgtgagataatttggagcgcccttgagtgttatttgcctcttttctcttgcaggatacttcttacataaataagaatagtgactggtctgcagaaatcttagatttaaaaacctcttgaatctaggaaaccaaatcaaggcagatttcagactttgtctgcagtacccaaaaacaatttaaatataatatcacggtcaaaaccttggtaatacaatcaatgttttaaattctatcctgttacaaagaaagcagattcttattgaacttatgcaaacaactctattgccataaaataaaaatacacatgaagagcttcaaattttaggcagatcaaatagggatcacatttccacctctgttcataaaagtatatattaccaaattgctgtaaactttaggtagcttaatagagaacgttttctgaaatctggaaaacaaatcttttaggttaaataaccaaaactgtat

SEQ ID NO: 471619 - DNA, 732 bp, Homo sapiens
ggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaattggggacttgtgcaccgtgaagatttattggatgctatgtttaagaaaatggaaaat

SEQ ID NO: 471620 - DNA, 1165 bp, Homo sapiens
gtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccccgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgttt

SEQ ID NO: 471621 - DNA, 595 bp, Homo sapiens
gagaacgtcacgggcgttccagctgggtgggagagcctggacagaaacaagaggaaaaacatgatgaacctcagtcaagaatttggacagagtacagcaagggtggttttatctgcagcctcagctgcaaagactggaatggagggtgccggaattatctggaagatctgggagcgtcttcactcatacgtccggtgtctgggctggatgactccacggttgcttagtgacgtgctggttgtgaaagtgtggtccctgaaccagcagcgtcagcatcacctgggagctcgtcagaaaggcaaattcttgagccccaccccagacctactgaatcagtcagaaactctgaaggagcgccacctggaggtaggaggtgaagtctgcagagagaagctggaaatgtactgacggatccccaaggattcagtaatgtgaccaagtggaggagctgcatttacaggcatcaagggaactgcaggaatccacccccatgattgaattatctcccactgggtccatcccacaacacatgggaattatgggagctacaactgaagatgagatttgggtggggacacagacacaagccatatat

SEQ ID NO: 471622 - DNA, 535 bp, Homo sapiens
tgcaggaccgtaaatgatactggtcaggatcaataaacgctttctcctgggacaagaggttggaactggctgcgtagagggtggagaccctagaatatgtatccactcattccctgactcattcattttctcattcattcgttcattcattcattcatttgttcatcatccctggacccgagggctcctgtccatcagggctgagctgggatctaggggacacggaagtaaatcagacccgtgcctgtccttgaacagctccggcaccagtgcggagaagaccgacccacataatgggaaaatctataccgacagaaagtacattagtgattgcctagggctggagtgggtgcttagattgggggtgatggctaaggagtacacagtatctccttggactaatgaaaatattctaaaagtgatctgaagttgatgattgcacagctctgtacaattaaaagccgttgaattgtacactttaagtgggtgaattgcatgatatgtgaattcgatctcaataaagctgtgaaaaaaa

SEQ ID NO: 471623 - DNA, 1825 bp, Homo sapiens
cttcggtacccgcagagcctcacccgcaccaggaccggtcagtgccctgcgccctgcggggcagccgcgtcccctccacccaaggcacaccgggggcctgtgggcggggctcggcacgtctgcagggcccaccgatgggctgagctacgcctgctcggactgcggcgagcacttcccggatctctttcacgtcatgagtcacaaggaggtccacatggcagagaagccatacggctgcgacgcctgcggcaagaccttcggcttcatcgagaacctcatgtggcacaagctggtccaccaggccgcccccgagcgcctgctcccgcccgcacccggcggcctgcagcccccggacggctccagcggcacggatgcggccagcgtgctggacaacgggctggcgggggaggtgggggcggccgtggcggcactggcaggggtgtctgggggtgaggacgcaggcggggcggcggttgcaggtgctggcgggggtgccagttccggccccgagcgcttcagctgtgccacgtgcggccagagtttcaagcacttcctgggcctcgtgactcacaagtacgtgcacctgagcttcgcgggcgcctacgacttgctcctacaccgccgcagccatcggcagaagcggggtttccgctgcccggtgtgcgggaagcgcttctgggaggcggccctgctgatgcgccaccagcgctgccacacggaacagcggccgtaccgatgtggcgtgtgcggccgaggcttcctgcgctcctggtacctgcggcacaccgcgtggtgcacactggcgagcgggccttcaagtgcggcgtgtgcgcaagcgcttcgcgcagtcgtccagcctggcagagcaccggcggctgcacgctgtggcccggccccagcgctgcagcgctgtggcaagaccttccgctaccgctccaacctgctggagcaccagcggctgcacctgggcgagcgcgcctaccgctgtgagcactgcggcaagggcttcttctacctgagctccgtgctgcgccaccagcgcgcccatgagccgccgcggcccgagctccgctgccccgcctgcctcaaggccttcaaggatcccggctacttccgtaagcacctggctgcccaccagggcggccggcccttccgctgctcctcctgcggcgagggcttcgccaacacctacggcctcaagaaacaccgcctggcgcacaaggccgagaacctcggggggcctggagcaggggcgggcaccttggccgggaaggatgcctgaccgaggggtttccccatcccactcccatcaaaagcccccttctggactcccacctcccaggactgatcagactcttcccccctcctcgctgttgccccatccttcagaacttcacacggactggcgaccttcaggcgacacgcccgacaggctcaagactgaatcactcccatcctcgacctctctgccctcccctcatcccatcagacactgaaccctatcctccgtccaaccctcgtttgtgacccgcatcagcccccgccccagcagcactctgcccccaggacttactgaggatttgctgtattcccagcgttagtctgagctgggcaaatggagatggacaagacagactgatggtcatgatacagctccctcttagcacttgtcctccagggtaatgattgggagattcaaaagcccgttcacagctctcatgttggctctgggaacagcaagatgtatgcctggcaatgtgtgtttagttatctcatttgttagaagaagggcctggggtcctgaagaacaaaggtgctccaggga

SEQ ID NO: 471624 - DNA, 726 bp, Homo sapiens
ctttataattgtaaccattttaaatcacacagctcaatggcactaagcaagcgtgcaggacgctggctggctccaaggtctgcacgcaggaatcagctcgccaaacacaggcgtcgtatctataaaatggggccgctatgtgacgcgttgggtgcagtgtccagtccagcaccgggcgcttgtgagacacggaggaaatgggatgggtccttctcgttaccgccccagaagagaaaggactgtggtgcaggtgaggtgggtgggaacctcagcctcgcgaggtccctattcattactccctggccggcggccatctccatggcaacgctggcgcctttccagtgcgcagctccggggctcagcctgtctctaagccggtctcggagtgggcgggtcttgtccctgggggcggtgcctgcttcgaagtgggcgggccttgtttctcgaaagaagatactttttttctcaaaccagaaagcatgtctggtttttgagtggcggttgcagagtggagaggaatatctctaagatttagctgattttattcccaaaggttgagctttttcaaacaggcaacagtggatctccattcaaaaagtctcccttgagtgctaaactcttacttgttttctcctcccagaatatgtcttcctcctttaaattttcctttctttttctttcttttttaatttatattttaaattttaattaattaatttatttttt

SEQ ID NO: 471625 - DNA, 904 bp, Homo sapiens
tctatctctgtacgaagcttcgtctctgtctccaactctgccctctactcagggcccgccctatggattagggttaagaatgaaatttgagttctcactggagaagatctggatgggcctcccagaactgctggtgaagcgggtggtggcccagttggcaggagctctggacttcctccacagccgggggctggtccacgcagatgtcaaacctgacaacgtgctggtcttcgacccggtctgcagccgtgtggccctgggagacctggccgtggactcctggggcctgggggtgcttctcttctgtgctgccactgcctgtttcccttgggacgtggcactggcccccaaccctgagttcgaggccttcgctggctgggtgaccaccaagcctcagccacctcagccaccaccaccctgggaccagtttgcgcccccagccctggccttgctccaggggcttctggacctggatcccgagactaggagccccccactggctgtcctggacttcctgggggacgactggggacccgtcaatcctaagagccaggcctggtacccatgggtctccttcctcaccaaggccagcccgcgccccgcagtcccatggcacctgccagacaggacacggagcctggcttgtggaggttcacgcctgcaggacggggatgaactagatccaaatccaagaccccagcacccagcggagggtccagaactggaaactgtgtttcctaagcaggaaggtatgcttccaggctgggaagtgagctcactacatacgacacggcatcctgggctcgatccatcgtggaagcgctgctgaaataacagtctggtgttggcccaactgtgagcctcgtagttttgacaaatgtctcacggtttgcatcgcgatgcc

SEQ ID NO: 471626 - DNA, 2088 bp, Homo sapiens
ccccacccagctgccccatcaatgccccattgacagagggagactgagtcacaatgagaagcgcgatgagcccccagcccctcctccctcagacccaggagtccagacccccagtcccctcctcccttgggcctgggacctgagcctgggcacccctctctgttctcgcagagatgcccggcaaacagtctgaggaagggccggcggaggcaggggcttcggaggacagcgaggaggagggtctgggcggcctgacattagaggagctccagcagggccaggaggctgcccgcgcgctggaggacatgatgacgctgagtgctcagaccctggtccgagccgaggtggacgagctctacgaggaagtgcgtcccctgggccagggttgctatggccgcgtccttctggtcacccatcgtcagaaaggcacacccctggcactgaagcagctcccgaaaccccgcacgtccctccgtggcttcctgtacgagttctgtgtggggctctcgctgggcgcgcactcagccatcgtgacggcctacggcattggcatcgagtcggcacactcctacagcttcctgacggagcccgtcctgcacggggacctcatggccttcatccagcccaaggtgggcctcccgcagcccgcggtgcaccgctgcgccgcccagctggcctccgccctggagtacatccacgcccgcggcctggtgtaccgggacctgaagccggagaacgtcctggtgtgcgacccggcctgccggcgcttcaagctgaccgacttcggccacacgaggcctcgcgggacgctgctgcgcctggccgggccgcccatcccctacacggcccccgagctctgcgcgcccccgccgctccccgagggcctgcccattcagcccgccctggacgcctgggcgctgggcgtcctgctcttctgcctcctcacgggctacttcccctgggaccggcccctggccgaggccgaccccttctacgaggacttcctcatctggcaggcgtcgggccagccccgggaccgccctcagccctggttcggcctggccgccgcggccgacgcgcttctgcgggggctgctggaccctcacccccgaaggaggagcgctgtgatcgccatcagggagcacctggggcgcccctggaggcagcgggagggcgaggcggaggcagtgggagcggtggaagaggaggctgggcagtgaggaggccccgggggatgcagaaagggaagccgccccacccgaggcccccaaggccaacggcttttggtgtctcctcggtgtgttttcatccatggggcttgggattcccctcggcgtcctcctcctctctcctctctgcaggctgcattcctcccttgtatgtgtgtgcatgtgtgtgcaagtgtgaacgagtgtgcacatgtgtgcacatgtaaattcgtgggtgagcatgagtgtgtacgccagtgactgtgcgtgtgtgtccatgacttgcgtgtgtgtgcacatgtgtgcaagtatgaatgtgtgtgcgtgcgtgtgagtacaagtgtgcacatatgtgcaagtgtgactgtcctgtgcatgagtgtgtgtgagtgtgtgcgtgtgtgtgcgattgagtatgcatatgcataatatgtgtgtgtgcatgtgtgcaagtgtgaatgtgtgtgcatgtatgagtgtgcacatgtgtgcacatgtaaattcgtgggtgagcatgagtgtgtacgccagtgagtgtacatgtgtaagcataagtgtgtgtgcacgtgtgtgcaagtgtgaatgtcatgtgtgagcatgagtatgtgtacgccagtctgccctgtttgcaaacactgtctcttcctctccgcgccctccttggcctcaggcccagagcaaggctacaactcggagctggatcgtgtgtcacgcactccctggcccctgcataccccgcagggcgcctgctgtggccaccgagatggaaagtacttctggtgaagatactgtgaatgttgttgaaacgacaataaatgatttagaatgttaataaacttagttaataaagtagcagccgggttggagaagattaactcaa

SEQ ID NO: 471627 - DNA, 1052 bp, Homo sapiens
cctctctcccaccccctgacaccaatctataaacaggagccatgcctgctggctttgatggtgggagtctaggtggcccgggcccttcccgccagcccagcccctgggaggggacccgagccgggcggagcctcctccggagccgcacgccgggctcggctcaccctccccggatgccgctcctcctccatccccagaagtttcagccactgagattccccttgtcccggaggctggaggggaagacccaggcggctgcgctttggaggctggaccatcgtggggcttgtctgtgcccacttttcccccattcaagagttaccactgccaggcgcagttgctcaggcctgcaaacccagcactttgggatggcaagacaggaggatcgcttgagcccaggagcttgagaacagcctggacaacatgagccagccaggcccctgggcctggagcatccacaggaggaaagtacaagaaccctggcaccctgccaagcagcagggattcttcagacacccaagggctggtttgctgggaaggactcatgtgaccagaaggggaaactgaggcactgctgagcaccaacagtcctggagagctttaagaatggttgccatctgaggccaggcatggtggtttatgcctgtaatcccagcactttgggaggccaaggcaggcaaatcacttgaggtcaggagttcgaggctgtcaggcctctgagcccaagctaagccatcatatcccctgtgacctgcatatacatccagatggcctgaagcaactgaagatccacaaaagaagtgaaaatagccagttcctccttaactgatgacatcccaccatcgtgatttgttcctgcccaaccctaactgttcaactgactttgtgacaatataccctccccgcccttgcaataatgtactttgtgatattcccccgcccttatgaatgtactttgtaggatacaccctccccacccttgagaaggtagattgtaatattctccccacccaacttgagaatgtactttgtatgatccaccccctgcctgc

SEQ ID NO: 471628 - DNA, 724 bp, Homo sapiens
gactggccctgaaacatccctgctgcagatacggggtccatgctcatttgtgacatcaatgaaacatccccctccagccccccaattcaatttgcggcttgccactttgcttgccctgtggcctagggaagccttggagccaaagcagccggaccccagccccagcttcagaggagctgccttgggggtggggctgccccggggctggcccagccccagcaagcttgttaattacttctcagggaagcttgttaattacttctcaggagaagggatggtgggttccctccccaacccacaagcatctcgggactcccaacacctacccacctgtgggcgaggacaccgctcgtttttgcccctcccaatccccgatcttggaatccacttcttgtggctccagaatccaggatgcgtcctccgagggcgcacggctttaacccgagttgccagcgcttttcgggccccgggcgatgtcggttgttcagggggctctctgggtgcctggctggcctccgttcccacctttgaagtgagctctggttggatggtgggaggagcgggggcgaggcggggtgttctgctgggccgggtctgggaggaattcgcgggaaatgcgggggcttaatgggggaaacagaggcagtatcaaatagacggcctgctgacatttttaaaaatgtttttacaatttttgtttgtttattttttttgaaaccaggcc

SEQ ID NO: 471629 - DNA, 842 bp, Homo sapiens
ctgcctgcaaactgccaccaatgtatgaggtataagaaggactggggagtgggagggcgcagagaccgagagagggcgacagagacccacagagagggggagagagacgcagagagagggggtacagagacccagcgagagggggacaggacctggggcggcgaggtttcttcaactgcaaagtgaggaaaggtaggttccccttcctagggatcgcagcagtcccacgctccgccggactcctggcaaacagcagacgcccaattcctgcgcgccgagtcgtctgagccgcactgatactaggtgggactcagggaatgacaagagggggcggggcgtcacccacagcgccctccccactcccaaccagacccaacttgggcccgcccccggagcttctgctagcctgtctggcccggcctgcacccacctgctccggtcgggtccgcgagttccgtgcgtccaggcggattccgctggacagccaggccttcccttcctccgccgggtcccggaacgcgcctgagcagtccctgtctcggaactgtaagtcccggtaccttaaacgcggcatcgcagctggactacatttcccagaaaccattgaggctcttgctcctcccggcctaagggctctgactgcgagggaatgctgggaaatggagtctgggagcaggatacggggcaggaaaaacacctacttttcttgcaagaacaagttcttacagcctctcctgcagtaaacgttctccgatttccaccgagctgagccggagctggcaattcgctctgtggggttcccacaggaacatcccagtatcttatagggttatgtgctaacc

SEQ ID NO: 471630 - DNA, 771 bp, Homo sapiens
aaaagaaagcatagagccaaatgagggtgtcaggggtccagggggatgggtgctcaaggaagacctcaccaaggagctgaaactatctactgtctggccttttacatgaagaagtttgctgacccctggtctagaacaattcttggcacacattccttgctggctttccccacacctgtgctgctccttactcagattctgcataacgaggactgtactaagagctttgtaggcactaattcacttaatccactcaatacaagcactcattaccatttactcaacaaacacttattaaacacctactgtgtgccaggcactgaggattcggcactgaacaaaataaagatctttgtcctctgctatgagaaaaagcaaagcggggttaaacgagagagagtgatgagaggaactgtcttatataggatggccaggaaaggcctcttggaagaggtgatattggagcagaacggatgatgtgggagagaggttgtcatgcaaaacctggggaagagcattcctggtggacccaacagagaatgcaaaggccttggggcagcaccaggcctcctggtttgagaaattgagccagtgtagctggagcagtatgaaggggagggcctgggggtgagatcagagagagcaaaagggccagccacatcccgcaggacctcattggccatggtgagttcttagacttttactgagtgaaatgggagccatggaaggctctgaacagaggaaaggccccatctgaatagagtagactgt

SEQ ID NO: 471631 - DNA, 2215 bp, Homo sapiens
ctcctcacctctttctggtcatcgctggaagtcccagggggctgggctgcccctgatggcagatgccttctgcagacattgatgagtgtggggagatccccgccatctgtgccaatggcatctgcataaaccagatcgggagtttccgctgcgagtgccccgcaggcttcaactacaacagcatcctgctggcttgtgaagatgtcgatgagtgtggcagcagggagagtccctgccagcagaatgctgactgcatcaacatccccggtagctaccgctgcaagtgcacccgagggtacaaactgtcgccaggcggggcttgtgtgggacggaatgagtgtcgggagatcccgaatgtctgtagccatggtgactgcatggacacagaaggcagctacatgtgtctgtgtcaccgtggattccaggcctctgcagaccagaccctgtgcatggacattgacgagtgtgaccggcagccttgtggaaatgggacctgcaagaacatcattggctcctacaactgcctctgcttccctggctttgtggtgacacacaatggggattgtgtggattttgatgagtgtactaccctggtggggcaggtgtgccgatttggccattgcctcaacacagctggttccttccactgcctctgccaggatggctttgagctcacagctgatgggaagaactgtgtggacaccaatgagtgcctcagccttgcaggaacctgcctacccggcacttgccagaacctcgagggctccttccgctgcatctgtccccctggcttccaggtgcagagtgaccactgcattgatatcgacgagtgctcagaggagcccaacctctgcctctttggcacctgtaccaacagccctgggagcttccagtgcctctgcccacctggctttgtcctctctgacaatgggcaccgttgctttgacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcgctgcctttcaggagctctgcccctttggccacggggcagtcccaggcccggatgactcccgagaagacgtgaatgagtgtgcagagaaccctggcgtctgcactaacggcgtctgtgtcaacaccgatggatccttccgctgtgagtgtccctttggctacagcctggacttcactggcatcaactgtgtggacacagacgagtgctctgtcggccacccctgtgggcaagggacatgcaccaatgtcatcggaggcttcgaatgtgcctgtgctgacggctttgagcctggcctcatgatgacctgcgaggacatcgacgaatgctccctgaacccgctgctctgtgccttccgctgccacaataccgagggctcctacctgtgcacctgtccagccggctacaccctgcgggaggatggggccatgtgtcgagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacagatgacaatgaatgccacgctcagcctgacctctgtgtcaacggccgctgtgtcaacaccgcgggcagcttccggtgcgactgtgatgagggattccagcccagccccacccttaccgagtgccacgacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgaggtgggtgcccatgccctcaggacccccagggaggcaagaaacgggggagtttgctcagggtcatgtgtctgtactgcagcaggtgctggaatgtgtgagccacactgtgtgtgtgtgtgtgtgtgtgtgtgtgtgtgtgtgtctttgtgctagcagatatgagaaccagtacgtgtgcaccatatgcatggaagaactcggggggttgagggag

SEQ ID NO: 471632 - DNA, 1069 bp, Homo sapiens
gaggcacagagagggtagacaatgatgagtgctcagcccagcctggcccatgtggtgcccacgggcactgccacaacaccccgggcagcttccgctgtgaatgccaccaaggcttcaccctggtcagctcaggccatggctgtgaaggtacagcccagctttggctgggatgtgaatgaatgtgatgggccccaccgctgccagcatggctgtcagaaccagctagggggctaccgctgcagctgcccccagggtttcacccagcactcccagtgggcccagtgtgtggatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaa

SEQ ID NO: 471633 - DNA, 2499 bp, Homo sapiens
tctctgtgtctttttcttttccaagtctcttgttccacctaacgagaaacacccacagatgttcacctcatccaaaaacatcctcacagacctgcccagaatgatgtttgaccaaacttctggggatcctgcggcccagtcgagttcacacaaaaaattcaccaacacactcggcattccggggaagctggggacgcggccagcggcacctccaggcctggccccccggcccccgccccggcccccgccctggctggctcccagcccacgctgctccactgcaggcccggccagcagcatctgttgccatggtacctgctggggtagcaaggcccccccacccacagtgggacatcaccacagcagccggggcaacggccgtgcaaggacagaggcagagactggactgaggcatctacaggccgagggccaccggccaccaccaccagctggagaaggacacagacgcagtctccctctgagcctctggaagaagccagccctgccgacacctggatggcaaagctctggcctccagaaccgggaggacacatctctgctgtgggaacacccaggccatgtgcctttgctacggcagccccaggtggcagctgctcaaggccctggggacccagctgtgaacaaaatcggcaaaatccctgccctcctggaggtggcgtcttagtggggaagacaggcaagaaacacgattgggacaaacaatggaacagatgataaggaaggatggtgggggtgtgtgatgatggggaaggatgacggtgaaggatgataggaaaggatggtgggaaaggatgatggagaaggatggtggggataggtggtgatggggaaggatgatggagaaggatgatgggaaggatgatggagaaggatggtgggaaggatgatgatggggaaggatgatgggaaggttgatgggaaggatgatgggaaggatgatgggaaggatgatgggaaggatgatggagaaggatgatgggaaggatggtggggataggtggtgatggggaaggatgatggagaaggatgatgggaaggatgatgggaaggatgatggggaaggatgatggaggatgatggagaagggtgatggggaaggatgatgggaaggatgatggagaaggatgatggagaaggatgatggggataggtggtgatggggaaggatgatggggaaggatgatggagaaggatgatgggaaggatgatggagaaggatgatgggaaggttcatgggaaggatgatgggaaggatgatgggaaggatgacgggaaggatgatggggaaggatgatggggaaggatgatggggaaggatgatgggaaggttcatgggaaggatgatgggaaggatgatgggaaggatgacgggaaggatgatggggaaggatgatggggaaggatgatgggaaggatgatgggaaggatgatgggaagggtgatggagaagggtgatgggaaggatgatggggaaggttgatgggaaggatgatgggaaggatgatggggaaggatgatgggaaggtgatggagaaggatgatgggaaaggtgatggtgaaagatgacaggatgggtgatgggaaggatgataatgagaaggataatgagaaggacaatggggaaagatgatggggaaggatgactggaaagacaatgggagagatggggaaggaggatgggaagaatgacagggaaggatgatgggaggatgactggagaggatttaacagaagagaggatggagaaggaagatgggaaggatgatggggaaggatgatggagaaggatgatggggaaggatgatgggaaggatgatggagaaggatgaagggaaggatgatggagaaggatgatggggaaagatgatgggaaggatgatgaggaaagatgatgggaaggatgatggggaaagatgatgggaaggatgatggggaaagatgatgggaaggatgatggagaaggatgggaaggatgatggagaaggatgatggggaaagatgatgggaaggatgatggggaaagatgatgggaaggatgatggagaagggtgatggggaaggatgatgggaagaattatggagaaggacgatgggaaggatgatgggaaggatgatggggaaggatgatgggaaggatgatggggaaggttgatgggaaggttgatgggaaggatgatgggaaggatgatgggaaggataatggaggatgatggagaagggtgatggagaaggacgatgggaaggatgaatggagaaggacgatgggaaggatgaatagagaaggacgatgggaaggatgaatggagaaggatgatgggaaggatgaatggagaaggatgatgtgaaggatgaatggagaaggacgacaggaaggatgaatggagaaggacgatgggaaggatgatgggaaggacaatgggaaggatgatgggaaggatgaatggagaagtatgatgggaaggatgaatggagaaggac

SEQ ID NO: 471634 - DNA, 977 bp, Homo sapiens
ggtcagctcagctcaaggtgagacgggctggaaagcggcccagaaaggatggaccaggttctgggcagccaatataggctcagggttcagaaaggggttttggaccagcaccgtgcactcctgcagggggccccggatgcgatggagctgcgcgagctgacgccctgggctgggcggcccccaggtccgcgccgtcgggcggggccccgggcggcggcgcgcgcgtgcgcgctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcacctgcgtgtgaccctacctcactcggccggcgcggggccactccccccgcctcgacggcaccactggccggccccgcgaaagactgcgcgtgcgtagagcacgccggcgcggccccgggactctcgcgataactgtactgagataaagtgtggcaactcgagctggctggtgattcatcctcggcgaggggctcgcgtgtgggccgcgtcgccgtctccaccgggaaagcggggaccagtggggggggccagctgcagggtagtgggaggatgctgtttgctttgggggaagggtagatgcaaagtgggtccagtttatggcggacaaaaaggaaaatggggtgaatggggctatgttggcagggaccgtccttcctgcctccctacggatccctctgcccgtcccgagcgtgttccggtccgcacctcttcgctgtgtgggcttctggggaggggaaagggaactagctcggatgaagagacg

SEQ ID NO: 471635 - DNA, 1453 bp, Homo sapiens
tcacaaagcatggttcgggttccctcctcctcctccggtcgccctcttagcctctttgaaggtttttcttctcaggcttcccagacccagtgcctacactctgagggccctgggctccctccagttccgtgctgggtgtctccagaacaagcggggttccatgtcttccctgaaagcctgctcctccctggggccccagatccccccactccctgcctgctactctgacccatggatcccctgggcccagccaagccacagtggctgtggcgccgctgtctggccgggctgctgtttcagctgctggtggctgtgtgtttcttctcctacctgcgtgtgtcccgagacgatgccactggatcccctaggccagggcttatggcagtggaacctgtcaccggggctcccaatgggtcccgctgccaggacagcatggcgacccctgcccaccccaccctactgatcctgctgtggacgtggccttttaacacacccgtggctctgccccgctgctcagagatggtgcccggcgcggccgactgcaacatcactgccgactccagtgtgtacccacaggcagacgcggtcatcgtgcaccactgggatatcatgtacaaccccagtgccaacctcccgccccccaccaggccgcaggggcagcgctggatctggttcagcatggagtcccccagcaactgccggcacctggaagccctggacggatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcggccagggtgcgctactaccagagcctgcaggctcatctcaaggtggacgtgtacggacgctcccacaagcccctgcccaaggggaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcactggcgggagacgctgcggcctcgctccttcagctgggcactggctttctgcaaggcctgctggaagctgcagcaggaatctaggtaccagacggtgcgcagcatagcggcttgggcggatcttggggacagggcaggggctccacgggtgacagtgccagtgcggtaatgaccacatttgagtggggtggggtgacctcaccaggaatctgtcttctgcc

SEQ ID NO: 471636 - DNA, 4084 bp, Homo sapiens
gacaagagatcctgagtacgtctacagtcagccttacggtaagcttgtgcgctcggaagaagctagggtgataatggggcaaactaaaagtaaaattaaaagtaaatatgcctcttatctcagctttattaaaattcttttaaaaagaggggaagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatggtatttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattaatggggccatcagagtctaaaccacgaggcacaagtcctcttccagcaggtcaggtgcctgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctctcacagttgaggccagatacaagtctttttcgataaaaatgctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacaccaatcctgagtggaataagccagttaccacaatacaacaattgtctcccgccacaagcggcagtgcagcagtagatttatgtactatacaagcagtctctctgcttccaggggtgcccccacaaaaaacccccacaggggtatatggccccctgcctaaggggactgtaggactaatcttgggacgatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgccttaaatcagtggccaaaaaattggcctaaacaaaaggctgttacaggacttgtcggcataggcacagcctcagaagtgtatcaaagggcggccactatagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggccgtaaacgccgtaattcaacccatggggcctctccaacccgggttgccctctccagccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagacaagttttcagactgttatattattcattatattgatgatattttatgtgctgcaaaaacgagagataaattaattgactgttatacatttctgcaagcagaggttgccaatgcaggactggcaatagcatctgataagatccaaacctctactccttttcattatttagggatgcagatagaaaatagaaaaattaagccacaaaaaatagaaataagaaaagacacattaaaaacactaaatgattttcaaaaattgctgggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtgaagtggtcattccttcctcacagtacagttaagacttttacattgtacttggatcaaatagctacattaatcggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccagcctatcaatattatatcagattctgcctatgtagtacaggctacaagggatgttgagacagctctaattaaatatcgcatggatgatcagttaaaccagctattcaatttattacaacaaactgtaagaaaaagaaatttcccattctatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaactggcaaaagatattgtacaacattgcacccaggagagcaccaggatgtttaatgcctgcagtccaaaattggttggtggaagtacctactgtcagtcccatcagtagattcacttatcacatgtcagtaaactttgttaatgattggcaaaaaaa

SEQ ID NO: 471637 - DNA, 1636 bp, Homo sapiens
aagagtttcatgtgctctttatctctatgatcacaattgaagaaggcaggaggttgagatgctgcatcgccaagatcgtggtgattccattatcattaccctttgcccttctgaaagtgacggaagagagctcgccagcaccttccatgtggggagacagggaggatatgacagtctccaacctggaagagggtcctcaccagaccccgatcatgctggcactctcatcgtggacttccggcctccagaactctgatcaacaaatcatgcgcagcatctctctcctccgagatgccgagacatgtgtgcagggagacaccatgaaaaagcagggacatcaagagttgctcagggaccaccaggagctgcacattgaggaggctgagtcgcagggctccctgtgggtccagccccaggaactcctgccccaggcgcaggtgcaggaccattcctggttccaagaccgcgatgatcatcttcctctggggaagctgtgggccctgggggagaaaagccgtgggcagacctgtctcacccacgcccacctaggtggtgtgaccttacctggggcagctccaggggcagctgtgcagggtggtggggagctggctgtaccggagctggttctgcacctgtggagagagcagagtgtgcaggtgaaagcccttgtcatgcaggatgcccttgagggttcaaggtgccaccgtgagaaagaccaaatacagaagaagccaggtacaggacacccagccacggagctgcaggaggaagctcccgacactctggacagcacagctgctcgcctcatgactgcccttctgaaagtgacggaagagagctcgccagcaccttccatgtggggagacagggaggatatgacagtctccaacctggaagagggtcctcaccagaccccgatcatgctggcactctcatcgtggacttccggcctccagaactctgatcaacaaatcatgcgcagcatctctctcctccgagatgccgagacatgtgtgcagggagacaccatgaaaaagcagggacatcaagagttgctcagggaccaccaggagctgcacattgaggaggctgagtcgcagggctccctgtgggtccagccccaggaactcctgccccaggcgcaggtgcaggaccattcctggttccaagaccgcgatgatcatcttcctctggggaagctgtgggccctgggggagaaaagccgtgggcagacctgtctcacccacgcccacctaggtggtgtgaccttacctggggcagctccaggggcagctgtgcagggtggtggggagctggctgtaccggagctggttctgcacctgtggagagagcagagtgtgcaggtgaaagcccttgtcatgcaggatgcccttgagggttcaaggtgcctccgtgagaaagaccaaatacagaagaagccaggtacaggacacccagccacggagctgcaggaggaagctcccgacactctggacagcacagctgctcgcctcatgacgtgacgggacactggcttggtagcaggggactcaggatgaaaaagagaagatgcctcacctggatgaggacccagctcctccactttctggcgttttggggcatttgatggcgtgcc

SEQ ID NO: 471638 - DNA, 1060 bp, Homo sapiens
acacaacccaagccttcgggagcagctttggggctgacaccactctctcaaaggaactaaaggattcgggagccaagaagaaatctttgcaggagacagacaaacactggcagtggctgacttggagaaccctggaaattttcaccatgaaaggttcccggcgcccaagaagccccagtgattcctgcaccgaatccaagagcgaccacgcaggagagagcggctccagctgcacgccatcaaatgccccaaaacgccagaaagtggaggagctgggtcctcatccaggtgcagaaccagctccggtacagccagctccacaccaccctgcacagctgcccctggagctgccccagcttccccagaggaagatgatcatcgcgatcttggaaccaggaatggtcctgcacctgcgcctggggcaggagttcctggggctggacccacagggagccctgcgactcagcctcctcaatgtgcagctcctggtggtccctgagcaactcttgatgtccttgaaggatctcttgtaccctgcccatgcccgctggctcctgctcactagtacagagactgtctgggagattgacattgaaaatggatctgtgagagcccagagagcagagaatgtgtgtgtggcgccttcagtaaaagagggtgaggctccccaaggcttcctgcccctgatgggacccccagcaaaccttgtgcatggagtcagcccttcttcctggcgtgtcctctacctcaaacctgactacagagcggccgtcccccagggctcatcccaaatgcccaagcctagtccctggagacaggctctgcctgaagaattccacttggatctccatggcctggagcccctgcccacctctgccctcagacctctacctccatcacccagtccggagcccagaatttgccacaagtttctatggaggccaacgtgcaaggcccgaagacgtctcttctaaggctcatgggccatgcaccctcaggcaccagacgggaatcagagacgctctattcagaatgaagcacacctgctttttcatggtgt

SEQ ID NO: 471639 - DNA, 700 bp, Homo sapiens
taagaagagaaggagtgagggaggagagaggaaaaaagaataggaggaggaagaagaggaggggaggagaagggggaggagggaaggggaagagaagaagagaagaaaaaggagatggaggagaggagaaaaaagaaaaaggcagcgagaagaaggagaagaggagaagaaggggaggaggatgaaggaagaaagaaagggaggaagaggagagaagaaaaagaggaggagaaaaggagaaggagaggaggagaaaaaggaaaggaggaagagaagagaaggttaggaggagagaaagaaaaggtgaaggagaggaggagaaaaaggataagagaaggaggaagaggaggggaggagaaggaggaggaagagggggaacaggaggagagagaaagaaggaggtggaggagaggagaaaaagggaaaggaggtggagaggaggagcggaggaagaggaggaagaaaggagaaggagaaaaggaggaagaggaggaagaaaggagaaggagaaaaggaggaaaaggaggaagaggagagcagaaggaggaagagaggaggaggagtggaggggtaggaggagaagaggaggaggaagagagaagtaggaggaggaagaggaggagagaaggaggataagagaagatggatgagaaaaggaggagaggaagagaaaaagaggaggaagaggataggaggaggc

SEQ ID NO: 471640 - DNA, 537 bp, Homo sapiens
ctcctcacatcccagacgatgggcggccagggtcatcagaaaggaaaggaaagggaaatagaagggaaccgccaagtgggtattgaagcaaaaagagctacaaggcaggaccctccattagaaatgcttatagaaggaccacctagatggctagccaccaaagaaggaaaaatactttcacctgcagctaaccaatggaaattacttaaaacccttcaccaaacctttcacttaggcattgatagcacccatcagatggccaaattattatttactggaccaggcctttccaaaactaccaagcagatagtcagggcctgtgaagtatctaccacggactcctggactggcctgctggcccatgctctgatgttaatgacatcgaaggcacccctcctgaagaaatctcaaccgcacaacccctactatgccccagttcagcaggaagcagttagagcggtcattggcccacctccccaacagcacttgggttttcctgttgagaagggggactgaaagacaggactagctggattt

SEQ ID NO: 471641 - DNA, 624 bp, Homo sapiens
ccacatcacctagtttctaggttcagcaatacatcacgataccttctgagaggaagaccaaagcaggagtgccacatcacctaggctgggcccaggcagaagagtcacattgcctaagtgttagaatgagcgatgtgtcacaatgccccttctgtgcagcaccaaggtgctgagtccatcaatatgtcacagtactcattgagtgaagggcccaagaatgaggattgcatcatttcggtgaggggcccagagctatgtacccatactccctgtagtgagcagggcccaggcatgagaggagggtcacataacatagatgatgtgccaagtgatatgccacaactcatactgtggacaggtctctgcaataaaggagagtcacataatctggctgacggtcacagagatacatcacaatgtatttatctcttgtccttacggacaggaatcaggcagaagaatcacatctcctctgggctgtgtcctgggataatttactctcccttctgtgatctgagcccagggagaaaaggagactcacattacctaggtgttggggccagaggtatgtcacaatgtcacctgttggcaaatatgaagtaagagaggggagtaacatcaaat

SEQ ID NO: 471642 - DNA, 716 bp, Homo sapiens
agcacctggccacatgctggctggatgttaactggtcctggaatagtgccaagtgcagagtcggactggtgcggtacacctgtcaaacaaattcaccaagcgttggatggttcacccaatagcagggaacctgagcttggtttagaacgtcatgagacaggtcgaccagacagttctcctcttgccatgtctgtggtccacaagaaggctctagcctggccatgtctgaaattgcccagacagttctcgctttgccatgtctacagtctaccacagggcatttgcttcggtcgaccagatggctatcgccttgctatgtctgaagtcgaacggatggttctcgccttcccacgtctaaggccgtccagatggctctggctggcggcagtatcattcagccttggtgtgacaaaccaagagagagagaaacaaggagggagagagagagaaagagagacagagtgaggagatcttaattttgacattaattacctttcaccattgttcactttcacttttttatgtattggtctttaatattgtttttattcttcgttattgttatatatttactgttggtttttaaatttattttaagatggatatcggccagaagcgttgggcttatctgctagtttgccatgtctaaggtctaccagatggctctcaccttctcatgtctaaaatcaacaaaatagctctcaccttcctatgtc

SEQ ID NO: 471643 - DNA, 771 bp, Homo sapiens
ttaggagatccaggccagcagttcacactccgttacaaaactctacagagcttccgagctagcagcagcacacattcggggaacattgaagggattgtcttcttcttttgtgggtggttatgttagtggttgtggagagagagagaagggtgaataaaaaatataaagatttggttccaagtaagaatgctgaaaatagtgagacatttctgtctgaaggaaacaaaattatttctgcaaggcaatattgccagtccatccccaaatatttgagggttttctccttttttagatatgtagtggtctctgcacctgtgcataatgattctgaagtatatttaagagaagtggaagaaaaccgtcccaccacatatgtgaaaaacctgtcttctgcaaaaccagaccctagtgccaaaaaggttggggacaactgccctacattatacagtgcctgcgtactccagtgcacagacattagaaatgctgctccgcatattacaatgcacagaacagccacagatgtcagcagagctgaagtcaaggaagcctgcttggaagttaaatgaatatgtatgtggttaaaatattctacttaaaagttttaaaccaagagtaacttaaaggatgcttaacttgtgtttctctgaatttgatgtgtatttaaattatgaaaataagttttctaagaaccattttgtgttcaaaagcttcttaaagtttcacaacttaattttcctaagtacaattctgattcagatttagccttctttt

SEQ ID NO: 471644 - DNA, 2346 bp, Homo sapiens
caggaacatatcacagtggtggaatgttccaagggtggattctgcttcttttgggaagccccctcatccacgctgagcctctgtacatcctggtgaccccccgagttctgagggttggcagtccggagagcattcacattcaggcccactcagactccagacagcccctcacaaggaccctcaaggtgaacctcacagtgtgggacttccccatgaggaagacagtgttggcaaggagccagctcattctctcaccaggaaacaactttatggaccaggcacctgtgacggttcccgagagcctgatgtacctcccaaaaccagggcagcaatatgtcatcatccgggcaacttgggcacccacctcgggctcctcattcatggagaagatggtgctggtggctcttcatgctggctacatctttatccagacggagaagaccatctacacccctgagtacttggttcactaccgggtgttcactgtgaaccacaagatggaccctgtgaccaggacattcactctggacatcaaggtggtctttcccgatgagggtttggggacctggaccatcgaagccagctaccaaagtacacccaagcagaagttcgaggctgcctttgatgtgaaggaatatgggcctgagctggatgctaagtgttgggtgctggtgttgcagcccttcgggcttgacagagccaccaaggaaggagcaggactgggaggggacgagggagcagaacagatctctgaaggcctgggccacgtctccctccagaaggacacgctcatggccgcattccaaggcccaggagaggacttcattggaggctcaatctttgtcaatgtcaccatgttctcctcagggggtgagatggtgcaagctgagacctcaggggtgaagatcatccagagcccatacaacatcaagttcaccaggacaccccagtatttcaagccaggaatgcccttccactttcggattccacctcaggtcttcatctcaaatcctgatgggtccccagcttccagagtccttgtccactcccaagaccaaaaagtgtacacctcagctgaggggttggccactctgaccatcaacacagatgcaaatctggacaagctccccatcgagccagaggagcaggcttcagccaagatgacagcttggccttacttgactcaggatgggtcaggaaacttcctacacatcgaagtaaagacattgggcacagaggttggcagcagcatccagctgagcctcaacacaaggcatcaggaccctaaaaccaaggacaagattactcacttcaccatcctgctgaaagttggcttgaagaatgatagattcttccagtctttggagcccaacagccaagtcgaactgaaggtgacaggtgatgcagaagccacagtggggctggtggctgtggacaaggctgtctatgtcttgaacagcaaacacaagctcactcagaagaaggtctggaatgtggtggaggaacatgacattggctgcacaggaggaagtgggaaagacagatttgctgtgttcaaggatgctggattggacctgaaaatcagcacaggaatggatagcctggcaagctcaggcacaggctttggggcggatgaagaagaggacttcgatgacctcttcttggatgacatgcctgtgcggaccttgttccccgagagttggctctggaggaagttcactctgccaaagagtaaatcgggcatctcccattaccccatctctgtgaaggtgccagattccatcaccacgtggcagtttgtggtggtcagcctcaaggctggacaaggtctctgtgtctcggacccctttgagctgacagttatgaaatcgttctttgtggaccttaagttgccctcctccgtgatcaggaatgagcaggtccagatccaagccatgttgtacaatttcagggatcgccaggccaaggtccgagtggagttcccccacaaggagacactgtgcagtgcgtcaaagccaggagcaccatcccaccaggtagtggtcgtgccccccacctcctccaagatagtacactttgtgcttctccctctggagacaggcaaagtggacgtggaggtcaaggctgtgggctacggggtccaggaccatgtgaagaagacactcttggtccgggtaatgggcactcccaactcactagctgctggtgcagacagcggggcttccaccaggtccaggctgggcaggtgggcccaggatcgataagcaaggctcctagatgggagtgaggtgagaaagaacagatttgaaagttcagtcagttggctgggcatggtggctcaagccc

SEQ ID NO: 471645 - DNA, 660 bp, Homo sapiens
gatggctaaatgcttttttctcactgtttttagaatttgctcttaatctttgactttaagcaatctgaatacaatgtgccatggagaagaacattttgcattgtaactacctaggggtctctgaacttctctcacgagatctgatggttttacaaagggcagttttccctgcacacactctgtctcttgcctgcctccatgtaagatgtgtctttgctcctcctttgccttctgtcatgattgttaggcttccccagccatgtggaactggaggaggaacagcaagaggaaagggcaggaggcttggaactgtgttgtgtttggctagaggtaacaagagaaaaagtttagcccagagggtccatcgggggaaattttgggacatggaccatgagaggtcctttggattcttagaaaaatctctgaatgtcccactgaggagttttgactttttcctagagcctttggagccatgggagatttaaagtaggttccctcttccataatatggaaatcatgacagtattatctgtctcatgatgttgctatgagaattcatggtgttatgttcctgatatataacaagccctcaagtcttagtttaatattagtcttaatattttaaggttgataggagtgtctttttgtgccaagccttgc

SEQ ID NO: 471646 - DNA, 1273 bp, Homo sapiens
cagagctatgctgggctatgctgggctgtcactgtgagagatggagcactcttccctgctgggctgtgagccctatgtggtgaccctggctgactctgtaatcatagtgcctcctcttagggatgcttgaggattagtaagatgaggaagagggggtgctcctgaacacgagaggagagctgcgttcttcaccgcttcctccttgccccgcaggaggtgtagctcagcgggccacaagacagagctcgtaggtcggggggatgttgccaaagcctgagagcttgggggtgatatcgatgtccacaggcggcaccagcgagtgtagagagaagttctgaagggtggaggtgaagtagagaaagagttccatgcggtccatggcctcgcccaggcagatgcgctttcctggaggcacaggggagggcagaaggaagggtcgcacctgcacaggtcatggggatgtcggggtgtctggactgaccaccccactgagcctcagctgcctcatcggcacctcagggctcatgactaaggtagcctcgaaactgagtgtcccggatgaggttgtgggggacacccatgggcacgatgtctaccagtctctgtatttcgtggatgacggcatctgtgtagggcatcttgacccggtcatccacccttgggagccggtgacaggggcttcatcagggctcgacgcagaacatgcaggtgaggggcagggcactgtgaacctggcagaagagctgattattaaatgttcggtaatgatgtgagcttattatgaaatagtcattattaattaaattacgcaaacaaaaacggaatatattatacttttaaaagaagaatctgctgctttttttcaccccccagtgatttcagggaattgggttgttaaaaatgttttcttcagagttaatagtttttattcacgggatgcttgctccaaaagaagctactcaaccattaccagaagaaactcttcatcagtgcacttggcagctgacatcttcccaacattcccatagccccaccctaatccttgtcatcactctgaaatgtgaaacacagacatttcactctctgaccacaaccactaataccccaactcccccactgcttcattgacaatggcctgaggggtatactggccaactaggtcgttggttaaggttccgaagagtgcaaacactatagaaggtcaagtctccctcctattaaaagactttttttctaacattttgaaaacttttgttacatgtttacaaggaag

SEQ ID NO: 471647 - DNA, 1696 bp, Homo sapiens
cagtgccttgccaggatcccatcacaggagagaacttggccagttgcctgcaggcacaggccgaggatgtggctgcagccgtggaggcagccaggatggcatttaagggctggagtgcgcaccccggcgtcgtccgggcccagcacctgaccaggctggccgaggtgatccagaagcaccagcggctgctgtggaccctggaatccctggtgactgggcgggctgttcgagaggttcgagacggggacgtccagctggcccagcagctgctccactaccatgcaatccaggcatccacccaggaggaggcactggcaggctgggagcccatgggctgcaccgtggtggccctcgtgcccccggcctccccggcgcccctcctcctggcccagctggcgggggagctgggccccttcccgggaatcctgaatgtcctcagtggccctgcgtccctggtgcccatcctggcctcccagcctggaatccggaaggtggccttctgcggagccccggaggaagggcgtgcccttcgacggagcctggcgggagagtgtgcggagctgggcctggcgctggggacggagtcgctgctgctgctgacggacacggcggacgtagactcggccgtggagggtgtcgtggacgccgcctggtccgaccgcggcccgggtggcctcaggctcctcatccaggagtctgtgtgggatgaagccatgagacggctgcaggagcggatggggcggcttcggagtggccgagggctggatggggccgtggacatgggggcccggggggctgccgcatgtgacctggtccagcgctttgtgcgtgaggcccagagccagggtgcacaggtgccgtggcctgtggtcgtggcctcccccttccgcacagccaaggaggcactgttggtggccaacgggacgccccgcgggggcagcgccagtgtgtggagcgagaggctggggcaggcgctggagctgggctatgggctccaggtgggcactgtctggatcaacgcccacggcctcagagacccttcggtgcccacaggcggctgcaaggagagtgggtgttcctggcacgggggcccagacgggctgtatgagtatctgcggccctcagggacccctgcccggctgtcctgcctctccaagaacctgaactatgacacctttggcctcgctgttccctcaaccctgccggctgggcctgaaatagggcccagcccagcacccccctatgggctcttcgttgggggccgtttccaggctcctggggcccgaagctccaggcccatccgggattcgtctggcaacctccatggctacgtggctgagggtggagccaaggacatccgaggtgctgtggaggccgctcaccaggctttccctggctgggcgggccagtccccaggagcccgggcagccctgctgtgggccctggcggctgcactggagcgccggaagtctaccctggcctcgaggctggagaggcagggagcggagctcaaggctgcggaggcggaggtggagctgagcgcaagacgacttcgggcgtggggggcccgggtgcaggcccaaggccacaccctgcaggtgaaggatgatggatagcgacccattcctggaccctaaaatcaatttagtgggctgttaggcggttctcacattgctgtaaagaaacacctgggggc

SEQ ID NO: 471648 - DNA, 778 bp, Homo sapiens
gggacagcccccaactcaactctcttctccttcccaccaggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcactgtcccgctgacagcctacgtggtggttgctctcctggaaacaggcacagcctcagaggccctctacctccttcctatcccttgaggtcacttcacttctcccaagaatctttttctgccttctccatagccttccaacctatttctcttctgaacctgaaggcctgccctgcagggcagcagttgtttctccctggtcttctgagttctggtctcttagatcagcagtatccaacctttttggcacaagggaccagttttgtggaagacaattgttccatggactggggaagagggggtagttt

SEQ ID NO: 471649 - DNA, 791 bp, Homo sapiens
tgggcttggcatgggcactggcagtagcagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcgcttccagtgccttctctatgcccatccatgtgctgggcattgaggaagcccaagagctgatcccaaccccacccttgagggactcctagtccaggtgagatggcagatctagagccccccaagtctaaaccttatgcagaggtcagggtagggtgacccctaagaacctgcagtgaaccctgtgagggcagtgggccaaggacaagatccaagaaaacacaaatacctgaataa

SEQ ID NO: 471650 - DNA, 1285 bp, Homo sapiens
ctgcttccatctccttgtgcatcacttgcgcagctcagatatttcatggctccctgtatacagaactctggctggagttcctaaattccgatgggcaggccctgttcggtgaggagggatggatttcggtctcacttaaagaagcagcccggccacgatcagtcacagcagctgtgctgtgttatgggggactcctcctggtccctggtgccagcaggctagagcggccaactcaaaccacagatagagtggctgccctaccccgggaacccggtccatctccggctgcctccagcctgctgccgctggccagctggaattccaagccaatgggacttgtgaggtgctgtgggagtggggcctcagaatgatgtcacttggctccctggattcagcccccttcctaggggaatgcacggatgtatcttccgctttgctggaattctcggggcagaggatgcaaaactcctgggctttcacgcatgccccagtgagccagcgagcattccgcccagactccacacagctccgtgcttcagacccaaggccatggctgagcttaccaggggacctcctgatctgcaggttgcaaagatccgtgggagaagcatggtttcccgggcagagtcgcacaatcactcaccgcctcccttggctgtgagtggggtcgcccctagctccgtgccacacctgggtgggccatcgccccacttgcttttcctcactccctgtgggtcgagctgtctggctagtcagtcccaatgcaagaacctggatacctcaactgaaggtgcagaattcactcgcagtttttactgctctccgtgagagccgcaggccacagctgcttctaataggccagcttggccccatctaaagtatgatttcttaatacatgagatgttttaaatatgtaacaatatttatcacaaataatattttgtctcaatgtgatataaaaattactaataaatcaattctgtgttggttaccacaaagctatctggaaatgtaacatctgccatttagaaaatttttgtagagttaatagaactttacctgaagggaggctggcaatatgcatcatgatttcaaatattgtattaattgttttgtaattttgtgttttttaaaactaaacttattaaattggttgtatattactttaggtagcattatttggtgatgagagaataatatgcaaaatataagagttccttattataaaaatatcctgttttatattactaccacttcctctgaaagtttaaaattttaattttct

SEQ ID NO: 471651 - DNA, 633 bp, Homo sapiens
ggtggcgggaggagggagcggcacacgcagaaagaagcggtgcagacaagaagcggcagggcctgagcaagcacatcgcagccgctgcccccggacctgcccgctcagctctacagctccgcaggcggcccacgacaaaatttcatgtgtttattgtatacagagacgccacacttcctagaatgggttttttgctcacataccgggactaaaacgctatctccctatattcagttcattactaaagtcatctattcaggctgcaaacgatgcaatcagctgctaggttatgatcctgatatcatcaggattcctttaagtaaaaagcaatttgaagcagtattgcgcttatcaatatatctgcaaatagctttctctgattacacaggacaaatagagcatgaacttcctgctaataaacttcttcatttcttatctcatatgccagtaatcttgcccacaaaaatagtttactcccccatacctaatgctttaacactatttactgatggttcctgtaaacatggaaaagtgacagtctggtggagaccacatcattcagtcactcaatctgggcttactagcactcagagagctgaaatggggccctgatactggtcttggaaacttttt

SEQ ID NO: 471652 - DNA, 644 bp, Homo sapiens
ttgtctcacatgattccagtgcagaaatgccaaaaggccccttcccatatccctcgagctctgtggcctggtctgtgcattgtggccatcacatccatctgtcccattgtgccatgtcttccctgtggtctgtatgtgacaccgtgtctacctctggtcccaccatggctggatgtcaactggcctgtgaatctgtgtccacttgttcatgtgcttactgtgagccctgggcctgtgtttcatgctctgtgtcatgggacactgtgctccgcctcccagggtgcccgtgtggcctgggatcttggccctgtagaccttgcctggttccagtccagtgccttccgccctgccctggcctaccacagctgcctctgggcctcatcctggtttcaccacattccaggggctgtagcccaaatccccaaccccactccacccccaggttctcccaccattggccctaactggccttctggacctccctttgcccagaagagggtggcacctgccactctcaggaccaccctgccaaggcagaataaaccagatcctgttgcaaaaattaattcattaaaagtatgaagcacagaagaaaatgaggtaccaggaaaagggcgcccttctaattacgtgaggcttctgct

SEQ ID NO: 471653 - DNA, 769 bp, Homo sapiens
catctacagaaatccatggtccctcctggaggaggccacacttcagagaaggtgttgtcatggttgggctatgatatggtttggctctgtgtcccccaccgaaatctcatctcgagttgcaaaagaggaatcaaaaaggatcaagttgccagctgccatctgccttttgcctttcccttccacttcccccagcctgtcaccctcctctcctggtgggctaaaagtggcacgtttaggaagatcacagctgagtgtttgggacaaggactgaggggtggggttggtgttcctgaagacaaacatcatgttctcaattattcgtgggagctaataattaaaacgattgaactcatgaaggcaaaacagaaggaagaagctcccttgtacagagacagagtgaggggggctccaagtggagagaggaaaccacaagtgcagcggaaaacagtaggttatattaggaggctggaggaggcggtgcctgattttcatatgacccaggggattggtttgaccagctgtgaggacatctaaggcccatctattttgtgctgttactgaggataaagggtctatagattgttgttgtgcctctatggcacttatagttaccttccatccttgttgcatcataatagagacactgagaagttgaaaagagcttcagtgccttcctgagaagcttcctcagttgggacacagagcagaatatcatcaacttatggcaagaccctaacttgaggatgagagaactcagagaggtcttttg

SEQ ID NO: 471654 - DNA, 1005 bp, Homo sapiens
tgacccccgcacctctgcctgtaaagggatggacagcattggatttgaggtccttaaaagtgactttgggtactgtgtcgagagtggatggactggcaggagtgagaggctcagggcaagtgaggaggcagctgaagaactcaagaggcagtcaaagggggactcgagggccacagctttgagctctgctcttggcccatttagtccagttttagaaagaaccctgctgaatccatttagcaaacatcctccactcttggtatctgatcactgtccatatctgaccaaatgccaaattgctgaccctcaacatgttgtcatcatggcctgccttcagcaagaatcctgtatatttgctgtggcaactgagggaaccaagcctcagtcatgttccccagagcttgcccatggcatttacatttgcaaaaagtaaatctcttgatttccttttggtttcagtagtgtgatttccttttcaaaaataatagcaagtgatactagtttacatataaatagaaactgtaaagttcctttgtttttactatttatcaatatatttaataattatatatatttatatagcctgaaataatgcaaacaactttaaagaattgacacatttgtttatattttacaggtaaaaagattaaaattttggcttatttgcctgaagtcacactgctagttaaatgacagagctaaaaaatgttaaataagttgctaaatgaatgtaattaatttggtttgtttgtttcctaaaatattgatttaaatgtctttatttaaattttaaaatgatagcatttgaaagagtataaataaaattcttaagccgcaatagtaaaggaatttagttacaatgcatgaagttagaagcaatagctttggatttgtaaatgtattcttgaagggtgtcataaagaaatattttattcctatttttcctttgttttgttggagtagttttcccccatctttaatgaggtataattgctttaccagttc

SEQ ID NO: 471655 - DNA, 537 bp, Homo sapiens
ttcctgtgtctccctaatgcctcttgaaggtggccctgattgtttttgcctgatttgcatagtcctcatagttaaaccattttttaaaaaaaatctatttccctcttacacaaagatgactcctacttttgctcaccaatctcctctggatgtttcttttcctttcccaccactgttcaccgattcctctctgcaaaccatccttgtccccaaatcagatccagtttcacctcctcctgttgcagcacacgcttggagggggagaaagaatgaggaggagtggggaggaagagagagaatgtgtgagtgtgtttctatcagggtgggcaaagtgcatttgacccgcaggcctgcctttgtgagtggcattgtgttagaagcagctacactcatggtttactgcattcaggaggtgcatgcgtaggtttgttacataaatacattgtgtgttactaaggtttgggcttctattgaacccatcacacaaatagcatatagtctgtggtacatatgtaccacgctgacctctgcaaagaa

SEQ ID NO: 471656 - DNA, 622 bp, Homo sapiens
cagcttcacaccacagaaggaggcacaggctttgggagagagcacaggctctgggactgcaaaatcaaatgacttttaaggaccgagtccaggcagttaagccagtcactgtgtgcagtgggcagagtggaaactggcagggctcatgccctcctccatcatgtagaggaacagctgttatttcaccccactgcacagctgctgtgtgtatttctcctaatgctattcctcccccagcccccgccccgaccctacaacaggccctggtgctacaggaatttgaagaagagaggtcagttcggaccagagactttcaggcttcctggaagaggtggggtagaactccatgtcaccccatgaaatgtgggacggctttcaggacaagttcctgccctggaaataaaaagaatgagtacgattatggggcagcctttcacacagtgactcatgatccagtttcccagactcccttgctgtgggctgtggttatgtgactgagttctatccaacggaatgagacagaagtgattgagtgcctcccacacggtgacccaaggaccacattttctgccatcctgtggctctgccatctgctagggtctcagagatttttatctggctc

SEQ ID NO: 471657 - DNA, 631 bp, Homo sapiens
agggggagacctgtccctgagctaaggcagagggaggagcagagtcctgcagcacagccatggccacttgggcctcccagtgtgtaccagggcttctgcatccctccaacatccattcaatactcattaatgcacctgtgctatgtaccaagcactgtgccagactctggggacacagcactcttttgtttcatcgtggagaagaaaatggcccccacttacttttaagatttggcgtatgcgtgaagattaaaccagataatgcatgtgaggtacttagctcaagacctggcccagagctgcttcctaatgttcccgagactgtggacttgggccttgccaaggctgacaccagaaatgactgcacatatttaggagtaaagaacacaggaacagaaaccaaataccgagcttacggggatcagcaggtgccaattcaagaagacaacacagagcagagagcatggaggtgaaccagggagtgcatgcctcgcctaaagtaccaattatccttaggagtcaccagatgtacacctggtcactcagatgcctaatgtgacacctgacacattaaagaaaaagaaaaaagagcaaggcaagcagcagtagaaaaagaaaaaaaaaggaaaat

SEQ ID NO: 471658 - DNA, 943 bp, Homo sapiens
ctaactagactttccacactcacacctgctgtccctcacactgtagccaaagtttccaggggatgggtagagcagcagtagcatggaccagtgatggcagacagcagccgagagacaggccccagacctgtccagagttctggataggacagttgatgtggtccatggttgggcttgctgatggagtccttgagcagtctgccctagtgcctgggtcagcatgtgagcagtgttggtctgtgttctcggtatttggcctagtgctagagtacactgggatgggcctggctaccgggtctgcaggattgagtctggatcctgaatctgtggcagtgggcttggtgcctgggactatagaagcaggccttaaagcctgggtctggtttggtttggtgctaggatgggcttggaggttggttctcctggggctggcctgtagcctagttccacggaagctgacctggtcccagggtccactgggcaggcctgatgtggaggcagctgacctggtcctcgggtctactgggcgggcctgatgtggaggtgaagtcagatgctcacttctttcccatttggatggcgtccatctctgtgttgtgctgttcaggctttggggagggttgacacaagtgatatgaacctatccttctcaccttcatgcatcttttcttatgtctttgcttcacccaggtgctataatctttacacttgaattccttcatttttgtgaagttattttctcattcgcatggttgtttaaatttacatttctcgagttcatgaaatcagtgaattaagcattgcagagcatatacagttatgagaacagtatgttggggaagggagctggtttgcaaaaagatttcacctgtgctttactgacacagtagccataatacaaaagcagtgctttaagtagtgttactgataggaaataaattta

SEQ ID NO: 471659 - DNA, 584 bp, Homo sapiens
caaggctcacagtggttgatggctttccagcagtccttctggagcaagccttcagacttagagatgccttcttctggaactattttcctcagctggctgtggcctgaagccatagtgcaaacacccttctcctggactcagagacttgagggggtctatcttagcttattcctgaatgaggtgaaatgggccagcaggtgggaactatactggaaaactgggccctgtgaagagtcagtgactttaagaatcagagatgaattgttgactctgctcagtgaagggttgattgtgtgttacacactgaataacagcagcagcaacagcagcaataataaacatttcctccatttttcctcaattatttctgaggtcctattaccatatgctgtggtgacactggtagagaagtggtgtagtgacacaggaaagagaaggtagtcaataaagggggtgctattaagccagatgccacagtgaactactgaagcttaaacccatgggaagctaaaaatatttaaaaatacatacttcagaatcattcctcccaaaggcatttatagcctgcaagacaatcgccttcc

SEQ ID NO: 471660 - DNA, 769 bp, Homo sapiens
aaatattaatgtggggggataccccttacattttgcacccaaggcgagtgttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccaggtgcgtgccacagagcctggggtccctgagtaatctccctggctatgatggggtccctgtgtaaatcccccccagctgccctccaaaccgggacttgtgtggggacacagacactgttcccagcactgggcctgatacaacgtggcacccaagaaacacctcttgtatgaatgatgccagcacataccctgggcatcagattctctccgtctgtatgggaagggttggtctatgggaaccccgtggacttttgcccctgggtggtcagctgggccatgagtgagctgcaggctcaactcaagaaggtt

SEQ ID NO: 471661 - DNA, 662 bp, Homo sapiens
agctcttcagggcccacaggacaaagtctgaggccctcctcatggccctgctgacccctggacctcctcttacctttccctcacactctcaccttaaccgttttctcaaagggcctttgcacagggtgttcccgctacctgaaacacactgtcattccttcaccacccatggctttgggttaacttctatatatcctccagggctagggctgacagacgggaccaggagctctcgaggtgtctggaggctcagcgccacgggcctgggacagagagctgatgacccaggagaccccctctactaccacctacaaggttcaggcttctcgtgtccccagctcaggactctgtgctgtgtatcagtcctggatgggcctggcgggtggctgcatgtgaatttcagctttgcctccttctggctgtgctatgaggccttgagcaagttcttttggcctctcaggaaatggggttttccgaggtgaagtagaaggtgaaggtcttagcacgggggccagcaaatactaatcactcagtacccatcaggtattattactacccagataaagggctggagccttcagacaaattcaagtcctggctcgaccatttgtgacctgggctagtgacatcccttcccccagcctcaggtgtctcctctgtaa

SEQ ID NO: 471662 - DNA, 947 bp, Homo sapiens
cctttgttgtaacaaccacagatgtcctcagacatcacccagtgtcctcgggggagtgtaaaatcaccctgggagcatctcgcactcgtgacaaccacagatgtcccagacattgcacatgtcactggccctcaaccctgtctctccaccctgtccaccaatcagcacctggaggtgggctgggagctgcctgtgaccgcttcagcatcttttgggagtggtgacagagccacagagggctgtgagcttgcccagccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggacgtggggaacagcagatcagtaatgatttactctattgattaagcattcccggcggccaggcagagccctggctggagatacttggcctctgggtggcctttgtcccttgacccttgctatgagctcttcttggtcccattggagagttg

SEQ ID NO: 471663 - DNA, 960 bp, Homo sapiens
gttacaggatcctcatgagtggagacaggaggaagggagcccaccctctcttcccattcctgcatgatgaaacagcttccaccagctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcaggtgagacggggaggctgcaacccaagtccagtggcctcagtgtgcgtgtgtgcgtgtgtgtatgcatgcatttgtgtgtgcatgtgtgcacgtgtgtgcgtgtgtgcatctgtgtgtgtgtgcatccatgtgtgtgtttgatgtg

SEQ ID NO: 471664 - DNA, 759 bp, Homo sapiens
tctttcttctgagatctcgcccgccgccgggcctggagggtgtgccccatggatctaattgttatcctgcctgcatcccctgcactaacccccagacctggcgttggggcttctggcactggccgggaccgacgcgttctcctctggaatgttcagagggaggtagtccaggcggtcaccgcgctcgccagacaagcaacgcagcgccccccgatggccaccgcgcgccggcgcagcccaagccggctgcgccccctagtggccgatgctcgtaaagtcttcagcgagccccgagcttttgctagccagcccttggttttgcaggctggggtcatcgtcgttgtcatcgttggcatcatcatcatcatcatcatcatcatcatcatcatcaatagctacctttgcaactggcttagggacaggtgtgtccctgaagctggactgatgagcattggctctggaactactgctgattgttgaagaaggggcttcctagacatactgtgctgaaagggcacaggcttggaacactggaacatttctttgcatcttacatcaaatttgtcagcaaattctgtcggctctagttagaaaaggtgtcccattctgtgttggaggaaaagcgatgctgtctatcaggacgttaccgggtcagttgacagaactggaatacgaacagtcgattagaaaaattcacatactaatattaaatttactgaagttgatcactatattgtggtcatgtaagagaatatccct

SEQ ID NO: 471665 - DNA, 2036 bp, Homo sapiens
ccagaccaaacaggactccaaggtccaggctggtgcagtgaccaagccctcctctctaaagtgtatggtgctctggacaccatgcccttctcgacatggctgttgcattcgttctgttttcacgatagggccccagtgacaaaggggctcttgaccaaccagccaagccatttgctactacccatgactctacatgtattcttatgtcagcccacttatttttccatacagagtaaattaccagattcaccacctgaagacactggacacaagaggtgtccttttggtgatgagcagacacaagaagatttaaccatcagctttaagtctcttcttagcgttgtgcaagccagagagttggatcgaatcccagtgtggccgtcaaaacagctggaaaagctgcaaccccagtcaaatgagaaattgggcaaatatcttgacacagaaaaactgcacgtgtaccctggtagaaattatacttttatagttatttttacatccaaacattactctttgagcgccgtcatattttatgaaaacttttattaacatttcaaaatgaccttaccctcatggtgggactgtcagtcccaggagccataacctatttaaaacatttttatctttacaaacacaataaagtaagctgtcttcaacagatttgtagatctcattagagatactttttaagaagagccaaaaggcagaagaagggtcactttacaaatgtggcctctgtcttgtgaaaaatattgctgatgaagtttcactctgctgggctgtgatggtgacgtaggggtgcacaggtggtcccagaggaggccagggcgctgggcaggcaggctctgggagtggcaagcagctgtctttctggttttctgattgtgagatgacagtcagagcacagggttttggaataccagagacgaagccaaagccattggtaactgactgctgtttcttttggtcagtgtcagaacgggggataaagcccaagagacaaacaaatctctaaaggactattaagttgcaaatatatcggagccaaaaatagaagatggagccttataaacattttgcatattttggtgtaatttgttgaaaatagtacaaaatatgctcacagttggcatctagaatgcaaatattaggaatccagtcccctgatacattatggtttttcagcagtatagtgtgggctcgtccaattgctattgtgtgactttgtagtttgttggagtgtgaataatatcagtgacttgtttgtacagtatattagggagatacatgtcgccaagtgttattagctcctctggagactccaagggacaaaaaagcacagagtggaactcagggagaaacagatacatatatttttaatgtcactgatgccagctgcttttctgagcggtttccttaaaataaaaaccaggccatggatcaaagtgtgcaaggggctttcatgttccagaacatgggggttaagtggggagagtttcaatgaggagaactgcagtgcgtgtttgagctgatggaatactctcccacctggggcttcaatgagcctgactggttttactgctgacagtaaatttgtctttcctttcccctgacaggtgagaagccatcctctcttgaatgggggctcccactgtacatctggcacccacttcacaggtggctgatgtgcatgattatatcaaggggtgctgggccacatgccctctggttgttttctgacaaaggggaaccatggcaagagcctggagggaggaagagagggactgaggtccagacaacagacacttatcactttgtagtctacccctttgtgcataaactctctctggattatcttccctgggatgcaccatctgtttggtgctgggatcctgactgagagcaggccactggggagtagaggttcctaagggacatctgaggaaggagaggacacaggacatggaatggggtgaaggagcgctttaagggccagttggcatttgagctgcccatggaaggttgataaggatttt

SEQ ID NO: 471666 - DNA, 1839 bp, Homo sapiens
attccagtcaaagcttttttcaaagaagacaaagatgacatgatgacaatgaagaagaagcagaagaggaagaagaagaaggaggaggaggaggagacaacaatgatgacgatgaagaagaagcagaagaaggagcagaagaggaagaagaagggggaggaggaggagaaggaggagaaggaggaggagaaggaggagaaggaggaggagaaggaggagaagaagacaacgatgatgacaatgaagaagcagcagaagaggaagaagaagaaggaggaggaggaggagacaacaatgatgacgatgaagaagaagcagaagaaggagcagaagaggaagaaggagggggaggaggaggagaaggaggagaaggaggaggagaaggaggagaagaagacaacgatgataacaatgaagaagcagcagaagaagaagcagaagcagcagcagaagaagaacaagagaaagaagaagaagaacaaccacaacaacaaggaagaggaggaggaggaggaaatgaaatgaaaacttatttacaaaaagacttatacaaaaatattcatagccacattattcctatagccaaaaactgaaaacagtcaaatgtcccccaactgaggagtggataaacaagttgttttatgttgacaatatgagatactatttagaagcaaaaatgaaaagaacaaaaccctaatatatgagggaataagagaatctcaaaaatgtcacattgagccagacacaaaaaagtgtgcactgtatgactcctttctacggagtgctgtaccaggcaaaggccagctgtgaggacagaaatcagatcggtggctgcctctgcaaggagtatagagatggacttaggagacggaaggaattctctagagggacagaaatggtttatatctagaagggagggtgtctacgtatgtcaaaactcatcaaattgcaccctctgttgcatatacatttattttaataaagtagattataaaaggaaagagaaaagacaacaaaatatgtgtctactttaattatgctcagttggagagagcatgtcctattgcaggctgggccctaagtgttaagagctcaatgaagcatctctttaagaccaatcatattggctcttctctcccctgagtataccccaggccaccaagtaatcaggtctacttcagttctgttacactagccccaagaaaatcagttaatgcaaacagagaacagagacaggaggaccctgcaaagacctcccaaggggcaaccacgtgggttgactgtaagaggatcccctcaatcttggtggtgatttctccatttcatttgacctgggtggagctggggtagtacctgttaccccatcacttaatctagggagctgggatatctcagtgcatccctaaaatgtatgttcataatgaaggaagggttttattctctaccccaggagatgccttagagaaacaagaagcgctacaccaccactctagcgtctggagccctgtctgggaggttaggcagacatggggcaaatcctggctccacctcctcataagctgtgtgactttgagtgtgttcctgaatctctctgtgcctcagttaactcctctccgtaatgggtatagtcaaagagtgtatccgtctcaaggttgtcattagaagtaaataaactagtagagagaaagagaaggaatcaaagaaaaagactaaggtgagaatgaaataaaggcatacgagaaaaaggtagaaacagaagaagaatgaacccaaattatacttctctgcctaaagcttgccgaagcgttctgcacagctccctgagcataatctgggctc

SEQ ID NO: 471667 - DNA, 911 bp, Homo sapiens
ctggggagtccttcggtggcaccgcattagctgaccacacccctgacaaccaggtctctgctgacatggtccccacagaacacgtccccattgaccaggtcccaaataaccaaatcccatggaccgggatctgctgactaggccacactgacatgcttccaatggatcttagtccgatgccagtctccccggaatactccacttttgccagcatgaaagccgacaccaggaccagggacaaggaagctacacagctcacctggactaagctcccacaagggttcaaaaactctcttacaatctttgaggaagcactggcctcaaacctcaaggcctataccctgccaaatgataactgtgccttgtttcagtacctggtggccacttacccccagggctttaagatctggatgaaccccattactcccatcatcaggttgtgccaccccaacatcatctggtctgtcatcaatgcctcagccaccattgcaccaaaagacgaggccttctacaagttcctgaagccctggctgggggatgggctcctggtaaatgccagtgacaagtggagctgccaccgtcagatgctgatgcccgccttccatttcaacatgctgaagccctatatgaagtttttcactgacagtgtgaatatcatgcacgtgaattctttgaacccagagttccagctgaagccttggggtggaggcaccacagacagatctggtctggaattttggctctgctgggtggcattcagcattgcttttcctctctgagctttggtttcctcagctgtaaaatgggtataataatccctacttaaaagatggtcaaggtgatgtaatggagtcatatccctggtgcatagtaggtgcccagaaagtgtctgtttctatatttcctcttgt

SEQ ID NO: 471668 - DNA, 1535 bp, Homo sapiens
tgtgggagagaacagctcttctcttgtttccatttttataatattagtatgatacagtatccatgcctagtcagaactatagcatcatatctgaatttaacctctttggcttctcagccttcccccagcacctcctgcccatcttgttcctgctgtacctcctgatgttcctgttcacattgctgggcaaccttctcatcatggccacaatctggattgaacacagactccacacacccatgtacctcttcttgtgcaccctctccgtctctgagattctgttcactgttgccatcacccctcgcatgctggctgatctgctttccacccatcattccatcacctttgtggcttgtgccaaccagatgttcttctccttcatgtttggcttcactcactccttccttctcctggtcatgggctatgatcgctatgtggccatctgccacccactgcgttacaatgtgctcatgagcccccgtgactgtgcccatcttgtggcctgtacctgggctggtggctcagtcatggggatgatggtgacaacgatagttttccacctcactttctgtgggtctaatgtgatccaccattttttctgtcatgtgctttccctcttgaagttggcctgtgaaaacaagacatcatctgtcatcatgggtgtgatgctggtgtgtgtcacagccctgataggctgtttattcctcatcatcctctcctatgtcttcattgtggctgccatcttgaggattccctctgccgaaggccggcacaagacattttctacgtgtgtatcccacctcactgtggtggtcacgcactatagttttgcctcctttatctacctcaagcccaagggcctccattctatgtacagtgacgccttgatggccaccacctatactgtcttcacccccttccttagcccaatcattttcagcctaaggaacaaggagctgaagaatgccataaataaaaacttttacagaaaattctgtcctccaagttcctgagcgccagtttggtggtgatgaaatataataatgtgtatctccatagggctgttgtaagtgttcagtgtaagaaaaagcaagaataacatgatagtcataaatgccacccagcactgagctttttctatgtattggcactgtgtccagtgttttataaatattatccttttaattagaagaaatgtacaaaggaaaataaactatttgcctcagataaactggtttcttatttaaagttcctcactgtctttgggagagatataccctaagtttgtgtgtggatattaatatgttgagttgaatgaaagatgttagaatgcaaacgttgagagagggcaagaaggagatatatatatatatacacatacatatatacacacacacatatatatatacatatatatgtatacatatatatatacatacatatgtatacatatatacatatatatatatacatacatatgtatacatatatacatatatatgtatacatatatatgtatacatatatacagagac

SEQ ID NO: 471669 - DNA, 2644 bp, Homo sapiens
ggttccctagaaagtgtggatttgaagacgtttctcagttctgttttgagtactagcaatgggattccttgctgaggcaacacctgagttgggggtgggagggcgtccgtcgtgtatggacgacacctggagatgtcctttgtgggaagttcaggaactggggccacttgctgctgtctcagggttgtcggatgtgatcagaggcttagcagccaacctgaattcagagcactcacagctgcatgcaacacttccttcaggaagaggggagcgcttcgtggtctttgaggatgtggctgtggacttcaccctggaggagtgggctttgctggattctgctcagagggacctctacagagatgtgatgctggagacctttcagaacctggcctcagtagtaaaacagtatgaatacaacacgtacggaaaagtcttcatgcatcgccgcacatccctcaagagtcccatcacagttcacactggacacaaaccatatcagtgccaggaatgtgggcaggcctacagttgattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataattctccaaatactctcagctatcctacatgaatttgaacagatttggccttgtgttctgtgattttggtgagcgttcaaggaagccaggctttggtctggattggatgttctcaggtcatgaatataattctctgggaactcccaaagttctcatctacaaagcagaagttaattggagctgaaaactaatcagtaaagccacagcagccagtcatatgggggagaagaggggaatgtttgatggtttttgtggtttagagggttcgggggatctcctccttccacaagggatggatgtgaagacaactcattctttgatgttcagatggttgtggccctctgatgagatgtgtgcacaccttgccaaatgcatatgtctgttgagcctggacattaagtatttcttgatgttcttctgtgtaacagaacaaggaactgaatctatactagactttattacagcacagtgtccattatctttactttctcccactataataccccagtcttgcccgtaaagatgagaagggaagtttgactttgatgagcaccaaagttaccaattttacaaaatctaatagccataattcttgtagttcctcaccaccctacagttcccactatttttaccctagttcctgtgtctgcagcctggtttgcatgaatggacctctgctcagctgtcttttccattcctttgcgtcctgattcacagttcctctttgcacttctgtttagaggaggacagtgggtatggcctgcacacctcaggaatattgctggtaccccatccatattttcccaagtcctt

SEQ ID NO: 471670 - DNA, 529 bp, Homo sapiens
ttttgtggttggagccctacgtcaaaaatatgatgtgtcttctccttcctggcgtgggagaagccagtcatggccaggcggaccctggaggggactgtgggcttcagatcttggactccactaagtcctggactctttttagtgggctgggcatggagcatttccaactccagtcccgagggaaaagggccatttattgacagagcagctgttgaagtccctgctggcagagttccaggtcagcacccagacatcctcgccaagaaagagccatatggaggaaggaatgacgcaggagcaggacagtcacacctacacccacgccaggtatttcacttaggaccggtgaacagcaccaaactccaacccaagtgtaaggagttcaaatccttgaaaagagaaattgggttcactgcattcatcaagatgatttggggtttatgttacgattccatcacccccaacccacagtgatgcagattttggagatgtattttgattatccattcctttgactttttagccattt

SEQ ID NO: 471671 - DNA, 724 bp, Homo sapiens
ggcactggcggttcacacttgctaactgagtaagcaacctccctcccttggggaagttgcttctttgtagccagaaaaagcccttggggtggtggaggatggaggaactgtgggctgggccctgaggacacagtccgaggcaggtcctgtgccatctgggggctgagacactggggtcaaatatgtcagagtggccggaacggaaccccatggagggcctctccatgctcttcatcagagagcagacatctccaccaccaccagacatagaaatcgtctccaacaaaagctgctcaattccctccatctcggaacagagtggcaaaggcatgagagttgctacacattcggagggacctgaggatgaaacagtgaaactggagactggcaggtgttcactgtcagtctggggaaagcagatccaagcagccatgagaaaaccccggaagcagtcagagaggaatcaaagtcctaccggtgtcatgtggccccaacagagccccggagagagccaactgagcagaggcctgtgtggctgggcaggcaggggacatgtcctggagggagcaagccttgaacttgtggtctgtagaacttgcccttctgacccaagggtggccgtagaggaatgttaaatcagcacccccagccctggaccacgcctgatggcctggaggagtctgcttaacctctccaagctgccccttggagaatataagatcac

SEQ ID NO: 471672 - DNA, 551 bp, Homo sapiens
aggcgtgcaccatcatgcctggtcaagcctacagcgcccagtattcccagacagtctcccatccaagtactaatcaggccccaaccctgcttagcttccaagatcagataagaccgggcacattcaggaaaagattcaccattctagatgccattaagaacatttgtaattcatgggaagtactcaaaatatcaacatcaacaagagtttggaagaggtttattccaggcttcatgaatgactttgaggggttcaagacttcagtggaggaagtgactgctgatgtggaaatagcaagagaactagagttggaagtggagcctgaagatgggactgaattgctgcagtcttatgaccaaacttggatggatgaggagttgcttcttatggatgagaaaagatacaatcaccactgtgatcagtcagcagccatcaacatcaaggcaggatcccccaccagcaaaaagagtatgacttgctgaaggctcaaaccatgattaacattttttaccaataaagtatttttaattaagatatgtacagtgtttttt

SEQ ID NO: 471673 - DNA, 932 bp, Homo sapiens
tttcaatgttttgaaatttattgagatttcaatttgacccaaaatatgatttttcttggtaaaccttcgaggtctaagagtgacctgcggagtcagcgcccccttcagtctctgggcttctcactgtccccctctgcactgtcccacacctggagcccgagggtggtaatgttacaggaaaacggtcctgatccagaacccaagaaagggttcttggatttcgcacaagaaagaattcaggaacggaatgatttctcgagctcggctctggctgtcttggtctccacggttatctggaggcctcagagtgagagaaagaaccgggaggccttggcggggggtggggtgctgcaggccgctgcctggacctcctctaggcctcaaatcaccatcagctgccagagggcgctgctcttcactctgccacctgctctcccctgggagctgagttttaaaactcccaagaattacctgaaagccagagagcaaagaggcattggcctccacactgcaaatgccaccctccagggcattgaacctccacactgcagatgccaccctccagggcattgagtcttcaccctgcagatgccaccctccagggcactgagcctccaccctgcaaatgccaccctccagggcattgggcccccacactgcagatgccaccctccaggacattgagtcttcaccctgcagatgccaccctccagggtactgggcctccaccctgcagatgccaccctccagggtactgaagttccagactgcaaatgccaccctccagggcattggacttccatcctgcagatgccaccctccagggcactgaacctccaccctgccaatgccccttttggggtactgaacctctactctgcagatgccaccctccagggcattgggcccccacactgcaaatgccaccctct

SEQ ID NO: 471674 - DNA, 722 bp, Homo sapiens
gaggaagtgtgtcctctgcaggccgtctggggccatgcgtccagctgccttgttgtggggcatgatgctcccccgactggaagcttgtgccccgctgtcccaggagaccacttatcctcagtttcttcacatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagggcacgagtcagctgcagtttgccagctgtggagccagcaagcttgcaggcctgtgcagtggcagagccctcggcagatccagcgtggaaagggcgcagcggcatcccgtggagctcatcaccccattccacccccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccaacggtcctgggttcgagctgcagtaaagggccggactgcacagaacccggcagggatgcagctccgtgccaaccccctgccaaaatggtaaccagtgagacacagaccctgtcactgggagctcccagggtagtgggcaggtgacaagtaaacattttcatcagc

SEQ ID NO: 471675 - DNA, 616 bp, Homo sapiens
tgaatgaatgaataaacgaaccaactcggccacttggccgggcctcctttctcctctggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggagcccctcgttgcatttaaaatgtccccctttgatttcatagctgccacgtttggggcgctccctccattggcacctgggggtggaggtgctactttgcacaccgtcagtaactagagctcagtatttgttttt

SEQ ID NO: 471676 - DNA, 518 bp, Homo sapiens
ccacactgtcatgcctgctgaatcatttttctctgctcagctgaaaactcaagacttcagtgcttctgggctacgatttcttttggactatcgagtacaagaacctgtggattttagaccagtcacctttcagatccctcagctgaaagtctgttggagtttgctggaggtccactctagaccctgtttgcctgggtatcaccagcgtaggtgcaaaacagcaaatattgcagaacagcaaatattgctgctgatccttcctctggaagctttgtctcagaggggcacctggctgtatgaggtgaaagggaaatccccaaaccccttgtacttcttgagtgaggcgatgccccgccctgctttggctggctctccaagggctgcacccactttccgagcagtcccaatgagatgaaccaaatacctctgttggaaatgcagaaatcatctgtcttctgcatcgatcatactgacagctgcagaccggagctgttcctgttatcatttatgaaaacatc

SEQ ID NO: 471677 - DNA, 1103 bp, Homo sapiens
accattttttccacatagcaacacttcagcaggataatggcgactcggattcgattcctgaggaagatcagcatgaggatgacaatcacttcaatgatgcagagtattatcactttgaacaggaaaaaaaaaatcagtctgaatattccagaagaaggcataattataataggagatgacagctccatgttttttattgtccctgaagaccttccagtgggacaagatgtggaggtggaagaaagtgatattgatgatcctgaccctgttattcctagacttgaaaattctattaagctctgtattttcctaaaggtacatctctttacttttccaatggcagattctgatctcctcaatggcgtttgtgtggaagggtcttatgagacagccggggaaataatagacaacagtaagcaggttgctgaagagatgtggaatcatttaaattcaggaaaaatgatgaggatgcaattccctgatcctgatgaggatggctgatttttgcagttaaaaaggaaaaggtataaatgaaacaattccataacatatttggaaaaaagatgtcagagaaggatattagtctgcatgagagctagaaatgagaagccaaacaaaaaacaacatcttctctaatttagaaaccattcatattatttaacattgtgatgatttagaattctcttacgtatctcaaacctagcctgcagaaccataagcaaacaaacctcttttctttataaattacccagcgtcaggtattccttttgtagcaacactaagcagagtaagacagttagaagacactaaccttactcagagctcacccgttttatattcacttgtttctgtgtgcctgtgtatgtgcgtagttctatgccattttatcagacatgtggttgtgtgatcactaccacaggacagagatggacttttaataaaacactttatgattttacagtataatttaagattaatattgcttgtgtagtcaatgcatattcagggttaaaatcttccttcctttcctaaatatgaataaaatgatgatttaaaattctctgaatattgaacacctatgacactaataattattagtgccc

SEQ ID NO: 471678 - DNA, 599 bp, Homo sapiens
cagtgggtggaggaaggaaaacttgggatagaaaatccaacaggactgctcctggatcatggctcagaggacctggagttgggtcacatactgcttcagagtccacagtcaggaccagtgtcagcaggcctgttacctgaagcagggacagatgtggttcctcgtgcgtcccttggtggatggtgctggtggcaagactaaggccaaatggggctgtagcagagtccatagggggatggagctgtttccagagaaaacaccaaaaatcgatagggaggtgacagacattgtggctaaagagggaggaaactgggaagcctgcatggagtcaccgagcaccaagaccagctcctggccctcaacaggtcctaaggaaggggtgagtaaaggaactccaaggcaccacaccccaaatacaaccctctgggatcctagagacaagagatcccattacccccacagacatttgaattggcaggaggaacttcttagagaccagacagaggcagagattgaacctgcatagaaccctgaaggtttcaaggtggcacgtggtgcagcagcaactaaacgtgacttcaggcatttatcccagaagg

SEQ ID NO: 471679 - DNA, 670 bp, Homo sapiens
aggcctgtgctattgctggcgaatggatgccactactgagcacaaccctgtctccagaaacatctactttgcttctatagcccacgcacttccattggccaggctttatatttggctgtgcagttcaacctgcaggccagtagatggcgctgacggaggtcccaggcctcctcactctctccctggcctgggagtcggggtctcagagaaacacctagccaaggccagtgtttctgcaggggtgggtcaactgtacagggggcctgcaacagctggcaccaggctgactgtgggattccaggtgggcttgagcggtgcctctgcaaagtttctgggtggctctgtgttcagctggaggcctaaggaggattatgggggctctcctgtggctaggattgtaaaagtctgtgatggagaggtgggtcccggagcctctcacctcattcaccccttccttggagtaagagcctctcttcactccacaccgtcccagctccgcaggctgcctggctccactgttccctgctttccttgggtcccattggttctctggtgaatccgagcatgctctcttaagatgatctatgtgaagtgcccattagccccccaagtccactgttcccttatttattttctgtctggattatctataaattgttgaaagtgggag

SEQ ID NO: 471680 - DNA, 924 bp, Homo sapiens
agtcttttgttctcaagggctgatgcagctccggggttgaattctttgtcactgtcctgcagccctccttgtctcatctgccctttctggtgggctatgaatgtagacagctggctttgctctccagaggaggaggcccccaaggccgacactggctccttctggtgtttgagggctgctggctctggcctgctgcattcaggggcccaggaccccacgatgacatggcagatgcaagcacagcagatgcgctgggctgctgaagctggtgccagctggcgcatcagcgatgctgaaggcccagacgtgcaatgtagacagttgaaggttcatcttttgggagtaggccctggagatagaaatggaaaaactgtaggctgtcctctcagagagctcagagctggggagaaggatatacacacaatacaagatcagagcttaaataaagatccatttgctgatagtaatgggctacatagagatttaagatttaacccaccaggacagagcctggtccctatctgagttctcggactagctagatgtctgtgctgatgctgagctcaacaagctcagaagcatccttcttggatcccacaatgcacccatttgggtaaccttgtctttaagaactgagtcatctcctccgtggttgcccttgttttctaaaatgggcagaagcttaatttggtgaggtttttcattttcaggttttatttattattttaaggctgaagagttcaaatctttcgttcatccttgaagacatgtcacaaacaggctagtgactccaaaccttcgggtgtgatggaacctctttaagatactgcctgactcacagaattgtgtgtatatttgcactttgcagggaacctgaaaaactctactggaagctatggagtaaatgtgggctggggagggaga

SEQ ID NO: 471681 - DNA, 619 bp, Homo sapiens
cctaccgtgcatgaacgaacaaacgtgccagcgctttcccgcctgctccagctccgtctccagctgccaggatggagccgggtcgggaccatccgggaaaggggacgccctcccggaccccggctcaccctcgggggcgccggctgcccgcacgcgcctctcccgccaccagcgccgccccggtatttatgagttcgcgggtgccgaggcctcttgccgcctacagccgtcccagccccggaagagccggtcgcctcggggtgacagcctccctagacagccagggccccgggtcccacaggtccggccggtcctgcctgggcgccccacacccacccgcccaccccaccagggcgtggcgcgggaagggggacccaggaaggttatgatacgtctccggcgcgccacctctgagccggccaccagaagcccggggcaacctcaaaacaaaaccagaatcccggaattgcagtgggctttctgagctgtgcgacctagggccttcttattgcctgttccctcgacctagaacattcttccccaggtgcccatgtagccccttctctccttccttcaggccttacccagatgacactttctcaggcagccctccccttga

SEQ ID NO: 471682 - DNA, 1238 bp, Homo sapiens
acatacccaagactgggaagaaaaagaggtgagccaggctccatgactgtaacttggaccacatgggtcccaacccgctctgaagtgcaattcgggttgcagccgtcggggcccctgcccctccgcgcccagggcaccttcgtcccctttgtggacgggggcattctccggcggaagctctacatacaccgagtcacgcttcgcaagctgctgccaggggttcagtatgtttatcgctgtggcagtgcgcagggctggagccgtcggttccgcttcagggccctcaagaatggggcccactggagtccccgtctggctgtgtttggagacctgggggctgacaacccgaaggccgtcccccggctgcgcagggacacccagcagggcatgtatgacgccgttctccatgtgggagactttgcctacaacctggatcaggacaacgcccgtgttggggataggttcatgcggctcattgaacccgtggctgccagcctgccgtacatgacatgccctgggaatcatgaagaacgctacaacttctctaactacaaggctcgcttcagcatgccgggggataatgagggcctgtggtacagctgggatctgggtcccgcccacatcatctccttctccaccgaggtctatttctttctccattatggccgccacttggtacagaggcagtttcgctggctggagagcgacctccagaaagccaataagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggtatttaacggcagccgagagatgccctacaccaacccgcgagggcctgtccacatcatcacaggatctgctggctgtgaggagcggctgacgccctttgctgtcttcccgaggccctggagtgccgtgcgtgtgaaggagtacgggtatacgcggctgcacatcctcaacgggacccacatccacatccagcaggtgtcggacgaccaggtcagtgaggggcaggccgaagtcacctgactgtacagccaggcccctccaagcaaatgagctgttaaaaacgtgggctc

SEQ ID NO: 471683 - DNA, 1141 bp, Homo sapiens
cggtgttgagctccaagccgagctgctgcgagatggtgacctgcatctccttggacggccgcttgttctccttgaagatggcgatcagcgtgcgtcgctgcaggtcggtgaacaccaggcgctgcttcttgggctgcagggcgcgctccttctgctgctcctgttccttgcgcttgcaggctgcgggcgagcggcgggcgggcgggcgagcgggacacagcgccaccgtgtggccggccggggagaggcaggaggcgcacgccgcccggaggatgaggaggaggggagaagggacacgttggggaaaggcgaatgcacataaggtcccagggagagcccagaagcaacaagaatgcagggagaggcggagggggagacagcggggaacacagggacgcacagagacagagacagggaaacagcaaggtcaacagggagacaacaggaaagtccaggatgcagccagagggcggtggagacagaatggaaggcgaggacaggcagggaaagcagatgcggtgggggtggggggaggacaaagaaggggacacagtgtgagtgcccctctgcaggcatggctaccaccccctccagcccccttctccatggagcccactcaggcaccccccaagcctcataccccccaaaccccgtcctaccctcaaacgctccctacctaaaggaccacagaaattgatattggtaactttctcctctcctttctgcagccccaacctgggggtgttggggaaatgacatggaaactgcacatgagagtttttggctcagtgtagacttgggtgaaataactggttaattactaggtcctgggaaaagcgtctaacatgaaaaagagagggagagagagagagggagggaggcaggaggggggagaacaatggagaaaaatggtttggtgggggaggaataaactcagaaggaaccgacaaggcaggcaaagctataattaatattcccagaggagtaagagaaaaatatcgtatccatgaaacaagtacaggatgctgttaagtaaaagggaccattagagagtgaggaaatgctcttaaaatgtgaatatataacagccagagtaaaataattccatgtaaggactggaagataaagttaagcagatatt

SEQ ID NO: 471684 - DNA, 1922 bp, Homo sapiens
gcctccacggagatggtaacaccagtcacatggatggataatcctatagaagtatatgttaatgatagtgaatgggtacctggccccacacatgatcgctgccctgccaaacctgaggaagaagggatgatgataaatatttccattgggtatcgttatcctcctatttgcctagggagagcaccaggatgtttaatggctgcagtccaaaattggttggtggaagtacctactgtcagtcccatcagtagattcacttatcacatggtaagcgggatgtcactcaggccacgggtaaattatttacaagactttccttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagactttctacccttgggaatggggagaaaaaggaatctctaccccaagaccaaaaatagtaagtcctgtttctggtcctgaacatccagaattatggaggcttactgtggcctcacaccacattagaatttggtctggaaatcaaactttagaaacaagagatcgtaagccattttatactgtcgacctaaattccagtctaacagttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccgtccatattttgactgaagtattaaaaggtgttttaaatagatccaaaagattcatttttactttaattgcagtgattatgggattaattgcagtcacagctacggctgctgtagcaggagttgcattgcattcttctgttcagtcagtaaactttgttaatgattggcaaaataattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacaattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaacgtgtgctgtgtcaactcagagttaaatggattaa

SEQ ID NO: 471685 - DNA, 586 bp, Homo sapiens
ccgagggtgagaggtgccccctgacacccccatgcccccaccccatggcggcccagcctccagatggagccacgagggagggacagcccgagagtccaagtggaaatgcgtttcccgctgtcccgaagcctgggcctggtcttctggtccatcctccctcccagccagcagtgtatccactcgaaggcctcagagagcccagtggagcccgcgcctcccctccagtacccacccaaaggcgtcctctctccccctttcctggactcagagcggagctggcctcctcattggggaacagagtcccaggcagccgccgcttcacgctgtcctgtgactctgcatcccacacagggatgtcacaccaagatccgttgcctcatccaccgcccgtccaaggccccacaagctgatgccggttttcccgcccagaactggaacagctttcctaacgcccgcacgcggccaacgtcaggcgcgcgcagaggcacccacgggcccgccttcaggggcgaggcggatgctgcatcctgaagccctccctgttacaagcccagcccctccaaaggcctctggatgaaggggagga

SEQ ID NO: 471686 - DNA, 604 bp, Homo sapiens
cgtaggaatggttcaacgacagccctacgagagtgtgcgcgagcgtgctgtctgcacctgcgaccaccccgaccccgtgcccagccccctgaccctctcctgctgttctcactgcggggaaacgggtccaaccccaccactgaccccagctcatctcaggcctcccgtccacagccacttcctcaggagccctcctggacccgccagcccgggtctgaccccggtgcgccgtgagaacatcaaacatcggccagggctgcacacgggaggccctcgggggtgcagcgtggaagccccctggacagatggagaagctgaggccctgtcaacaggtcccccgcgtcctccccggccctgtgttgatgggcggcagctgtgtccaggcacgctgtccccgttggacatggccggacgcatggatttccgaagccatctctccatctggcagctttattaacccaattccagggatcgagtgattgacgtgtttgcttatcggctcctcctgtctctccagggacgggtgcccaggtgcccccaccccacctccatcggcccagggggagaggggacaccagatcccccccacagccccgagaccaac

SEQ ID NO: 471687 - DNA, 1151 bp, Homo sapiens
ctgcaagctccattcatgggcacttctgtttgtggagtaaagcctgccacattgtcaaaatatgtaactggaggattacagtatgcttacctctgattttatttctacagtgctgctataagtaacaatgagtaaatctactaaattatgtggtaagacttcttgtccaagaagcaatatattctgcaatctccttgacaaaattgttaaaagaccctccctacagtttttgggtcagtggggatatcactgttacgaaccaaggatttacagatcactggcaaaaattctgaggtatgtggacttggatggttttgacgcactactcacagattacattgcatttgtggaaaaatcaggataccgttttgaagtaagttttaacctcgacttcactgaaatatgtgtgaatacaattctgtactgggtttttgccagaaaaggtaatcctgactttgtggaattgcttctcaagaagacaaaagactatgttcaagacagaagttgtaacctggcactgatatggagaactttcacaccagtatactgtccaagcccattaagtggcatcacacctctcttttatgtagctcagacaagacagtctaatatcttcaaaatactactgcaatatggaatcttagaaagagaaaaaaaccctatcaacattgtcttaacaatagtactctacccttcgagagtaagagtaatggttgatcgtgaattggctgacatccatgaagatgccaaaacatgtttggtactatgttccagagtgctttctgtcatttcagtcaaggaaataaagacacagctgagtttaggaagacatccaattatttcaaattggtttgattacattccttcaacaagatacaaagatccatgtgaactattacatctttgcagactaaccatcaggaatcaactattaaccaacaatatgctcccagatggaatattttcacttctaattcctgctcgtctacaaaactatctgaatttagaaatctaacatacgtcagtgtcctaagttccttaacaatgcttaccaatgtatggcttagaagttaataaaaattcacttcatgtaagtttttattgcattaaacattcatttagaaaatatattttcacacaacatcttaatt

SEQ ID NO: 471688 - DNA, 1660 bp, Homo sapiens
gatcccgcggccccgcgcatgcgcccccgcgcggcccggagggggctcggccggcgcccagctgtcatcgatcgccgcggccccaggcactgaataagctcaggaagggcttccgggaagggcccggtgctcccgccccgccccatctctccgtaatagtaatggcagcaatagcgtcggcagcatcgcctcccgcctgcgggaccgcgccgcggagcctcccccagcacccaggccagggcttcatcggggtccgctgtatcctggaggtggccgcaggggccccacagtcgggattccaatcccttgggggctgtgctgaaaggccagagggagctgtgggaggcaagatctaccagtggggcctcagatttccaggcagttggaggaaggttctggctttgtgtctcttgggctcctccaaccccagcccctgctaccaatacctccgtggtcaggcctgcagcccgggcctgcaggcgggatgggaacctcttgcccaggccctggggctgcagcctcgcgtgggtggggggcagatgcagggccgcgccccgctgcggcggcggcaccgatcagcagagagcgatcgatggcttattgagcacttttcaagcttcggtgatttttgtggattcagtgtaaaccgcagcctgggcccccgctcccatcgacctggggcagaggagccccctccccacgatcggcgctgacagctcccgccgcgggctctgcgccccggcaccccgcagcacggagccgcctcctctcctcccgggcccccgcggagagcaggggggcggggccccagacctgggggaggcagggaggaggggaagccgccatgttaccacgaaagaaggagacggaggctctgaaatcccccttcataattaataaatgaagaatatggttgttaatcgatggagctgtgaagagaatattgattccaacctcgcactattttttttttttgtgccgcttagatttttacacctcatttagaacaaggcttccccagggaactcttaaaaccaaaagatatttgcgagattctagtggggcggggggcgacgtcggggttgggctgcaaaaagagggggactagggagggagaagcagcgtgggggggacaaagcgaagaaatattatttatcatccaaattgccaaagcaccgtgcctttccttgaagcacccatttgaatatttgattaaggatcaattatcatgggtgttgggaaaggttgtcgggcaaattcgagagaggccacaggggaagtgaaggaggtagaaaaataaatctagttattattttttattacacaaacaatgcgtgtcttgggtggtaaaactgtagtaaaatggagaccatcaaccaccacaacaaaaaattatcaatctcactgttccagagagaaagctttggaagtgtcttgcctgtaaacatgcacatacgtgcaaaataattgtacataaatattaaagacgtttacagaaatggctttgcatattatctgtgacctgccgtacatggttggccgttctttctttctgactgaaaaactaattagaaaatattaaaaagtaaaatgaagaaaatgtcatcattgataattaatttcagttctttttttattttttatttatttattttttttt

SEQ ID NO: 471689 - DNA, 570 bp, Homo sapiens
gccgcccgggcttgaggccccagatggatgctctgtttccagaacaaagaggtgtcaagacccactgtgtgctgggggtcccacccccggccctggaacctggggcaggaaggatactccatgcacacctttcagggggtcagaggctgagacggtgcctggggcagacccgtgggttggggtgggggtgcccagatcttgacccccatccgtattcccaaggggcagagatgggacgtgactcctcctggcccccgccgccggcccgcaggtgttggggtctctgggctgggtctcccggcgttgtggctgctgccgagggagatgaggccaccctgatccccgcctgctccagccgcagcaaccaaggacgatcgatagccgaggcggccgctggggcttctctcctcttgctgtggggtgggggctgggtgcggggcagccagaactggggccagagtgtgctctccgcggtgtggccgagttgattactctaattaattttgcatcgacctacatggatctgctgggagagggctgatcggcatgggagacagatgctgccaaccc

SEQ ID NO: 471690 - DNA, 1332 bp, Homo sapiens
agattgagaccttcatttcagaaaacccaacagggtgagtccaatagtccccagtgtgtgatgttcccctccctgtgtccatgtgttctcattgttcgactcccacttataagtgagaacatgtggtgtttggttttctgttccattctcagcaaactaacacaaggacttctgttttatagcaccacttactcactgtctagacagcatctggaacattcacatcacaagatgaaatcatggaacaatacaataattttagaatttcttctcctgggaatttcagaggaaccagaattgcaggccttcctctttgggctgttcctgtccatgtacctggtcactgtgctcgggaacctgctcatcatcctggccacaatctcagactcccacctccacacccccatgtacttcttcctctccaacctgtccttcgtagacatctgttttgtctctaccactgtcccgaagatgctggtgaacatccagacacacaacaaagtcatcacctatgcaggctgcatcacccagatgtgctttttcttactctttgtaggattggataacttccttctgaccgtgatggcctatgaccggtttgtggccatctgtcaccctctgcactacatggtcattatgaaccctcaactctgtggactgctggttctggcatcctggatcatgagtgttctgaattccatgttacaaagcttaatggtgttgccactgcccttttgtacacacatggaaatccctcattttttctgtgaaattaatcaggtggtccaccttgcctgttctgacacctttcttaatgacatagtgatgtattttgcagtagcgctgctgggcggtggtcccctcactgggatcctgtactcttactctaagatagtttcctccatacgtgcaatctcatcagctcaggggaagtataaggcattttccacctgtgcatctcacctctcagttgtctccttattttatggtacatgcttaggggtgtaccttagttctgctgccacccacaattcacacacaggtgctgcagcctcagtgatgtacactgtggtcacccccatgctgaaccccttcatctacagtctgaggaataaacacataaagggtgctatgaaaacattcttcagaggaaagcaatagaaaggctatttttcaagaaaggcctgtgacttcagagctctaagccccagagccagaaatggtgatttgttaataagatggtggaaggaagacttgccccttccatttatttcctggagtttaaacttctttgttcctcaactactttatagagcttacactgttcttctt

SEQ ID NO: 471691 - DNA, 1124 bp, Homo sapiens
ggaaatttgaggttttggaaaatatattattgaggggatggaccatggggatccggagctgcagcccatcctcttcatgctgttcctgtccatgtacctggccacaatgctggggaacctgctcatcatcctggccgtcaactctgactcccacctccacacccccatgtacttcctcctctctatcctgtccttggtcgacatctgtttcacctccaccacgatgcccaagatgctggtgaacatccaggcacaggctcaatccatcaattacacaggctgcctcacccaaatctgctttgtcctggtttttgttggattggaaaatggaattctggtcatgatggcctatgatcgatttgtggccatctgtcacccactgaggtacaatgtcatcatgaaccccaaactctgtgggctgctgcttctgctgtccttcatcgttagtgtcctggatgctctgctgcacacgttgatggtgctacagctgaccttctgcatagacctggaaattccccactttttctgtgaactagctcatattctcaagctcgcctgttctgatgtcctcatcaataacatcctggtgtatttggtgaccagcctgttaggtgttgttcctctctctgggatcattttctcttacacacgaattgtctcctctgtcatgaaaattccatcagctggtggaaagtataaagctttttccatctgcgggtcacatttaatcgttgtttccttgttttatggaacagggtttggggtgtaccttagttctggggctacccactcctccaggaagggtgcaatagcatcagtgatgtataccattacttatattacctagcataatgttaatcctatgtaaatagttgtattacttaatattgtatttttgtaatattcttatttaatatttttaaaattttctttaatatttttaatatttttgatccacagttggttgagtccatgaatgtggtactggcagatatggaaggctgactgtacttggtatatatattgttaaaattgtcagaatcaaaatggagtcacttattaaaaaaaaaaaaggctgggtgtagcggctatcaaaaaagtctgcactttgataggctgaagtg

SEQ ID NO: 471692 - DNA, 1868 bp, Homo sapiens
gcattatctcacagagtcgttatcctggactctcagatgatcctgaactgcagcccgtcctctttgggctgttcctgtccatgtacctggtcatggtgctggggaacctactcatcatcctggccgtcagctctgactcccacctccacagccccatgtaattcttcctctccaacttgtcctttgtggacacctgtttcatctgcaccacagtccccaagatgctagtgaacatccaggcacggagcaaagacatctcctacatggggtgcctcactcaggtgtatttttaaatgatgtttgctggaatggatactttcctactggctgtgatagcctatgaccggtttgtggccatctgccacccactgcagtacatggtcatcataaacccccatctctgtggcctcctggttctggcatcttggttcatcattttctggttctccctggttcatattctactgatgaagaggctgaccttctccacaggcactgagattccgcatttcttctgtgaactggctcaggtcctcaaggtggcccgctctgatgctctcctcattaacattgtcttgtatgtggccatggcactgctgggtgtgtttcctgtagctgggatcctcttctcctactctcagattgtctcctccttaatgagaatgtcctccaccgagggcaagtacaaagccttttccacctgtggatctcacctctgtgtggtctccttgttctatggaacaggacttggggtctatctcagttctgctgtgacccattcttcccagagcagctccatggcctcagtgatgtacgccatggtcacccccatgctgaaccccttcatctacagcctgaggaacaaggatgtgaagggggccctggggagactccttagcagggcagcctcttgtctcttacggtacacaacctcagaactaagaggatgctatgggtcccttaagcaaatgtgaatgcgcatatcctagatcttgctctcccctaaaatatatgttgcagtttcctattttcaaagcacctacgactttgcttaaaatgtttttgtatggccgggcacgccccagtccctgtgcaggagcctggtttctggaaaaggccccacagcctggtggacacagacccaattccagtatcagacccatcagtgaccactgtgttgggattcaacagcctctccagactgtgattctcactggcaaaataaaaaatctgtctgtctttatttgatcaggagtactaaggctccaatgagacagtgtatttgaaaaaccttgggaatccactctccaaagcctagcaggttttgttactattatccaactcaatgtacaattctaaggtaaattgaaaaaatgtataaatccattaaaaagaaaagttgaaggtctcacatttcctggtttccaaataaactacaaagatccaggaattaaaacagtgtggtactataatacataaagacacatatacagaaaaatggaagagtaaagagagcccagaaagaaactctcacttatatggtcacatgattttccacatgggtgccaagaacattcattgggaaaaagacagccttttcaacaaacggtgtaggaaaaacttgatttcaaaatgcagaagaatgaaggtgggttcttaccttacaccatatgcaaaagttaacacaaaatggatcaaaggcctaaacctaaattccaaacctataaaattcttaaagaaaacattgatcaataccttcatgacattggatttggtaatgatttgatcaataccttcatgacactggatttcttagtgatttcttgaatatgtcaccaaaagcacagacaacaatatatagataactt

SEQ ID NO: 471693 - DNA, 535 bp, Homo sapiens
tgtacgcacatggggtacacccactgcgatattagaagcaatatctccaaaaatattatgaaaaatatcacaggatgtacaccctctgagtacattgcctatgacattaggagtacaccccctgtgacattctgtacaccccaagtgacattagaagtaacattaggagtacacatggtgtacatcccctgtgacattgcagaggctccagtacagccatttaggggaagaaaatttatggacagaaaaagaaaagtgacgtacaaaagaatggaagtgaagtacacaaacagctggatgggttacctctcggcgttcgacgaatttgaatacggtttgaaaggctggccagctttgatggctcaaaaacagcaaatttcaaaaattagtctctgaatgtgaagctacagtgatactgttaccatgttattcttttctatttccctttctatgtatgcacaagagtgaaagaggagaaaaaactgtatgtgtataaatatatgctgaataaatgtacaataaaaattatagtggt

SEQ ID NO: 471694 - DNA, 710 bp, Homo sapiens
ttgctctttgcactgtttctgtccatgtacctggtcaccgttctggggaacctgctcatcatcctggccatcagctctgactcccacctccacacccccaggtacttcttcctctccaatctgtccctggctgacatcggtttcacctccaccgcagtccccaagatgctggtgaacatccaggtgcagagcaatgccatcagctatgcagactgcatcgcccagatgcttacctgctcagacacacatgtcaattacatcctgctctacgtggtggccggccttctggactttgtgcccttctcagggatccttttctcctacacccaaattgtctcctacatcctgagaatctcatccacagatgggaaacacaaagccttttctacctgtggatctcatctgtttgtggtttctttattctatgggacaggccttgggtacttaccatgaatggagcttgcaggactggaagttgatctgggtgagtcgttgagtagggggtgaatgtgaaggcctaggacattactgtacatcattataagactttagaaacactgtacacttaggctacactaaatttgtaaaaaatatttttctgttttcaagaatcaattaaccttgcttactgtaacattttcactttttaaaaaaggcttttgactgttttgtaataacacttagcttaaaacacagattgtacagctgtt

SEQ ID NO: 471695 - DNA, 796 bp, Homo sapiens
gtgtgctttaccctcagcatggacccacagctgcaggtggatttccataccgagatgaaggaagactcagacatcgccttccatttccgagtgtactttggtcattgggtggtcatgaacagccgcgtgaatggggcttggcagtatgaggtgacatgccacaatatgccctttcaggatggtaaaccatttaacctgtgcatctccgtgctggccgatgagtaccagcaacaatcggcttcaccctccactcttcccttcttggagtttctaccaagatggcagaatgacagtccttttccctctataagagctgagatcacctgcttcatagcaaacctggagaaccacttagcagaaacaacatgttacctacaaactaatgaaggcagattgagtaaagtcctgtcaaatagcctctttttccacacggcccaagtcaggcatcattttgatcatcctcatcctctctccccatgttcattgccgcagtttgttcacctccaaccttactcatgggtatgctcctctcctacccgcattcaacctaacacccagatacctgaggtgccaacacacagccagtgctactcctcattcctttcttccacgtttcattcccatatggaatgaaattccctcctctctcactggacactcttgggttcagtttaggtccactctcctccttacacctttctgctctcagtgttgttcacttttctattttgataataggtcataggcctcatcacctgtatggaattcattttttgtggaattttagaaggtgaca

SEQ ID NO: 471696 - DNA, 1064 bp, Homo sapiens
ctccccgggctgagtcagctgccggtgttgaggtcggagctgatcagcctcctggaatgtgacatgctgtaccctgactaatattccggctgaatcagagctttgctcgtaatgagaggcaagtctcgagccagtcaccctctggcccatgtgagactgggaattcagaatcagccgggagtgacagaaagccaggtctggctggcacgcctggcttcctcctccccaaagactctgcccttcactggcttccctggcaaccatggaaacactgggaggggcatgggtgacccatggcccttctacaagttgaaggcactgctgggctcagcctcctgcaggtcaggagctgctaggaatagccgccagggctggcaacaggtcacagtcactgctccggagacgagaggcctgctgtgctgtggcaccaccggcaaccagacagagcccttggcaccccccatcctgcttcccttgtactgttcgctcatgttcacagcagccaaaagtggccgtgcccggggtgtcagagctctagtggtataaatgatacacggtgaaagtgaaaacaaagccctcctctctgccacgttgctctcgcattgagctccctttcccggaagccccctctctgccgcgttgctcgcattgggttccccatcccggaagcctccctctctgccgcgttgctcgcattgggttccccatcccggaagcctccctctctgccgcgttgctcgcattgggttccccttcccggaagccccctatctgccgcgttgctcgcgttgggttccccttcccggaagcccccctctctgccgcgttgctcgcgttgggttccccttcccggaagcccccctctctgccgcgttgctcgcgttgggttccccttcccggaagccccctctctgccgcgttgctcgcattgggttccccttcccggaagcagctggtgttgccagtttcgggggctttccctggagatgggctgaatccccagccctcattactgaccattgacttctgcagggcttatcccgcaccctttgcaagcttaaaaa

SEQ ID NO: 471697 - DNA, 601 bp, Homo sapiens
ctctttttgtaaaatctggtacatgtgcacaatgtgcagaatctgcaagtggatctttggagcgctttgtggcctactgtggaaaaggaaatatcttcacataaaaactacccagaagcattctgagaaacaaatttatgatgtgcgcattgaactcacagaactcgctagctcaggagtgaagctgcagaccttcacagtgagtgttacagctcttaaggcagtgcatctggagttttccattcctcccagtggactcgtggtctcggtcacttcaggagtgaagctgcagagcttcaccttgagtgttgcagctcataaaggcagtgtggacacaaagagagcctcaaagcactccaaatatccatttgaagattccacaaaaagactgttaccaaactgctcaaccagaagaaaggttcaattctgtgagatgaaagcacacatcacaaaggggtttggcagaaagcttctgtctactttttatgtgaagatacttctttttcacctgaggtggcaaagagctcagaaatatcccaatgcagattgtacaaaaagacggtttccaaacagctgaaccaaaaggaagtttcaactctgc

SEQ ID NO: 471698 - DNA, 888 bp, Homo sapiens
tcgtgtcaatatgactgaggcgggaagtcctggaaagtttctgatcagaagagtggcacagagtggcgaatgtttttattgtattgtgttgttattttactacccaattgcattttattatcagcgtaccttattttatgaaattagacctgcattttggagggagagtctgattttcatgaaggcatgtggtatgcttctgacgataacgccagcattccagctcgtcagtcctcagcccggattccactccacactgcaggtggcttccctgggagatgacgttcgggccagtcgtatggatgatgatgtccaaggagacagttctctcctttaccccagtcacaggaaggaagaactaagcctcatggtgccttcctgggagatacgtggcttcgcagtccaggttgggaccaagagcttgcagacgtcatcgagtgcagattttgagcgaagtactgagcattgtaaatccagatttctcttccagagctgagtctgggccacaggacctggacacaggagggtcagtctctccggtaatgtgcaagcatttgaatctctgggaggtggctaccctcaccaagggacttttttcctagtctcctttgcatccatgtgtgactgaccataatgactacttatagccaaaaatctggacagaaatgatgtgcgtcaatcaattttgcaagtttacaaatattttctgtgtctcctctttctgtttgaagtatgggacgccattgcccaaggggatgatgtgagcacaatggaagaagcggatgtccctgagtcatcctggggagaaaattcaaattctgcccagagaaaccctcattggtcatttacatgagtgagatgccaaacctcactgtgttaagccatcgg

SEQ ID NO: 471699 - DNA, 1126 bp, Homo sapiens
taagctgatgtcatggttaactttatgcgtcaacttgactggcctaagggatgcccagatagctggtaagacattatttctggatgtgtctgtgggggtgtttctggaagaggacatcaaacttcctggtcctcatgcctttagcctcagactgaatgacaccaccagctttcctgcttcttcagcttatggacagcacgtcgtgggactcctcagcctccagaattgtgtaagaaaagttctcataataaacctctgctgtttgcatactttgatgaaacaaagctatcctgttgcagaaaactttcatggcaaggaactgaggggtggcttctggccaagagtcagcaaagaactgaactgccagcaacaccatgaaatcaacagaaccttgagatggccacaaagctgctggccccttgattgcagcccgggagagaccctgaagctgaagacccagccgggctgtgctcagatccctgattcacggaaatcgcaagacaataaacgtgtgttgtctgaagctgctccctttgagcctctgacgggccctggcaacttagagatgaacccgagtgaactttctgcactgctgcgctcaagtctccatcccgggaggagctgtagtctcgttaccgtaacatgcgacccgtgtgctgaccccctggaccaccgctgcactttctcatttatccaaatcactctcaccttctagctgactgtgactgtataatgcctgtgggttactgcccctctccttctgcaagaatataagctcttccatggaaagggtgtttgttttctatattggtggacctctagagcctcaaacagtgtctggcacacaggacaggaccaacaaatacttactgaatgaaaaaaatgaatgccagatggaaaaaataaaaatgaactaagcagggagtttctccactgtggccacaagagggagcccaagctatgtgttaaacccttccagcactaaggtgggtggtctctctgctcctcagcctggaggaccagggacaggtgtgacctgaaccacgtcctttctcctctgtgagcctctatttccccatgtgtagcgtggagatggaaatgcctgaaaggagttcccgtaagaagc

SEQ ID NO: 471700 - DNA, 631 bp, Homo sapiens
tcttcccagacgctggcgtcaccgctagaccaaggagccctctggtggccctgtccgggcatgacagaggagaagcacgaacaccgtgatgcctgctctgggggctccagctgtgggagaggagaccacagggccctccaggacagacagacacacggatgtggtcactcagagcctgctgctgcccgtccaggtacccacagctgtggacccacaggaagggaaactgcttttccctgggcctggctctggttttccctgggtgggggagctcaggaggaccccagactctctggacacatgagcctctgctcccctcccctgccccaggtcaccgtctctgctgcaggtgggacaggacaggcccctgtggaatcgggtctgggagtttccctgggaggcctcctctcccaggaggtcacagctgggagtcagagctgaaaggaactttcccacccgcaggcctctctcctttacacttggagaaactgaggcccaggcagaggaggggcctgtccacatcaccacctccagaggagcctcaaaccgatgacagaactcagcccttcctcccctggaccccgcccacctcccactcaaagcccctcacttagcactgtgggggcctgac

SEQ ID NO: 471701 - DNA, 511 bp, Homo sapiens
accctgtttctcatgggatagggaacatgggaagaggagctttcttttaaacatgagagtggagaaaatatacacctacatctgtacctgcaactacatctgtgcctgcacctacacctctgcctatacttaccccgtgctgacacctgcacctaatcctacaatgcacctacacctttgcctacatctaaacctgtgctatacctacatctctgcctacacctacaactgtgctacacctaaacctgtgcctgcacctacactgtgctacccctacacctgtgctacaactacattgtgctacacctacacctgtgctacacctacacctgtgcctgcacctacactgtgctatgcctacacctgtgcctacacctactcctgtgcctacacctacacctgtgcctgcacctacactgtgctatgcctacacctgtgcctgcacctaaacctgcgcctacacgatttctgtaacatcctctattagagccaaggacaggtgatgcccacc

SEQ ID NO: 471702 - DNA, 655 bp, Homo sapiens
cacctccgccatggccgtgtgtgcgcgggaggcggtggccgcgccgggatccccggatgaggggccgcgcactcattggctgtggagcctggagggcggggcagggggcggagcctggagggggcggagagcgggccgggcgcgtagtaggtgcgcgggcgcgggcgcgggcgcgcagccgagcgtggccggcggcttctggcgagcttgcgggcgacgggccacccagagtgtcagtgatagagccagaattggtgtccgggctgcgtggttctggaattttctgcactttcgcacccgtgatgagcaaactagcgcgcggaggaaccaatcggggagcttgcgaacgcgcaccagtcggagaggttttagaaacggtggccccgcgccggagagcccaaggcgggaggcagggagtggagaaatgaagccacttgttgggtgggtgataaaactcagcatccctggtaaagggcaggtgcacaccatgtgcacctggatgtggtgtccaaagcaggacacggcatcactgaatccagccagcaatgcacaacccatatctacatatgaggaaatttcagacaaacccaaataaggaatattctgttaaacaaaagagggactgtattcttcagaaatgttaatgccacaatgg

SEQ ID NO: 471703 - DNA, 1279 bp, Homo sapiens
agtgccccccagccctcagaggcggagacaaagccccttccctggtcactggggactgggctctgaccagcgcttgctcttggctgccacactgtgatgtccagcagcaggttttgggccggccgagctaaccctgcctctcttccttcgcaggcctcctcgctggggaggcagagtcctcgcgtggtctcctgcctcgagcacagcctgtgcccaggggagccgggcttgcagacaacagcaggtaccttcctccctccttcccctgctcaggtccgccaaggcctttgtggctgtgagagacagaatgcctgctgggcctggctgagctgtggaccggcacactggcttccagagtccagggtgtcccagctcccacccgttcagatggagctgtggggcagagtggtcaggactcccgtcttcctgttctttagcaggggcagggagcccaggcgacccaagaccatcctcagagcccagcacccccagcagaggacccgggcacacgcctgcaccgagctgagggctgcctcatcttgccagggtgttgggaaggggtggcttgctgagggagccggggctgagaaggtggagggcggcgagacaggcagcaccccgggttccctgcacctccctgcgctgctgcttgcccagtgggcatcaaggtcccatgcccgcctgccagccacctgcgttgggcctgcggggaggagctgacgctgtagggcaagggtctctatgactgttcttcccctggctgggctccttctgccaggccctcaggcccccagccttggcctacactgctctctgtctggattgattgagccctagctatttcctttgtttgtttaaaaatttgaccaattggagagtaaacatgcagaggaatggtgacacatcccagttctttcggggaaaccctggatctgatgacagccgtcaactgttgggccatgtacatcgcatgtcttcttcatgtggccctgcagacggagcttaagggactggtgttgtcgagcccccattggtttgtccctgcatgctccttgatgctgtactgacctgtgcaggcttctctgtgttcaggaagacaagcagtctctcagaaagagacacacccaccccccaaaaaaatccttggaatttgtatgtgcagctcaccagccgtgctcctgtgtgcattagtcgtggggtgtcctgttgggttccctcatgaggctgatcctggcagcatgcagagggcctcatccttagggcttcaccaggcgtcagt

SEQ ID NO: 471704 - DNA, 5309 bp, Homo sapiens
tatggggagggccggcccccagctgggaggagctgtgagaaccagggccagccactcggcaacctgggtgtttggggatgggcatagaggagttttcattggagcgccgcagcctgctgacgttttcttcagatgtgcaaggtcttcttaccactggttttgagcagtctgatgaggatgtgctttggtgtattgaggtgtctgatgagggtgtgctttggtgtattgaggagtctgatgagaatgtgctttggtgtattgaggtgtctgatgaggatgtgctttggtgtattgagtctgatgaggatgtgctttggtgtattgagtctgatgaggatgtgctttggtgtattgaggtgtctgatgagaatgtgctttggtgtattgagtctgatgaggatgtgctttggtgtattgaggtgactgatgagaatgtgctttggtgtattgaggtgtctgatgagggtgtgctttggtgtattgaggtgtctgatgaggatgtgctttggtgtattgaggagtctgatgaggatgtgctttggtgtattgagtccgatgaggatgtgctttggtgtattgaggtgtctgatgagaatgtgctttggtgtattgagtctgatgagaatgtgctttggtgtattgagtctgatgaggatgtgctttggtgtattgaggtgtctgatgagaatgtgctttggtgtattgagtctgatgaggatgtgctttggtgtattgaggagtctgatgaggatgtgctttggtgtattgagtctgatgaggatgtgctttggtgtattgaggtgtctgatgagaatgtgctttggtgtattgagtctgatgagaatgtgctttggtgtattgagtctgatgaggatgtgctttggtgtattgaggtgtctgatgagaatgtgctttggtgtattgaggagtctgatgaggatgtgctttggtgtattgatgaggatgtgctttggtgtattgaggtgtctgatgaggatgtgctttggtgtattgagtctgatgagaatgtgctttggtgtattgagtctgatgagaatgtgctttggtgtattgagtctgatgaggatgtgctttggtgtattgaggtgtctgatgagaatgtgctttggtgtattgaggtgtctgatgagggtgtgctttggtgtattgaggagtctgatgaggatgtgctttggtgtattgagtctgatgaggatgtgctttggtgtattgaggtgtctgatgaggatgtgctttggtgtattgagtctgatgaggatgtgctttggtgtattgagtctgaagaggatgtgctgtggtgtattgaggtgtctgatgaggatgtactttggtgtattgaggtgtctgatgaggatgtgctttggtgtattgaggagtctgatgaggatgtgctttggtgtattgagtctgatgaggatgtgctttggtgtattgaggtgtctgatgagaatgtgctttggtgtattgaggagtctgatgaggatgtgctttggtgtattgaggagtctgatgaggatgtgctttggtgtattgaggagtctgatgaggatgtgctttggtgtattgagtctgatgaggatgtgctttggtgtattgaggagtctgatgaggatgtgctttggtgtattgagtctgatgaggatgtgctttggtgtattgaggtgtctgatgagaatgtgctttggtgtattgaggtgtctgatgagggtgtgctttggtgtattgagtctgatgaggatgtgctgtggtgtattgaggtgtctgatgaggatgtgctttggtgtactgaggtgtctgatgaggatgtactttggtgtattgaggtgtctgatgaggatgtgctttggtgtattgaggagtctgatgaggatgtgctttggtgtattgaggagtctgatgaggatgtgctttggtgtattgagtctgatgaggatgtgctttggtgtattgagtctgatgaggatgtgctttggtgtattgacgaggatgtgctttggtgtattgagcttccaagcttcggcagttacgcgtaaagacatcttagcagcttccaagctttggcagttacacataaagacatcttagcagcttccaagcttcagcagttactcataaagctgctgtaaacgcccatgtgcaggtttttgttttgacacaacttttcagcccatttggatgaataaagaaacctgattgccggaccgtgtgatgagaccgtgtttaatgagaagctgccatttcactcccaccagcaatgaagttccatttctgaaggagtatttctcaaatttttctgatgtcccactctgtcttttgggtctttggtacatgtgccctgtcctgggtgctgtcccacagtctctccagtcactggtgtcacggccctgggtgtcccacagtccctccagtcactggtgtcacggccctgggtgttgtcccacagtctctgcagtcactggtgtcacggccctgggtgtcccacagtctccagtcactggtgtcacggccatgggtgtcccacagtctctccagtcactggtgtcacggccatgggtgtcccacagtctctccagtcactggtgtcacggccatgggtgtcccacagtctctccagtcactggtgtcacggccctgggtgtcccacagtctccagtcactggtgtcacggccctgggtgacccacagtctctccagtcactggtgtcacggccatgggtgtcccacagtctccagtcactggtgtcacggccatgggtgtcccacagtctctgcagtcactggtgtcacggccctgggtgacccacagtctctccagtcactggtgtcacggccctgggtgacccacagtctctccagtcactggtgtcacggccatgggtgtcccacagtctctccagtcactggtgtcacggccatgggtgtcccacagtcactgtcactggtgtcacggccatgggtgacccacagtctctccagtcactggtgtcacggccatgggtgacccacagtctctccagtcactggtgtcacggccctgggtgtcccacagtccctccagtcactggtgtcacggccatgggtgacccacagtccctccagtcactggtgtcacggccatgggtgtcccacagtctctccagtcactggtgtcacggccctgggtgacccacagtccctccagtcactggtgtcacggccatgggtgtcccacagtccctccagtcactggtgtcacggccctgggtgtcccacagtctctccagtcactggtgtcacggccctgggtgacccacagtccctccagtcactggtgtcacggccatgggtgtcccacagtctctccagtcactggtgtcacggccatgggtgtcccacagtccctccagtcactggtgtcacggccatgggtgacccacagtccctccagtcactggtgtcacggccatgggtgtcccacagtccctccagtcactggtgtcacggccctgggtgttgtcccacagtctccagtcactggtgtcacggccctgggtgttgtcccacagtctctgcagtcactggtgtcacggccctgggtgtcccacagcctccagtcactggtgtcacggccatgggtgtcccacagtctctccagtcactggtgtcccggccatgggtgtcccacagtctctccagtcactggtgtcacggccatgggtgtcccacagtctctccagtcactggtgtcacggccatgggtgtcccacagtcactgtcactggtgtcacggccatgggtgacccacagtctctccagtcactgatgtcacggccatgggtgacccacagtctctccagtcactggtgtcacggccctgggtgtcccacagtcactgtcactggtgtcacggccatgggtgacccacagtctctccagtcactgatgtcacggccatgggtgacccacagtctctccagtcactggtgtcacggccatgggtgtcccacagtctctccagtcactggtgtcacggccctgggtgtcccacagtctccagtcactggtgtcacggccatgggtgtcccacagtcactgtcactggtgtcacggccatgggtgacccacagtctctccagtcactgtcactggtgtcacggccatgggtgacccacagtccctccagtcactggtgtcacggccatgggtgtcccacagtctctccagtcactggtgtcacggccctgggtgacccacagtccctccagtcactggtgtcacggccatgggtgtcccacagtctctccagtcactggtgtcacggccctgggtgacccacagtccctccagtcactggtgtcacggccatgggtgtcccacagtccctccagtcactggtgtcacggccatgggtgtcccacagtccctccagtcactggtgtcacggccctgggtgacccacagtccctccagtcactggtgtcacggccctgggtgtcccacagtccctccagtcactggtgtcacggccctgggtgacccacagtccctccagtcactggtgtcacggccatgggtgtcccacagtccctccagtcactggtgtcacggccatgggtgtcccacagtcactgtcactggtgtcacggccatgggtgacccacagtctctccagtcactggtgtcacggccctgggtgtcccacagtccctccagtcactggtgtcacggccctgggtgacccacagtcactgtcactggtgtcacggccatgggtgtcccacagtccctccagtcactggtgtcacggccatgggtgtcccacagtcactgtcactggtgtcacggccatgggtgacccacagtctctccagtcactggtgtcacggccatgggtgacccacagtccctccagtcactggtgtcactgccatgggtgtcccacagtccctccagtcactggtgtcacggccctgggtgacccacagtctctccagtcactggtgtcacggccctgggtgtcccacagtctcgccagtcactggtgtcacggccatgggtgtcccacagtccctccagtcactggtgtcacggccatgggtgtcccacagtccctccagtcactgtcactggtgtcacggccatgggtgtcccacagtctctccagtcactggtgtcatggccatgggtgacccacagtctctccagtcactaatgttacaaccctcggtgttgcctcacagctctctcttttatttttctctctctctgtgcttctgtttgaataatttctttttttttttttttttttt

SEQ ID NO: 471705 - DNA, 487 bp, Homo sapiens
gctggagccgaggcgctgaaggacgcatggctgaaagcctgttacaagggcttgtacacatctttcttctgaatctgtcttcccaagtgtataccatacctcaaatcaccatccctataggccccaggtgtggccaaggagtgactgtttgtgggacaacgaacttggctgcattgtacccctaccctaggaacctatggaactttgaacttgagagcaataatttaggctatctggcagaagaaatttctaagcagcaaagtattcaagattgggcctggatgcttctaacagcctatctcatatggcctggtcatgtggtagtaaagaaaagcccattttcaggagaagaattcaagcggactgcagaaatttgcataagtaaaaaggtaccaagtgctaatcaccaaggcaatggggaaaaggcctcaaaggcatttcatagtagcccctcccatcagaggctcagaggcctatgaggacagaa

SEQ ID NO: 471706 - DNA, 1755 bp, Homo sapiens
ctcggacctgagtgggcccagccctgagattcatcagttccaccaagatgaacaaagggttgtcccagcaaaactactgtcctagggccccagatgaacctggatgggaaattcagagacctttgctcactgccattgattctgccactctcccagcttgctgtgtgggtcgtggcagccttgctgagactgccagctcaggacgcaattactgccaattgcattgggatattttgtatttttctggcaaccccaaacctgagacaagatggtatgctaagagcagaccagcagacttgccaaccaaagaggaatgcaaggggtgccatcagaaattcctgtggatatcagtcaaattggaagcaggaattgaaaaccctaaaagaataagccagcatattgcctatttccaggtaatttccaccgtctatgtcgccgtggtccaagttggcattcacgttcctaggacaaagtaaaagggcaaaggaggggtgtcagctgtccagtttttactttttgttatggttgttttagttacatacaataaagttcacttatgtgtttatttgggttgattacaaataatgttgatatgaatattcatgtacaggtttttgttatgaacataaattattttcttaagggcataggagtaagattgccaggccataggcctgtgacttatgcatttctggaaacagtattactgacatcgtatcaatttttaaaacttgaagcatttctcattacttctgtctttccatcatctcagcacctatccagtgccaatgtgtctgggattctcaattcacaatgtgtttgttcctgtttgggaagccaaattacaaacaactcatgtttagcaacagattttaattctttaactgtcaataaagattgaattaatacacttttattcatacttcgtcattcttctttacttcctttcaccaccgtgatctccactgtaaaagtgtaatcaatttgaatatcccctatccaaaatgtttgggatcaaaaatgtttaaaagtttagatttttgaatatttgcattttacttactggtggagcactcctaatatgaatatctgaaatcaaaatgctccaatgagcatgttctttaagcatcatgtcaactttcaaaaagtttctgattttggagcgtttcagatttcagattttcatattagggatacttaacctgtattatttttacaggttatttgcgtgcttttaaacaggtaacttttcaaagtccccttttccccctaatgatttcggttttccttgcaaagtcaactacctaaggttatttctaactgggttcattctgttcggactatctacttgatttattacaactttgtatattttagttattttggtacttgatcaatcttgacataaggtaaatatggatttgctaataaacatcaagatggaaagtgaagtcatcagtattctatctcctttttactgagtatatagaattcacatatgttttctcagatttaagtgtcttattgagaaggtttttttacgtcttctaggtagagatggtgctacagcttgaatgtgtcccctaaattcatggtttggaagtttgatttacaatgtaacattattggaaggtggagactaacaagaggtgattgtgtcaggagggtggagtcctcatgagtggattaacattgttactgaagtagtgggctaagtattaaacgagtggggttgttataaaaagagatctgccc

SEQ ID NO: 471707 - DNA, 743 bp, Homo sapiens
cagctcctctttacttatgcaaatttctgaggggtgagagaggacatccttgtcttgtgctggtttgtacgcaaaatgcttccaccttttgccctttcaagaatatatggaaaagcctggctgtccaggcagaagcctgctgtaggagtggagcccacatggtggagaacctctactaggtcagtgtggataaaaaatgtggtgttgaatcccccatacagagttcccactggagcactgcctagtgcagctgtgagaagaggaccaccattctccagatctcagaacggtagatacaccaacagctttcaacctgcacctggaaaagcttcaggcactcaacaccagcccttgagagcagccttgggagttgagccctgcaaaaccacaggcatggagatgctcaaggtcttgggagtctacttattgcatcagtgtgccctgaatgtgggacatagggtcaaaggagattattttggagctttaaaatttaatggctgccctgctgggtttcagacttgcatggtcctgtagcccgtttttttggccagtttctttcctttgaaatgggagtatttacccaatgccagtattcccactgtatgttggaattaactaacttgtctttgattttacaggcttataggcagaagggacttgccttgtctcagatgagaatttggaatctggacttttaagttaatgctagaaaaagttaagacttttggggactgttgggaaga

SEQ ID NO: 471708 - DNA, 456 bp, Homo sapiens
tactcaaccccttcaccacgtgatggcctgcaccaccttaggactctgccgagctgtggactttcctggtactgaatttcatgatccaccaaaacatgatgtagcagctgtctctcatactttgcgaaaccgaagggttgtaaaagaaaagagaagaagaagggggaggaggaggaagaagaagaagaaagaagaaggagaaaaggaagaagaagaagaacaagaagaagaagaagagcgagaagaagaagaagaagagcaagaagaagaagaaggaggaggaggagaagaagaagaagaagaagaagaagaagaagaagaagaagaagaagaagaagaagaagaagaagaagaagaagaaaagaagaaggagaagaagaagaaaatactgagagcaaaattttgagactagtttatctcttaaagcaaatatgagttggtgcatttctgctactc

SEQ ID NO: 471709 - DNA, 627 bp, Homo sapiens
gtcaaaggacctggagtctgatgtttgaggggaggaggaacagacagaagcatccagcacaggagtaagatgagaaccagaagactcagcaagccagtttatcccaccttttgccgccttctttttctagccaccctggcagccgattggatggtgcccacccacattgaagtttccaaattgaaaaagtacaaatatacacaaagatcgaacgtatgttgtactttaggtcccaagcaatttcctcaagaattcgctcatgatggcagatggctgtttaaacattgtaactcatacgtttcttttaattcaacagatataagcaaacattcaaatactccatcaaagcagctgtctcaccccatatctggatctcaaagccctgaatatttatgggtctttgaggattccaattcccaggttcagaacccactcagcaaagagtggttgaaagtcatcactgtaacacatggtgtatttccaactactctatgccatgtcattttctagctatgtgatcttgtgcaggctacttggcttctctgtactttaattccttatctgtgaaatggaaacaataatggtatgcacataataatgttaggagaattaaatttgaaaatgctt

SEQ ID NO: 471710 - DNA, 538 bp, Homo sapiens
ctactgcctctctagattccacctctggggcagggcatatctgaacaaaaggcagcagacagcttctgcagacttaaatgtccctgcctgacagctctgaagagagcagtggttctccaagcacggcattcaagctccaaaaggctgaaaattccaaaaaccagaacgcctctcctcctccaaaggaacacaactccttgccagcaggggaacaaaactggatagagaaagagtttgaggagttgacagaagtaggcttcagaaggtcagtaataacaaacttctttgagctaaaggaccatgttctaacccattgcaaggaagctaaaaaccttgaaaaaaggttagatgaatggctaactagaaaaaatagtttagagaagagcttcaatgacctgatgaagctgaaaaccacagtacaagaacttcgtgaagcatacacaagcttcaataaccgattcgatcaagtggtagaaaggatatcagtgattgaagatcaaattaatgaaataaagtgagaagacaagatcagagaaac

SEQ ID NO: 471711 - DNA, 1384 bp, Homo sapiens
gcaaggacaagaaagagagtccgttatggttgctgctgccctgaggaggatgagggggcccgcacaagcaaaactgctgcccaagtcggccatccaagcctttgcggggctggtgcggccgctggtcttggcgctcctccttgtgtccgccactctatccattgttgtatcatggactgattcactgattcaaactgtactcaactcagatatttctaccccaaatgtgaatgctttaacacatgaaaaacaaaccaaatcttctatttcccaaatcagtaccaccctccctcccacaatgaatactgagaaaagtggaggagcatctgtggcccctcatccctcacctacacctctgtctcaagaggaagctgataacaatgaagatcctagcatagaggaggaggatcttctcacgctgaacagttctccatccacagccaaagacactctggacagtggcaattatggagaaccagactatggaacagactatggaaccagactactggaccacgggccacagggatgacgacgagtctgatgacaccttggaagaaaacaggggttacatggaaattgaacagtcagtgaaatcttttaagatgccatcctcaaatatagaagaggaagatagccatttcttttttcatcttattatttttgctttttgcattgctattgtctacattacatatcacaaaaaaaggaagatttttcttctggttcaaagcagaaaatggcgtgaaggcctttgttccaaaacagtagaataccattgcctagatcagaatgttaatgaggcaatgtcttctttgaagattaccaataattatattttttgccctgtgatttgagtttgcttattatgtaattttatttgcttgactttttatatgatattgtgcagatgtttgccataggcaattggtacttaaatgagaggtgggtctctcttttgccttggtgctttggaaattaaatgtcataaacaaggagtatataattttttgatctgtacttttagagttgagtttaatcaggtgtccaaaatgtgagttaagcattaccttatatttacactgttagtttttattgttttagatttattatgcttcttctggaagtattagtgatgctacttttaaaagatcccaaacctgtaactaaattctaacatatctgtcactgctgactcacattcattctctgccattcaaatactattttttaaccacacatttttttgtggtcccaaactgtaatgtacaaggatatgtgtgataatgctttacatttgaataatattttttttccttccaagaaaactgctttggatatttttagataatttaaacataatttaggataacgatattgctca

SEQ ID NO: 471712 - DNA, 1695 bp, Homo sapiens
tccaggccggatccaaggaatcggactcgcctgccatggggccgggcagatacatcactcgaggcatcccaggggtggacgccagcgtgcacagggctctttgtgatgaaaaggccctggagcaggacctgcccggcgtgtccaggggcagcagcgaggctgcggcgtcagggcccgggactcaccagctgctgggactgcaggcctggggcaggttcccatctctctgtgcctgggcttcctgcttgctgaaacagggtgatggttctcacccccacagggctgttctgcagtgcctgttggttgggaagtttcggggaaaggaaaagacaaagggggaggtggagcagcaccgggccgaggagcttctccaaattctcgccaggtccgaccacataaacgggggcagccaagcaggctcagagcaggaggagcggctcccagggcgtcggaagcagctcctgggctcttcgcaggggctcatctggccagtgcctgtgggccccgggcagggcactgtgcacagggcagagacgcagggggcccatcggcactgctgtgatggcaactgtcgcgcagacctgccacctctgtgccccgggctcttctacagccctggtactctgaggaccagacatgggcccgtcggggtcccagacatgatgtcagcccaggagctcgtggcctgcctctgccgggagggggagcagcatctggcgctgggggagctgcccctggccaccgccttctacctggctgcattcagctgccacgccccctcagccctgcagagtgtgcgcactgccctggcccaggctcggggggcggcggtggtggccaccctggagtcctggtgccgcggggacagccagatccccgccatccactgggacggcatggcagtggtctccctgacagggtcgctggcctctgccttcctcggcgccctctgcccggaccaccccgccgccatcctgcacctgctggcaggtctgctggcccgcgggcgtcacgaagaagtggtgcaacgctgcagcgccctgctggactctcatgcacagcaagtcctggagctgcggctgacccgcgccctcgcctgggtcctgtccggggtgcaggcagcggatggtgtggccgcctatctccaggccttcgcctccagcgccgaccggacggtagctttcattcgcacccaccagcggccccacctccccgcgctgctcagtgccctccaggactacctctcggggcacccggaggctgggcacagtgccggccagcaggagaccggtggccagcgactcctggcggctctggaccccaggggcacccggagtgacaccctgtcacctgaagctctgctccacagcggcaggtttgaggactgcctggcagcatgcagccgggccctcgaggcccatcccaccggcagcgaaccccaagggaacacctgccctaagaattgtgcatccattagacccaagtcacttcggtcaagggactccccacatcgccagcaccagcacaagcatggcttacgatgagaagagaagaaatgaattttcctataacagactttttacagatgcagtttcctgcaacaaatgaccttccatctggaggttactttccaaagtccttggaaacattgcacaaaccagtcgctccatttgtgctgctgtgacagaatgccac

SEQ ID NO: 471713 - DNA, 1262 bp, Homo sapiens
agtctgctgcgcccaagcgtgtgcctatggggctctggagtcagcgcatctgcgtccacgactgactccactacttccccgtccctttgctgccccgtgaccgattctccatgtttgaaagtggaggcatcaagatctccctcccaggaggacgagagccgaattaccgctcagcccgaattaccgctcaggccgaattaccgctcagcccgaattaccgctcaggccgaattgccgctcagccccaattactgctcagccccaattactgctcagccctcatgatccttgacctgcactggctccaggacctgccttcacttcaggggcctcggccttgcctgcagttccgcctgactctgcagagccctgcagccgcgtgtgctcagatgcagcacccagggaagggttcatgggtggatgggcctggggggaaccagtttctaggggatggcccagcaacgcgcaaaagggagacccctgaagccggccggcctgttccgggcacgctgcagccgagtcatggacaggatgatggcctgggatgtggccatcaggacagccgtgtgagtccatgtcctgggcctctgtgcactctggccagcgtcttcctggtccccctggagggctcccacctccaagagcccggggaaacggaggggttggctgtgggtgccggggccatcctcggagctgcctgtgtggagacgtcctatgtccatgggccacgaagggcccggtggctgcagataatgtttcccatctgtggagccttcaagggctgggcccatgaggattctgctcccagcttgctcttcctctccagcctgcacccaccaggccccagaatcctgaggatggagctgctcctgtcccctgagaacaactgcaaaatgctttttaggtttaagtggaagaattttgctgcgaaaggtagagaagtgattccactcagaattgcacagaatgggcattcacgctgcgtggctactgagaaggtcctagaacagaccacaaaggtaacagccgaggacagcgcagaggcgcccagcaccgagtctgcacggatacccaagtgacttagcaccattttttgaaaagaccatcctgcccccagcttcgttctacaccaggtcgccatttattgtgggtctgtttgtgcactgatactacactggcttaattattgtagcttcatcttagaccctggcctctagtggggtaggtcctcctgtgttgctcttctcctgtagactgtctgg

SEQ ID NO: 471714 - DNA, 1641 bp, Homo sapiens
ccctgagctctggttcccacagggtgatgggaagaaggttggatgataactgcacgcccagtgggttgcattacaggaaaactctcaggctgcagggggatctccacccacgcagccatctccacccacgcagccgcctccacccacgcaacaatctccacccacgcagccgccttcatccgcgcagccgcctccactcacacaaccatctctacccacacaaccatcacccacgcagctgcctccacccacacagccagccctcccctctctgcagagctgagctgctccagcagggatgaggacccaggtgaatctgtgctgtctacactgctgcccgtgagccacttagtagccaccttggtgatccgatcgacggccatggtacccatacgttttctccactgtatacacctccacatcgtgtccatggcggacacccacacatctcatccactgtatacacctccacatcgtgtccatggcggacacccacacatctcatccactgtatacacctccacattgtatccatggtggacacccacacatcttatccactgtatacacctccacatcgtgtccatggcggacacccacacaccttatccactgtatacacctccacatcgtatccatggcggacacccacacatcttatccactgtatacacctccacatcgtgtccaaggcggacacccacacatcttatccactggatacacctccacatcgtatccatggtggacacccacacatcttatccactgtatacacctccacatcgtgtccatggtggacacccacacatcttatccactgtatacacctccacatcatgtccatggctgacacccacacatcttatccactgtatacatctccacatcgtgtccatggcggacacccacacatcttatccactggatacacctccacatcgtatccatggtggacacccacacatcttatccactgtatacacctccacatcgtatccatggcggacacccacacatcttatccactgtatacacctccacatcgtgtccatggcggacacccacacatcttatccactgtatacacctccacatcgtgtccatggcggacacccacacatcttatccactggatacacctccacattgtgtccatggcggacacccacacatcttatccactggatacacctccacatcgtatccatggcggacacccacacatcttatccactggatacacctccacatcgtgtccatggcggacacccacacatcttatccactggatacacctccacatcgtgtccatggcggacacccacacatcttatccactggatacacctccacatcgtgtccgtggcggacacccacacatcttatccactgtagacacctccacattgtgtccgttgcgtgtatctattgtatggtgaaccacaggccatttatttattagccttttggtgtagttttgcgtgatttccagtgtggggctacaatgaataccatcgctttgaacattcacctacaggttgttgggtggacacatgctttcatttcttgggtaaatacccaggagtggaatggttgggtcctatggtataagtgtaggtttaacctcaagggaactgc

SEQ ID NO: 471715 - DNA, 795 bp, Homo sapiens
cctttttcttgcccatgttttatttttaagcatgcatgggcagccaagcagagccgtggtgacagcttctgaggccagccccggggcctacggggattctggaatggtcccctcagcacacacccggccctctcctatgccggccgcacccgccccaagtggcgccagcccagctctgcagcccagcagcccagcagcccagcaccgccacagagctgccagcaccacccctgccgtacccagcagcccagcaccgccacagagctgccagcaccacccctgccgtacccagcagcccagcaccgccacagagctgccagcaccacccctgccgtacccagcagcccggcaccgccacagagctgccagcaccacccctgccgtacccagcagcccggcaccgccacagagctgccagcaccacccctgccgtaccctgcagcccggcaccgccacagagctgccagcaccacccctgccgtacccagcagcccggcaccgccacagagctgccagcaccacccctgcctttacccagcagcccggcaccgccacagagctgccagcaccacccctgccgtaccctgcagcccggcaccgccacagagctgccagcaccacccctgccgtacccagcagcccggcaccgccacagagctgccagcaccacccctgccgtactctgcagcccggcaccgccacagagctgccagcaccacccctgccgtacaaagacagccttgttgctgctttcaaacatgtagcgtgcagctgtcacaccaggctgacctgagc

SEQ ID NO: 471716 - DNA, 1407 bp, Homo sapiens
cccagtgaccgtctgtaatggttagaatgcagcgtgggaggggctccggctgcagagacagccgttataatagacgcctctctgtgcactgggatggcggactggcctgccggcgcaccaccggccacccagcgcaggacaccaggccctgtgagcagcagctgctgtggccgtggcctctgccagacatgggctatacctggggtgcagggtccaagctccaggatccccgagattctcagtgggaagagggacccaagctggccgagaagggcacaggctctgtcgcgtgggaccgggccccgcagagcccctgtggggaggaggaactcctcagagctgagctgtcccagcctcagcgcgtctttcccgggtggacctggcggtgtccggcgagccccactcagcccttcgcaggcagacttggcaggcaccctgggcctggtcccactctcaccaaatagcattttgatgagttaagtgtgagagaattaaaaacaacccgattaaatttcctttataaatacacgtaggtttggaaatcaaggggaaaagcggctttgggctcataaaacgctgcgtacgctttccctgcaagtgtgagggaaggtgcctggcaggtcctcggcacgggactccctgctgaaccgagctgagccagcccaggccatgacccatgcaggctctcaccctgctcccagccccagttcctagcttggacagcgtagacgcaggtccatgcaggtgacttgggctttgcctgcaaaatgggccaacaggaggtctggtaacaggaggtctggtaacagggggtctggtaacaggaggtctggtaacagggggtctggtgaccatggacctgctgcctgttgctgccttacctagaatctcacaggaggggaatcacaggcctgcactcttttgtcttctttctctcggggtcgtctttcggaggctggtcctatcgcagcatctgtctgtagttcaggccctcggataggacattcctcgtagtggccagggccagggccggggctggggaaagttcacccttttgccaaccacaactggcagctctggtgagagtgcggagcaggcttttttggagctgaatttacttgatatttccccgctccgctgggccggttccagggctgcagtccacgaggctgcaagtgaagaggcgtctttgtttctttaattttgcccgttggaaaactccggtattaatatttatgagaaatgacctaatatccacgccgcctgccgcgtgtttgcttaacatatttaatgtgatttgggggctgcgtgtacttttttaactgcctcggtgaccaggcaggaccactggccagtcactttctgggtccagccatcaagttaatcactcatgttgttcctgcaacc

SEQ ID NO: 471717 - DNA, 606 bp, Homo sapiens
tgggtaaaaagattgcggtgtctctcaggcatggagctgcagactggaggtgcccagtgccaaaagggaatcaggacccgtgggccccaaatcagcccccaggacctgagatgtagggcccggctccgggacctgctcctcttcaaatatcagaagaaagaggtggctgtgaagagcttcttgcagggggtggccgggtctcctgagcaggacctgttcctgggcaagagctcctgtggggacaggtgctgggcagccaggggctttagagccggcgttctctctttttccatcacgacaagtgccaacaccactatgacctacacccgagtggggcttcggcctgtacatatcatccctcatgagctgggggctcctcgccatggcccatccctccagaaccagtaccacctagttctgcaggttaatcgccacaagaggcttttggtccgcaagtcatggcagtcttgaaaacgggtggttacgtcttgagcgccatcacgatttgtgtgcacatgccgaaaatagttcacattttcttaaaggacatagaggagcaggaaacagttagcagcgctgctgtatttccgagaactgcagtatttt

SEQ ID NO: 471718 - DNA, 1191 bp, Homo sapiens
gcccacagcacacaggaaaactggccgagggggaggcggggactgtcggtccatctttctgggcctccactgcctcgtctgtaaaatggacgacaccagaggtccccggacagcgggtctgaggactcagtgcctggcgtgcctcgccgagaccccggagcatcgcgcggggctggccagctgggaagtgcaggctgggcaggttccacttcagctacgctgcagccccaggcccccaaccctatcagcggggcagcatcacccctgtaacgaaggcccaaagctggtggtcccatggcgaggctgcccgagaccccctttcttcccaggggtggctcctaggctgctggaggagcgttctgcccccagccccgccccagcctggtgtcctgtggctcccggacaaagcgagccaaacaatctcctcacacctggactctacttccaactgctggaaaaacaaagggagacgcccaggctctccccagccgggcgcccaggccgccaagaggcccctgccccgctctgcagccccaggctctgacgcccggagctcattgtttaactcagataagaaatgtgggctcttgtgttttcttttcttgagaaaatgtcgggcccgtgccccagctgaaccacttcagagagccattaacctctgcaaaacggagtggacaacttccacgtggctttctgtagaaatcagatgggactgcaagcaatggcacggcccctgccaaggtggatcttggagcctccagaagagacatgggcagagacctccctggtcttcctgcagctcctgccctggaacctgagtctcccaggcatctgaccagctgcactccaccaccagaagccggttaccaccgtccttcgggctttgtcctggagggtgcggggctggtgtggaccactcagtctggcagtgaccaccacccagtcagaggcacggcagaacgcacctgctgcacggacgctgtttgaacttcttcaaaacgtggtgcagtgtttcctgaagacatttaccatccttggcagttaaatacagcacagtgtcaattacaggtccatcttctgtaagtctgggacagattcacagtatctgtgtttgcacgaggctggggttccgggtgagtggaccggctggatggccctgcccagccaccctgacgagggctttttatctaa

SEQ ID NO: 471719 - DNA, 2851 bp, Homo sapiens
aacctctgcagcacgtgccccacccagtgtgtacagctcagggagcgccggggactcgggcatcaatgggcaccgagggtcgtcaggggcccagaaggccggctgccacccctgcccgggagacgctgcctccactctgccctgagcccagctgccatcactcgatgtcagaggctccagaggatgggatcctaccaggctcctttggggccaacatttctgatgggatggcacagcccgacacaccctggctcacccaccctggctcccacagccacctgaggatgcgccgggtggaggaaggcggcctggaccagcctgggacatgcggcactcggcgtaggaagccgatgcagagggtcacacctgtggcaccacccctccccaaggaggagggcggccctggcacgcgcagcctggaccagcccccgacatgcaccactcggcataggaagctgatgcagagggtcacacctgcttggcggcgtttagacgactcatccagcacaggcccccagagacagaagcagatgggagatctcggggactggggtgggggtgatagcgagaggcccaggtctcctttcggggtgatgaggacccgtgaaagtgactggaccccggtcctgctggccctcgctcccggcccccgccccgcaccctgtcgttggctgcggaaacagaagcctctaaggagaccagaacttttaagtacaggaaaaatgacttcagattcctcacactggttgcaaacagatcagcacaagaagtagcaaaatgctttctttcaaaagaaaccaaagtcttggggggaaaagtcgtaaggaaaacacttatttaattgatcagcattcagagaagtaattattatgttttaagtggccaacgggtcctttctaattgacgcggcggatcctttcagagacgcagccacagaactgccgctgctgttcctcccccctaaagacctgaagttgtttaggtttgaaagaacacccccataacccccgccccgctgaccgtgtgcagcagaaaggtacattggggggggtggtaattaacatggcatcttgttatttggaactggtaactgcacggagctcgcaaacaaagtcgggttggaggccgaagccccctcgacgcgctccttaactcctctcgggcgtgggcgcctctgcccgaaggacaagtaggaattagaaccccagggccacgcgagcagtgccctcaaagggggattaccaacacgacgaccccttccccgcagcccgagcgccgagcggctctgtgtcagggatgggcagatttcagcctagattcttggccagagggagtacaagggggtttttcggagtcggtatctgcctggctgtgcttcctccttcatcatgtggttttaaggagaagccatgaggcctgcagcccactgggcaggaaagaggcaccgtgtggcagctggcagggaagggcggcccccagagtgcgtgtgaatgtgagcatcccatgagtatccgtgtgtaagcatgtgtagacagtgtgtgtagcatgtgactgcatgtgtaagcatgtgaccgcatgtgtaaggcatgtgtaagactgtgtgtgtaagcatgtgtaagaccatgtgtaagactgcgtgtgtaagaccgtgtgtaagactgcgtgtgcaagaccgtgtgtaagactgcgtgtgtaagactgaatgtgtaagaccgcatgtgtaagaccgtgtgtaagaccgcatgtgtaagactgcatgtgtaagactgtgtgtaagaccgtgtgtaagactccgtgtgtaagaccgtgtgtaagactgcgtgtgtaagaccgtgtgtaagactgtgtgtaagactgcttgtgtaagaccgtgtgtaagaccgtgtgtaagactgcatgtgtaagaccgtgtgtaagactgcatgtgtaagaccatatgtaagaccgtgtgtaagactgcatgtgtaagactgtgtaagaccgtgtgtgtaagaccgtgtgtaagactgtgtgtaagaccgtgtgtaagactgcttgtgtaagactgcgtgtgtaagaccgtgtgtaagactgcgtgtgtaagaccatgcgtaaggccgtgtgtaagactgcgtgtgtaagactgcgtgtaagactgcttgtgtaagaccgcgtgtgtaagaccgtgtgtaagactgcttgtgtaagactgcgtgtgtaagaccgtgtgtaagactgcgtgtgtaagaccatgcgtaaggccgtgtgtaagactgcgtgtgtaagactgtgtgtaagaccgtgtgtaagactgcgtgtgtaagaccgtaagactgcgtgtgtaagaccgtgtgtaagactgcttgtgtaagactgcgtgtgtaagaccgtgtgtaagactgcgtgtgtaagaccatgcgtaaggccgtgtgtaagactgcgtgtgtaagactgtgtgtaagaccgtgtgtaagactgcgtgtgtaagaccgtgtgtaagaccataagactgcgtgtgtaagaccgtaagaccgcgtgtaagaccgcgtgtgtaagaccgcgtgtaagactgcgtgtgtaaggccgcgtgtaagactgcgtgtgtaaggccgtgtgtaagaccgggtgtgtaagaccgcgtgtaagactgcgcgtgtaagaccgcgtgtaagaccgcatttgtaagaccgcgtgtaagatcgtgtgtaagactgcgtgtgtaaggctgcgtgtgtaaggctgcgtgtgtaaggctgcgtgtgtaaggctgcgtgtaagactgcgtgtgtaaggccgtgtgtaagactgcgtgtgtaaggccgtgtgtaagactgcgtgtgtaagcagagggccctgttgggaacctgaaaag

SEQ ID NO: 471720 - DNA, 928 bp, Homo sapiens
tgaaacgttcctcctgggagctgtgtcagtgctcaccaacaatgcctgctgtgcccaaggaactcctgttgctgagctcctgtgtccatatgcagctgcatttcagggtcgtgggcgtggccatcgacctgccggtctgggtgccgaagcccagcgtggacctgaagatctgcatgtatgaccggctctaccaggactctgtgctcgtgcacacgcggtcgaaagctgccctgcgcctgaagttcgaggtgtgcaaggagctgagggcccacctggagctcctgcccgagacaggctacatccaggcacagtcgtcctactccgtgcagctcaagttcctgccgcggggccacgtgctcgtgggttctgtgcgagagcaggagggcggcgtgatgcgtctcccagcgctgatgttccagagacgccgtagctctcacgggatacactccctcccggaggacgcagggaggtattttgacaaggagacccgagtcctggaggccccgatgaccatatgggttgccgaccagaacaagccagtgggattcaccgtgcatgccattgtcaccacctcggacctggagctcagtccctcggaggtggattttggctactgcaccatctatgaggccatcaggacggaaatcagcctccacaaccactcgctcctgccccaggagttcgggttcgtcaggcttcccaagtttgtggacgtccaacccaacgatgggtttgggacgatcctgcccctggaaacgctgcagttctgtgtgatcttccagcccaccaaggccgaggaacacagattccaactgacctgcaagtctgagatcaaccggccgcaggactttgagtgctgaaacttggagagccccatgcagaccgggacctcatgccggtggcctcagacccctgctgctggtctgga

SEQ ID NO: 471721 - DNA, 494 bp, Homo sapiens
tgagggtattaggagttaagtgctgctggggctcctgagcaatttctgatggtgtcaaatgtagaaaaaataagatgcttgcttctctgggatggctgctgttactgggtgaccttctggggaggaaaggcaggagatgctgggcctgagtctcctcatgctcctggttggagaccagggagacatggggcttcactgctgctgctgttggctgctgattgcagattggcctgtccactgaagtctggttatggagtagagtctaggctatcctggagctttgctgttgccactgaggacagatcagactacccttcaggaccctggttggaaatgcgaattacagctacaatgagctatcacctccttcctataagaatggacataactaaaaagtcaaaaaacaatagacgttggtgtggatgtggtgaaagggaacacttttacactgctggtgggaatgtgaattagtacaacttgtatggaaagcgata

SEQ ID NO: 471722 - DNA, 671 bp, Homo sapiens
gagggtcccttttgtgtgcctgagtctacaaggaatacatgcatgatttcagagacttggtgattggtggacgctcagttgctgtggctccacatcatgtttacaccccggtccaggcctgcagtggctcttgcctacagactggcaccacctgttcactctgcatgcaaaggtggaggaacttggaagacagcagaacaaaggaaggtgggcctttcccccagggagaggccggccgaccctgccctctcaagagacaccattgagcagagtggccttgccagaaaagaggtttatttggctttggaattacactttggaattattggtgtctggaaagttcaagactgggcatctgtatctgatgagggactcaggctgcttccatttctggcagaaggcagaggggagccaagatcctgtggggagaggggaagcaaaggagagaggaggtgctgggctctttttaacaaccagttctttaaggacctattagaggtagaattctctcacccttgagaaagggcattaatcaattcatgaggaatttgctcccatgacctgaacacctcccattagccccacctccaacactgtgaatcaaatttcaacatgaggtttggaggaaacagacaaccaaaccatagcactctggtttgtttaatgttttt

SEQ ID NO: 471723 - DNA, 677 bp, Homo sapiens
cgttcctcatctgaaagcagcctctctgtgaagcctctgggcagagatgggagcagatgaggataacgatgagagggtcgggtcacagagggcttcttggggccacacagtgttcagattttatattgaatgtgttgggaagccctttgagcagggaatgacaggtgagccccacctcagactctgtttggaggaaatggaggattccaccataggaaaactcacctgccttcaagcattgtgcccgatacataagtgctcagcccagctttgcttaattaatgcttcctgttatgtctcctatgctgggccagtggtccttaagcctgaatgcatactagaaaacttgcccagccaacatatttgtgttttaaaatgcccctgtttcctgtatgaccaattctatcgtagagcagccattggcaaaatattgaaaaattcgtttctgccttgaactttgctatgaactgatgagccatgctgaaagtggaggagggaatgtagggtttctatgggtaaagaaatacttttgaaaataaaaagagtattctaatgggcattattcgtgtctgaagtacttgctgttctaaccttcagtgttctgtgcagattcttgcacaaggcaaatctccctgttggaggactaggtgggtgtttttataggatgcacatggctc

SEQ ID NO: 471724 - DNA, 1029 bp, Homo sapiens
tctgagaccgcagcatctgtagtagatttaggggatctggctctggtgtaagctgtaagatggtgttcaccctccttatctggcccacagaattaaaaatacctggtgaaggcgaaactgtagacgaacaccagaaacaaaggagaggcagagctagtcgaggacgtcaacaagaggggacttggcaagatgtaggggaagaggtgcagagattctatgccttccctggtcatgccaccttccagaaacctccaggtgttccactaactggaagccccctgatccctgtccttttgggtttctctggaggcttcaatacacaggcattgattaaaccactgaccattggccattgtgaccaactcaaaccttcgacacctctcccctctctggataatgtgggtgggactgaaagtcctaaccctcctctaatcctgtctttggtttttccagtgaccagcccccatcctgaagcttcctagggacccccagccaccaggcctttgccttcacaagtaaattttagaatcactttgtcaatttacattaatttaaaaagcttgctagaattttaattgatattgttttaaacctgtaacttaactcggggagaactaacaagttaaaaataataagtctatgaagatagtatatattttttgtcaggtcttttttttgcaatgttttgtaatttctgtttactagtcccacacatattttgttaaatttatctttatgtatatttgatattgttagtacaataaattatattataaagctttaatttccaattatttgttgctacaatatgtaaatacagttgttattttgtttattgatatattctgtgacattgttaaactcacttattacttctagtagcttctttgtatattccttagattttctatgtagacaattatgttacctgcaaataaagataattttatttcttaatttctattatatatgttaaataaaccacacttttaccaaaattttgcagaaggtgatttattaactgcagaa

SEQ ID NO: 471725 - DNA, 695 bp, Homo sapiens
attatgttttcccagaacgtgcaatgctcccaaataaatgtgtctccagcattatcacaccacaatattcatacggctcattactggttttaattttgcccgttgcttatttactgtctccttccccactttattgccggggtggaagagttattcatccaagcccagcacagaagggccccaaagcggaatttctccagaagccgctggcccagcgctcaggcctcgcaggctccagctcaaacccacacagcatcagaggttcccctaggcggcccttcctgcagctccctgccacgttgactgactgcttttcctgcctggggaatgagccctttctcctttctatgaccaaaagctgcatggctcaggtcccagaagccacactcgtcacaggtggaaggatggcagtgttctctgagctgcatggggaactgagtgtggcattccatccctggagacacctccagaaagaatctcttttttattaaatccctcttccaaaattatgaagtcggcctgtgttttctacaaccagtgttgaaaaacagtgttattagcatgtactatccccttccattatcgtatttttgtccgtaagcgatatattagcataacgaatgttggagagggaaggaaggaaggaaggaaggaaggaaggaaggaaggaaggaaggaaggaaggaaggaaggaa

SEQ ID NO: 471726 - DNA, 645 bp, Homo sapiens
tctggccctgactggtgttcccagcaaatgccagcgggcacctctgaacgccagcatagactagaacatgaataaacctctcacgcctccgcagctggtttcacctgctcttatacttaagggcaaccgcttctcatgtgctctctctgtgaatgttgcctttgctctaccttctgtctgggagactcatccgtgttctcatgtgggctctgctggtgtctgtagtgtctttccattacatctgaccagagtgcaaagaggtggagctgaccttcgacctcgggggacggcagatcctggtggttaccagtggactcctggcctcaaaaccagggttgagaattccagttactcatacattttcaaggaaggtcaaatgtgtgagctgccatccctgggcactagcagcatgagttgtcatcatttcttgaccaccaccaacttggggacacgggtcaggaatttttcttctttgcttcatgggtgaggaaatagaaatgtggagaaggatttttgcatgatattgcttacagatttccccagtgagtcttttctaaggtgcacctgctgatattatgatgggaagcgtggaagatgacatctttatgacaatgttgcagagaagcttagtgcctcatcctgttc

SEQ ID NO: 471727 - DNA, 563 bp, Homo sapiens
aataagataaagcaaataagtatctgagaggcatgaacattttgacaaagtgcctcctgggaattgtattttgcagccaagtctcagaaccaggtctagaagccataccacgtggctaccacctggttcctttgaaaggcagacagcacattcaggcaagacctggcgcccactctggaacgccgactcctggttcaatacccacgtttagacaagagaagctggctcattatggcacctctttcttccacttcaaattagcagtcaagattcttataaagcacggcatgctgtttatcttccgggtatcaccatccgtcataccagctgtttgtcgaaaactgattcaagctcatctaaggcaaaccggcactgagctgccttggaaccaccaatgtctgagacatggcttgagagcaggcctggttgcagggatcggagggtctgagcatgcagcaacccacagtggaattcagagatcttggggttctctaaattgggccggggtttcttttaattagccggacacctgtctgaaatgcatgctctcggccacgggtcac

SEQ ID NO: 471728 - DNA, 524 bp, Homo sapiens
gggccccttcacgtaggcaagccgctgtcatgtgccctctgcaacctgggactcctgcctgctctgctgtgatacagggctagtgcccttcctccctaggcatggctcaggtcccagaagccacactcgtcacaggtggaaggatggcagtgttctctgagctgcatggggaactgagtgtggcattccatccctggagacacctccagaaagataaaaccaagtctgcatctattgagaataaaggcaccacaggttatgggttcagggatgaacacgttgatcccggcagggccagtgggactcaagccaagaacttccgttgcaaacgaatgaaaaagataagctgcttttccgtggatttgccaagcttatggaagacaagcttggagctgctgaaggtcaacttgcagaggctactcatgaagaaagccaagaatcagagagagacaggctcctggatccagtcatgcctgaagacacagccctggatgtatcagttatgtaacaaaatataataactc

SEQ ID NO: 471729 - DNA, 657 bp, Homo sapiens
tacatgcctcatgggccaccgcccagacaccatccctccccaggatggccttcaccatcatccctgcccaggggagtgtgcttgcttcccagaccaagggaggagaagagaaaggagtgggaagggagacatgggaggaaaaccaatgcagggagaggatgaggggaggaaaaagctatatctgctgccacttccttcccgggcagaagacctcacaaatgaacctgcaacattctgagccagccagggccacggccttatctccacactcacaagcagtccatgctcccctgggcagagcccatgccgagggccaccctgggtggagaaagtgtctgggtggtggcccaggggcatgtaccaggctggacctgccggaatcccatgagaactggtcagagaagtgtcatgcccctagggatttctgcttcatcctagagattaagttagatggtgcctgtaaagtgtttaatacaagatctggcacatgggaggtgttcaaaataagtaagcgctgcgagtactgctgctggtggttccattttattctcaatgtggtaaaatacacataacgtaaagtttaccatcttaaccatttttcagcttgcagctcagtagtggtaagtgaattcatgttgtgcagccaacctccagaac

SEQ ID NO: 471730 - DNA, 678 bp, Homo sapiens
ggttttattggcaccatgataaacatgcccgaggcctcgcagggagtggggtctaggatattctcaataccctgcagcctctttgccaccaagaaaggaagagagatattaagaactaagaacggggcgctgttctcccacttccaccacctctatccatcaccatctgacaaaggctccagcacacgcttcgagaaaaatattgagaagaaaaagaacctagaaacagggcaatttggagaggccttcggggagccaggggtgcccaagcggcccactcgccagctgcaattaacaagaggacttgtcagggaagagggggaagctgggcgtgggatttccaggacacaactcacaggccatcagccggagagagcatcctgggggctgctggctggtcctctgccctctcccggctccagccctcctcagaccagtgggttatgcacacagacagctgcttgccaatgaaggaaacacactttatttccagcttaagaattcacaccatcacttgggcagttgctaaataaagcaccatttcccttatccatttcatgtggaccttttagcacttactttataatgattcagaaccatttttaattatgaagacttagctgaacacattcgtttacaaagaagagatattcacagacagttgtgctttctgctttg

SEQ ID NO: 471731 - DNA, 626 bp, Homo sapiens
cagtgactgggctactttagacagagtggaatgcagctttttgggagtgcaagtgcaatgttgcaaagtacaatgacccctgggctgctgctggccaaccccatgcctatgagcacccaatgctgccccactctgcagcagcctgggaaagacacttgcctggcttgggtggccctcaccataaaaacaccagatgtccccaccttcatggaaaagcctgggatggcccaatgtcccagcgaggccgccaaaattctcctttgctgccacacaattctgtccttctgcaatgtgacttcctggctcacctcaagttctgctaagaggtgcaggggtgccctgcctggaccacccaccctaggcaatgcctttgtcctcccatacatctttcttgacatccttacactactgccaggacagaaagtcattcccaaggctcctccacagcctctctcctggcccaccctgagcacctgaggacactactgagcagttaataagaactcagaaagcctcattgatttgaactgggttttgtgaaagtgcaaaaatttcacaaggcctctcctccccttctgatcaatgaagaagggcttccgggttggatgtctgagtttatagaatgc

SEQ ID NO: 471732 - DNA, 805 bp, Homo sapiens
caaggtagtaggtacacttaacatctcctggagttgccatgatgcttttttctttatggcactgggaagggaaatggagaatgggagaaacctgccagggcctctcatccagatgccaaagttattaattgctctggctgtgccacaggctacctggacagaccctggggtggggggctatgtgatcggccatggatatggtgggggtcctactccacccccttgggatcatatggaataccaggactacgtctcccacgcatacatgatgccctctgttcacccgaggacagggagcatgttctcctcaaacatcctccagggtgcctctccaatggcagcctttggaggcctcttgcctttgtggtcttcctgggagctggttgatgcgggtgagcacgccagagccagatgcaccctggagacatctaaatccaaccttcttgtctgtagtaatgaaattaaggcaatcaaagaatcctaatggatttcacccacctacaaggaaaaacccatgagcattgggaaataaggcttctttacatctgaggaagaagcccttcctgggaatccactgaggaagggctcctgtgctcctgtgaccacagcaccaatccatgaggctactggtttgagtactaaccaataaatttacaaagagccttttaaaaagccctaagaaagaattgagggcacagatgggaagggaactgcctttcttgtccattacttcactgcctcagcagagatgactgctcctaggtgtgtcattgtcaataaatcagaataagcaaatgctaaaagc

SEQ ID NO: 471733 - DNA, 591 bp, Homo sapiens
atctgctttaagtgtactgaccttttgttaagttttggaaaatgttggcagattatgcagaaatttctaggaaaagggtggcaacttccaggtcactgggtcattgccatggaaaggggcagggtgttgccatggagtgtggccatggcaatggcaaactgacatggcacaatggtaggcatgtctcaaggaaagctgcttccactccacccctgtttcagctatttctcaatttggtccagtgttcaagcccaacctttggagtcgagtcccacctcctacctcagaaccaccaccataatcaggatttagaatgcatcaccccaaaatgtttcttcatgtccctggccccttgctttcaatctcctacagctcctagtgagtattgatagttcagtcactatagtttttctttttctagaaattcgcctaagtggaattatataatatgtaccagcttctttcttatatctggcttcttttacttggcatgctgtttttgagagttaggcattttgttgtgtgtttgattagtttgatttttgtagtgtgtttgatttgctgtgtgtttttctttatattgcagagtag

SEQ ID NO: 471734 - DNA, 764 bp, Homo sapiens
tccagtggggcagtcaaatcttaaagctccaaaatgatctcctctgactccatgtctcacaccaaggtcatgctgatgcaagagatctggggcgtccacagtagatcaccctctgcaggtccaggacacccaccgcagatcaccttctacagattgggggcacccacccgcagatcaccctctgcaggtctggggcgctcactgcagatcactctctgcatgtccagggcacccaccaaagatcaccttctacagatctggggcattcaccctagatcaccctctgcgggtccggggcattcaacgcagatcacccaccgcagatcaccctctggcagatcaccctctgcaggtcgagggcgttcacagcagaccaccctctgcagagtccggccgggaggactgcgggcagctgggacagaagtgtttggaggtgatgacacagacactccacagacatctgccggctgcccagtctccaaatgccctgcagagatgtgactggaagagtttggggcaattccaagggagtccgttgagagaatcatcccagttggttggaggagggcaaagagtgacgcctccactcaggcccactccgagacatagattctgtccaccccagtggaccgggggcagaatctgtgctacttcattgtcattgtaagcttttgtttgttatttttagacttactttctttcatgtgagttatgtggatggttgaatcctcatgatttcttcttgcacaggatatagcatcccc

SEQ ID NO: 471735 - DNA, 2174 bp, Homo sapiens
tctgttagatggatttctctggaaaaagttggatatgggtcctacatccctccccacaacctcacctcaagacagaaaggaagtgcttcaaaagggttgcttggggaagttggtgtgtgccctgcagccaggaggacacgggtgcttgtggctgcctccacttgggagacccggaggtggctgatttgtcagcagaacaagagagagacagttttagcagccttgggacagcctgctccccagagttcacaggaatgcctcccactggctgtgcaggaatcaatgccttcttgcagggcacagccactcccacagagagactccctggggatgggccaccgggaactcagggactgaggccatggtgaagggcattacctacttcccggacaaatttttcaaagtgcaacccacaaaagcagccctcaagagcctgtgtcactttaaacaatctgccagtcaagtgagaatctcactaaactctccagtctccctctcccgtgctccaactgcccaggaccaagaaacattcgcttggaagtgggaaaagaggggagcatgaaggcaggcttccctggcttccccggcagcccatctgccagggagaggtcccagctgtgcaggtggtgctggtgaatgggagaagtcaaatttgtagagaaagttggaaactgactactacgtaagactggcttttaaaaccactcagttggcacttccatgagttcagactattgtaagaattttctattctcgagtgacttggaaagtcatggaggctcgtctaagtttgcactcaggagataaagaagaaataacccagcaagcaggcttacaggacagaaggaaggaagtattgcataccatgcctctgtttgtttcacacactggggacagcacttaggctttgaatgagtgggtctcaaaggccaggggttgcgggggtcactgtgaatgcaattaattcattcctttttatggctgagtagtattccattgtgtgtgtgtgtgtgtttgtatatatatatatatgttcttatatatatattcttatatatatacatatacaaattcatagatatatatatggatatatacatatatgtatatgtacaatatatatgaatatatactatatattgtatatatattcaatacaatagatatacaatacaatagatatacaatacaatagatatacaatacaatatacaacatacaatgaatatatatacaataaaaatatatatgtgtatatacatacactatatatatacgtgtatatattccatcatatatatacatgtatatatatattccatcatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtatatatatattccatcatatatatatacatgtttgtatatatatattccatcatatatatatacatgtttgtatatatatattccatcatatatatatacatgtatatatattccatcatatatatatacatgtatatatattccatcatatatatatacaggtatatatattccatcatatatatatacatgtttgtatatatatatattccatcatatatatatacatgtttgtatatatatatattccatcatatatatatatacatgtttgtatatatatattccatcatatatatatacatgtttgtatatatatattccatcatatatatatacatgtttgtatatatatattccatcatatatatatacatgtttgtatatatatattccatcatatatatatacacgtgtatatatatattccatcatatatatatacatgtgtgtatatatatattccatcatatatatatacatgtgtatatatatattccatcatatatatatacatgtgtatatacatatatataccatcatgtata

SEQ ID NO: 471736 - DNA, 527 bp, Homo sapiens
ttatgccaaatggctgactcctgggaacagggcaaggaagagaggtggggtgtgagcattctggatgtaaacttatttattccttttgtggtttccccacatctgcagcctctcaattccaaagataataaaactcctatttcctgcagagataggaatggatatttccatggccacacatggaagacaaggagattggaaaagacatgggggtggcacctaactgctcagtacagatgtactgcgcccagggctgaaaagggagctgtctgcgttcttccctgctttttcaggagctcacggaagaggccatgctacccaccaggggcaaacaccaaagaagagaaaggggtctttgaagatgacaggaaggtagtccattccaaccctaaatgatgaactctgtgaggctcagtttcctcttctgtaaactgcagacaatcctcatagcatccctgtgaaaatggaaaagctaagatgtccagtgtgcttggcacagttgctaacatgtcataaacaccccaaac

SEQ ID NO: 471737 - DNA, 1089 bp, Homo sapiens
agcagatcagagacactgcttttctgcaacctttgtataatgtcaggaagtggccccatgcaggaagtccctcccccaataagtcccccacttgccacagggcacgtcttgccctgaccagcaggacgggggcactccagctggggagaaggcagctttccttcatgccttcgcagctcctcgtgctcgctgctggggggcagccgtgggcagcgggtggcgaggttatgaatgccaagaggagaggggctgctgtcacatctccatgcagctttgcaaagcttcataggattctcatccagtgcccacactccccaccccctgccatttctttgtccttcctccatgaaaatgacctgtcctaaaattagtgccagaatccacatggattctaatataatcaaggtgggttcaacggccttgagaatttggaggagagtttcctgtccctgtcctccgggacctccaagtcctggctcagaggctgcaattctgagccagccatcttcagaccccggcagggcagagacccacaccacccttcacgatgctgtctgccctggtcatttctgctcacccaagatctccacttgtaacgtatatgtggctgcagtcaacgatgaatttctacattttggcaacggtcagagtgaaagtagtcgcactatctatagaaactttgagatggagaacacttggaacgcatgcttcgactggaccctacctggacagtctgaggatttgcgagcttcaggccatgtcgtgggctgaagactgttatggggctgcaggtgcagcattgacagatcactggagccctggaactttattcaataaaaagcttctgcaacccaacgggacactgacttgacccctaggcagaggctcctcacccactctgtgcttactcttagcgtctcaggttctaggggcttggctcaatgctagctgctctccactcaaaactactcaaaacctgctccatcaccccagcatcctttgatttaggattaatagtcctgttttagaaatgaaggttttgaaaggtcttactgtcctcctttctcttggccgacatttgaacctgaa

SEQ ID NO: 471738 - DNA, 787 bp, Homo sapiens
gcctatggatgaagtccacattggtcagcttcctggagtacagagcagggtggaggaagatagaaagtagatttggaggggggcaaacagagaatctatccccgtgatgaagacaatgatgatggtgctggtaacagtgataattgtggtggtggtgatggtgctggtaagaatgatgatggtggtagtggtgacagtggtgtttgtgatggtggcaatgatgatggtggtggtaagagtgataattgtggtggtggtgatggtggtggtaacaatgatgatggtaggtggtggtggtggtggtgatggtggtggtgatggtgggggtgatgataatggtggtgatggtggtggtaacaatgatgatggtggtggtgatgatggaggtggtggtggtggtggtggtagtaaagatggtggtgatgatgactaccatttattgagctcatatagtgccactcagcgttctaagggctctcaaccttcacacgagcccagtaagatagggaggtagagattctcagagatttgggagatctacatacagcctaactgtcagagctggcctctgctcccttggacctccctgaaaacacaggaattggtaaagcccctggtcctggcaatttgtattataattacatttgagtttgtttgtgttccttacccctctgtgagctcctctagaggacaaaaagaaattagcctttgccagtgtaggtgctgtcataatgacactgattcaacacatgccttttccctgcaaagcctgaaggcagggtgcctc

SEQ ID NO: 471739 - DNA, 674 bp, Homo sapiens
gagcgaattctaaagaggagaaactggagaacaaagaactgtgggcatcggaatcgggaagacctactgcctttaggaaaagacaaggacaaatattccttgtccaagtaacatagtcccagggagagcatgggatcacgtctagatgaggccagattcaatgttcaggcggctgtgaggatggggctgatggagacagtgcaggtgattggaatgaaggacagatgtcctggcttggacatgggtataatatctatcttggtcatttgggccaattcagtgtcttgggtacagggtcatccatctgggggactggatgacatgaagttgagtcagagaaagattatgtgtggacttgctattgttgcactgcaagcaaatacaccatgtcagtggtacacaacaataaacatttctgtcattcctgtggctgtgggctggctggggctcaaggcacctacgggtggggctctgctgggtagctctgctgtcagtgtttggtgctctctttctgggccctgcagatgcctctccattgggttctgtaaggtccctggagctgctgttaacagtggaggtgtttcacagcaaggaagcacagaggaagttaggatcaggaatggactgggcactggacatggttaaattctgcatttttccatgacaggataatc

SEQ ID NO: 471740 - DNA, 538 bp, Homo sapiens
gcctaagggagtccagaactgtgagtttatggtcatccttctgatggtggaaaaacctgcaggatgtactctcagaataaaggactcctgcacaaagaaggacagttggctaccgtcacatgggagaccaaaggaggcttctccagctccggaggctcaggcatgccagaaagaggcactctctggctccccttggacgacccactgtgtacaaagcacgccggccctggactcaaaagagcatctgcagtcggccttttggaccacacaggaccagagagccttggtgaagatgactcagagatccagtctggaagccctgctgtgggggcacaagagaccattcgccccaacattcccggcctctctacggggctggtggctgagaactgggggatttccccaggtctcaaggccttaaagggacccacaagtcccctggctgtctgcatttcctgcccgttgcagggggcaagccccaaggggagaacagggtggaagatctgggggagctaaattctgggagcgcaggcaatgc

SEQ ID NO: 471741 - DNA, 861 bp, Homo sapiens
ccacagactgacagcttcaagtccatccgaagactgagggtttgcagcagcctgtctggtccaggacataatacaatgataatgaatgactgtgttactggttttcagatttaccatacaataattgtcatcgttattttaggatgtactccttctacttataaaaaaaagttaactgtaaaacaacctcaggcaggtccttccggaaggattccagaagaagacattgctaccacaggagaaattcgaagcaagaggaaaatgaatgggaagggctcccaccaaaggaccctcatgggaaagtggccttcagagaaccctaaagaaagctgggccaagatccagggtgggaatggtgccaaagaacttgacatttcacattcactcacacattggcagctgtcaccatgggtaacaaaatgcaggcactacctacggctcaatagtcatgtcttctttgaagataagggtcttctcttgaaaggcagttggaggctttaggcagatagatgttcaatacctgagagaaagtccttcatgagtttgacacctggagctctcctaactttggaattccttggcctatcactgggaatctggcagtttacaccacctttgtccagcgtgtgacatccagtcttccttgtcgacatgaacatgttgagtccatcgtgaatcatggtagcatctttctaaaggcattgtaattgacaagcacaggtctgagtttaacttaacatgctctcttctgtgctgccttaaagttaatgactgtcagcagggatgagattctgacaagcagttatgctcctgtccaaggttaagttagcctgggcatggaggatggcaacactatcacac

SEQ ID NO: 471742 - DNA, 672 bp, Homo sapiens
ctgaagaaaaggagagtctagcatggataagtccactctgctgacttcaaaaattgatgcaggtctcttgatgtcagccccccaaatactttcccatccttcgacacactggctctgccttcatgcagtggccacgatattgtccctgcccctttctggttctgactcttccgacattgtcagccttgctgtcaagatccttctcatgtccattgattcctgtgactctcattgcatcctctcctcagtccctcagttgataacttttaaacctaatatccatatttcccatggtcatcccatggacacaggctgggaccgctccccaaagccatctagaaagacccccttttctcccttctccatcttgacagcaaaccatcaacccaatgttaaggaaaggcacaaccatcagaacattttagcaaataacataggtcactggaagtcccatgtccctggaaaaccgttggctctagacaaacctggagggttggtctgcctgcccagcaataccacagccagagtctactccaaaaaaatagacatagatgtgtatcaagacttaaccaaggcgcttttgccagagcattattttaaacatgaaaacactgcaaatgggctaaatgtccaacaacaaagcagcagctaataactattatgtctttgcca

SEQ ID NO: 471743 - DNA, 563 bp, Homo sapiens
tgcgctttcttgctctgcaaaggtttgcaatccagtgggaaagatggccatggcagattgcccgaaattgggaagatttctgaaatcccctgatcttgagcttcattatctattaatcaccaatgccagtacttgccagtaccccacatccaacagcattgtccctgggccacgagagtttcaggcctccccagagagctgccaggaagaaaccacacctcacagagaggttctctctgcccttcagccccactggcaacatgaccttgggcaaggcatggaccttaaggtccctcatttgatgagagagaaatttatcctagaagtaatgttcgcgcaatcactgagctctggtgcagaggacgtgggccaaggatgcacatcctccactaggggcccccgagacttattccttccagagcctgtggtgtccatagacacatcctgagcagaatattggctggactgagagtttttactttactgtgttaactcagaacccgaagtttcccaagaagcagcctcctgatacatcaggactgtcctttcacatggatgaccca

SEQ ID NO: 471744 - DNA, 930 bp, Homo sapiens
gctttttatagtcgagcgaaagagtcggtggctgattatttatgtccttctggtatgtcttagagtcaggcaacctgcaaagggtctgtccagccgggctccccaggtgtcatgggacccaaggggaggccaaggacagccctgcagccacttcgaagtctgggcacaaacaatggctattgtctgcgaatggctccatcacccttcccaccatctacctgcattttcaaaataaacagccctccaaagccaacagccctgtacaacttgcctgcctgccggacagaggcagctgtgggacctgcgttcctccaggcaaggcaggcagctcagctgaccacagatggctgagtggctgccagggatcagtaactcagggaaagagagatgagcgagaatggggtctcagtcctcagggggctcctagtcttctgggaggaacatgtttgaatgccctgagtcagaaccagtatctaaagagaagtccacacaacgttcattggaagatttaacacatggagagttcaatgcagcagggatccagttggaaaaaaaaaatcaaggaaggctttctggaggaggcaacatataagatttttctttctaaatatatgtgaattgattcacttctctccatcatcacctctaccaccagggtcttagatgtcatatgtttcatctcttctgcagagtatttccattggctccttatccccctccccattttcttctcacccagtccactcctcacactgcaggcagagtgatcattttaaaccatttcatttttttgctagaaaatgttcccttttgtctaagttttccaatttaaagccataaagtttccaagtattctctattgtttacatctctgcaaaatctgcagttatgtctcttttttcagtcctaaaattatttgtgcctgatctg

SEQ ID NO: 471745 - DNA, 569 bp, Homo sapiens
ggagctgggaaggtggttccagggatgagggtggctctggaagctcctcaatatccttctcatttgtgcttcatccagctggtgggtttctgtttcgtcttggcactcacacactctcccatcttctgcatttcattggctaaagagattcacaaaactagttcacattcaaggggtaggaaaatagactccatctcttcgtgggagaacctacaaaaatcacttttcaaaaagagcagatatagtgagaaaaaatatcctgatgcattgtgtggctgttgtggcctcattaagaccttcagtctccaggaccatataaagctggactgcatttggaatggtcctgcaaacattgctaaaagctgtaatctccagttagaaaacaaccttgaagggagtttctcagtggcctcattagacaaacaagaggtggtaggaccaagcctcctttggaatggacctgcccagaaggaaaggggacaaaaggagtactgggaaaggttttaatggaaccaagctcaagcactgtgcacagaagctggggtgaggagagggggacaattgggggg

SEQ ID NO: 471746 - DNA, 581 bp, Homo sapiens
ctacccgagaatgtcagggctggtgaggcgcaagcatgtgattagaggctggttggtgcagcctgccaacttcctgccagtgtgtctccctgtgccaggaactggcttcttttgtcctgacagtggcaaatccacatgcatgactccatttttttggagtccaggttcagtttgcaaagaggccagagaagaaaactgttcttgggctaaggccagttgctgcttcttgacgccctctcttatgacggttgacagtggaggaacaaaaccttctgagattcggtgctggattgatcccaaataccaatttacttcccctgaacgaacctcgagctctgcttgcccaacaatgcccacagggtacgagtgccaaggagagcacggaaaataacaacgagaaaggctagcagcagtatcaaaatgtcaagtttgtacttacagttgtatgggcccagacagggtcaagagccccaattatttgtgtatgtacacagtggtatgacacgaaaggttatgtcacctgcagctattttcctgcagatttaaataggactgatattcagctgtacagtgagctgctg

SEQ ID NO: 471747 - DNA, 1489 bp, Homo sapiens
gagacttgtcacttgtcaggtttgagctgacagtcccaacgctgatgaaagaattggaaggagattggctgtgcgtgaggagagttggggtcagccgcccaaagttttctccgcatggtgaggaggggagtcctaacccttttggatggtgcaaagaagtctcggctgaaggaggtggaaggggttccagccatctcccaactgcatggggaccaggacacaggctaagcaccatttcttcccctaccacgcccccagcggtgatggcagacaatgcagcaggattgcaggagccgagccgcggctcctccacccgctcctcacatcggaggagctagtatgatgctctctgagttcccccagaggaaccccacaactccaggatcagagcacacagacccccgaccatgccggtggggttcaccccctggcctgtggaggggaaggtggccagtgcagggctctatggcctgaagagtggcctgggaaggccccacagctgtggcagattcaagtgtcacaaagccatggtgctacccaggcatcctcagtccctcagtcacctcacctcctcaatccacctgcccatcagtcctaacgagtgccgggttcccaagttaccaccaccaacaaccgcttcttttgctgcacctggattcattgctgctacttttcaaacatctctgctgccctgggaggagctcgttgagcagctggctttcctgggagagatccactggctcctgctccaccacagtgaccatgcctcttcttccctgcccagccctcctctaaccttacttgaggatggtgaggaagcagacagaggacgtaaaagcaagaccagaaaggggctggcacctccgttctctagaattgagatcctccagataacacacaatgattgtggaaagaactggcaaattaaagatagttggtattgattccaaaaatacttttgctttcagcaaaatacatctttaattacttttctactagctgtcatttttcataaagcagtctagacgactcgtgccaaatcctgcaaagactgttttcaatgaaatgctttttcttaatatcaaagatcagagaggggttgaaaaatctcttcatatgtgaagtttaacaaatgcctagaaaacttgtcacacattcaggatggacagactcctatgctcccattgtcatcaacaactggtgaaaacactacctgcaattttctttttccatcttctcatctcttgtgagctcttccatgtgatggtctgggtaaaatatgtacatttctatgcaaatagtatgcatgttatttttgctttttcgcttttgttggtaatgtattatccatagtttgaaactcccttttcccccaagcagtttaatacaaagaccaagataacacctctacatgtacacatacagctgtagaaaatatgtaatactggaccagttctttttttaatctttatttatcagaagtaagctg

SEQ ID NO: 471748 - DNA, 608 bp, Homo sapiens
aataaaatcctgtggtttgaataggacagaacctagggatttgactcttcagagcatgataaccaacactgcagggtttctcaacagcggcactgttgacgctaggggcctgatgacattttgtcctggaggttgccctgcgagcattgtaggaagttcagctgcccctcggctgacacccatagatgctagtggcactcccacccctccaagctatcatttttggcgtggaagagagtttgatggattctgcaataatgagattgacgagacagatggtcgctgccaggaattcagcagaggccagggtgatggagaagcaacggctctgtgtcagaagcaggggcgggagcgggaggacactaagatcaacaggaataaaattcctgagaacaaggccctgctgatatggaggaaacagaaagaaggtgagagtcagcacggtcgcttcaaaatggtgacaactgaaatcttctactcaacaggaatggaaaaccagctcagttcctggtaaccatgacagctgttacaagtgcatccctgaaggtctgtgacgcgtccagactcctcttctgcctgctgtcccatggcaggctcttcctttctcc

SEQ ID NO: 471749 - DNA, 910 bp, Homo sapiens
cgatgaagaaccaggcagagcttcccctgagtcagcttagatcaacagcaggatgacagcagcagccgtgccaatcaccagcagccgacatcttggagaacggctcatcaacagcttcccggaagcaggggagatgccattgcttcagaataacttccccagccagatgttttaccagttcctcgagatggtagagtctgtgcatggctgtgacgcatcagggcctttccagtgccgctactgtccctacagtgcctctcagaaggggaacctgaagacccatgtcctctgcgtccatcgcatgccttttgacaacagccagtatcccgaccgcaggttcaagcgctccagggtcgactcagaggcttctgggaatttcgaggagcctacagctgtcaaggcggggagctctgcagacctcacggaagagggcggcaagggccaggaggagaccaactgagcagaccaacctgtatattgcaatagtattttacacagttttaacattatgcatctggtaaaagtttgctaactgcattccaaggggaaaaaatcatgtacaaccccccaatagtgtatagaacatttaaaaaattttaaaagatatctatatatatattaaaaaaaaaaaattccccagcccttgaaaatggctgctaaactgttacccggcaacaagtacttccaaaacaatgcaggtgggagaaaagtgatttcaaaaattcttggtgccctctgagctggagagagctgggggcccttccaactcgaaagtcgtctttgtccaaaaataatgctcttaactgaaaaacgataccatctaaacgatttagtgttgcgttgaagatggaggggctgtgttttcgttgttgaaaacacctctataatctgacaccagctgctgtaattc

SEQ ID NO: 471750 - DNA, 1220 bp, Homo sapiens
ggacaggagggaacgtgtcggacccggccagcttctgatgtgagaaggaacccagcagcagggcctgagccacctcatcaaagatgagaagcagctcaagcatcctgagtgatgggagactgggaggcagtgcacctgctgctgggagggctgggcctaagctcagaacctcctgggagaccaggtgagccgtgatcagcaagcgagcatgcacacgcatgtctgtggcatgtctgcagataggcaccttctgtctagatcaaccctaaagcaacaaacttggtgtagtcccatcttcatgggagcactttgtccagcaaaagggaaacctggcttgttccctcgagcctggaatggacatggaaagggtgtctttttggcagaagcaaggatctccagatggtttcgaaacagaatttacccagcaccagaccctcctgggccagtcacatggcctttgagtgaccaggatcttcaggagccactttcaggaaatgcagcaaaggtacatgtatcatatgatctccttcacagctgtgaaaaaatgctattagtgctttcaaagcagttttatcacagattaaagaagcctagaaaaaaaattggcagccagagacagccatatgcctacttgacctaggacggtaaacctgttgttcattccagagaggggattatggcattacttttagtaagttgcttttcatatggaaatttcctttcatagtaaagatctgtctttaatagcatcatcctaaaaacatgcctattttttaattccacgatcatggacatatagatttttatagtgtctgcaagcatacattaatgttaatttcaccattctcctttgtattttgttaatgtcacagtctgctgtaaaaccttgccaagtttcttaactgtcatgttaattccaagacctattctgcactctttgacatttcaggacagaacaaggcagtaaaaatagattagaaacagcttataagtattataaaatctagaactttacagatggtggaattaggtctgctgaatggaaatttagcaactcctgaatgcaataatattagaaaatcgtattcatttctaaggtaaatatttggaaggcgtcgtataatggcggctggagaagttggggaaacttataaaatgcaacagagttatataattttaagaaacatactgtatgcatataccatatcctgcagagtttc

SEQ ID NO: 471751 - DNA, 722 bp, Homo sapiens
agtggatgttacaatgccttacaacacattttctcattttttaatgataaaaatgtttctagtttccttagatctaaaacatggacctaaatgataaatgccttttgtgtggtgttgggacaggataggcccctcggaagcaaccaggagccggccctcccctccctggccatctgcttgaagcatctggtgatcaggtgcaagccccacaccggagcattcaagctgaaatgtgcagtcaccttgccacccacactcgcttttgttacgcagccaggctgcccctctttgtgtcggggagaacagtttggggatggaaatccgactgctggcactgggaattcaccatggctgagccgagatcctgcaggccgagaggctggcccagtctccagacccggctgtcccctcccaccagggtccatggacatgtctccagcaaacgggttggctttccagagcagggagaagattgctcacgaatgtcttctttacccctctgggtccagcaggtctcagatatttggatcctgccgtaaaggagaaatgcttgtcagttttatgcctccaccattacttaggaaggaaagggcctgtcctcacagctgccagagcccataggcgttacatttagcgttcttctcctggtgggggttcaagccatggtcattactctagaatgttgttacatgaagaaacaccaagaaatgtgtctgtaaaaa

SEQ ID NO: 471752 - DNA, 514 bp, Homo sapiens
acacaccatgggcgattttctccctcatttccaaggggggcttgatcaaataccagcttcaccacttcctaaacctaatcctctgcaggtcctggattcccttgctgttcaggaacgtaatgtctatatgaatatcgttgccagaattgtctcaggccatagatatatcttcactttccgtgttgagtcctttggaggccatcggggagctgctgttccccttcagcgtggctgcctgctcagggaggtcttggcttccgcagggtggaccagcttgcactgctctatgggtgcgcagtccctggaacgccctttctgtgtggatgttattgaatcctctgatgtccatgcgccacctgttcattcggggattttgagtgatagaagcaactcagtccattcacatccaccaagaccactgcggtctccctgaaatgttgtaccagaggtttctgctgactgatgtctcttttatagatgttcataagactgaaaagcaggcttcagatgtata

SEQ ID NO: 471753 - DNA, 908 bp, Homo sapiens
gggtttgttttgaatattgtgataaagttaccaaagaggtgcaaaaagagtgcagagaattccttcatacccttcacctagttccccaatatgttaacattttacataaccacagaccgctactgcactccagcctgcgcaacagatctagatcttgtctttaaaaaaaagaggaagaagaagaaggaggaggaggagaaggagaaggaaaagaagaagaagaagaagacggaggaggaggaggaagaagaggaggaagaggaagaagagaggaggaagaaggagaagaagaaggagaggaagaaggaggaggaggaggagaaggaagaaagaactgaacccaagaacttgggacaagggcctgtgggcagaaggttgatttttggaagtgactttagagaatttgggatagagaactgggaagacaggaagacagaaggaaggaaagtgaacctgggggcatatctatccactggctccatccccatcggtccagggctgtcacggaagaatttccacttttattttatacttggcagctgcgtgtgcaggtgctttacctccatctccttccacacacctgtgggcttgtgcaggaccagaggctggctctacccgctgaagctctttgactcctctgtcctctccaaagcctcagttctcacctgacaaaggggctggaatgttccatacaccctgtaggactgttggggtcacatggatccatgcttgtgaaaggcctgagtgtgcagagttgggagctacacttcggagaagcccctcttgctgtccatttctctctgataaccaggtgaggaccctgcatggcttgatccattctctttacttccttttaagccatactgaggaggtttactttaaacaatttgttgttggtggttgttgtt

SEQ ID NO: 471754 - DNA, 677 bp, Homo sapiens
ctagttttgaattcatgagttattgatcttcacttgcaaagagggacactgagagaggaagcaatgccaaatgacacgcagctagagtcaagcctgggacccgctgtcctggcacccacgacacgcttccaacaaggctttcaaaggcgacgcatcaatccagtaattgttacgcccataatgaaaaatccacagaggagacagagtgacacaaagaccacaaagcctagagaagattgccaaggggtagttgacccaggtggctgctgtgttgatgagtatgaaacctcccaggttattcacactctgtcaaagaccctctggagccaagacggcttagctcagaggagtgaggcggatgctgaggtttcagaccaagctatcttgggccatgtgggcttcagggagcccaaatctgcctcagaggcatagcaatggtcctgaggcttctgagtcctggattaattaggcggaaaggtttaggtagggtggggtcacacagctcttagattttatccttttcactcctgaaaccactggagaggctgtttttaaacacagaacatctagaatgccagggacctccctggaggcaggttgggaatcatggcccaagctccctccccagacacctgcacatgtgcacatggtcctgcgcaggatgcacatttcacaac

SEQ ID NO: 471755 - DNA, 4210 bp, Homo sapiens
gtcaaatgggctgtgatttatgagaaaatagaggatccaaagaaactgaactcaagccaagtgtgcgggcagcttcccctccattccttccctctccttgtccttttcctgttacatgtgaggcagtgcacattttgtttttggtgtctgagaatctgcattttaccttatttttatttgagattcaagggatgcatgtgcaggtttgttacttgggtacattgtgtgacactgaggtgcaggtttgttacttgggtacattgggtgacgctgaggtgcaggtttgttacatggatatactgtatgatgatgaggtacaggtttgttacttgggtatactgtgatgctgaggtgcaggtttgttacttgggtatactgtgtgatgctgagtgcaggtttgttacttgggtatactgtgtgatgctgagtgcaggtttgttacttgggtatattgcatggtgctgagtgcaggtttgttacttgggtatttgctggtgatgacgtgcatgtttgttacttgagtgtattgtgtgatgcagaggtgcaggttttttacttggctatattgtgtgatgatgagatgcaggttttttacttgggtatattgtgtgatgctgagtgcgggtttgttacttgggtatattgtgtgatgctgaggtgcgggtttgttacttgggtatattctgtggcgctgaggtgcaggctccggtgtgtgatgttccccaccctgtgtccaagtgttctcattgttcaattcccacctatgagtgagaacatgcagtgtttggttttctgtccttgtgatagtttgctgagaataatggttttcagcttcatccatgaccctacaaaaggacatgaactcatcattttttatggctgcatagtattcctggtgtatatgtgcgacattttcttaatgcagtctatcattgatggacatttgggttggttccaagtctttgctattgtgaatagtaccacaataaacatacacgtgcatgtgtctttatagcagcatgatttataatcccttgggtatatacccagtaatgggatggctgggtcaaatggtatttctagttctagatccttgaggaattgccacactgtcttccacaatggtcgaactagtttacactcccaccaacagtgtaaaagtgttcccatttctccacatcctctccagcacctgttgtttcctgactttttaatgatcaccattgttaactggtgtgagatggtatctcactgtggttttgatttgcatttctctgatgtccagtgatgatgagcattttttcatgtgtcttttggctgcataaatatattcttttgataagtgtctgttcatatcctttgcccactttttgatggggttgtttgattttctcttgtaaatttgtttaagttctttgtagattctggatattagccctttgtcagatgggtagattgcaaaaattttctcccattctgtaggttgtctgttcactctgatggtagtttcttttgctgtgtggaagctctttagtttaattagatcccatttgtcaattttggttttgttgctattgcttttggtgttttagtcatgaagtccttgcccatgcctatgtcctgaatggtattgcctaggttttcttctaggatttttatggttttaggtctaacatttaagtgtttaatccaccttgaattaatttttgtataaggtgtaaggaagggatccagtttcagctttctacatatggctagccagttttcccagcaccatttattaaatagggaatcctttccccatttcttgtttttgtcaggtttgtcaaaattcagatggttgtagatgtgtggtattgtttctgagggctctgttctgttccattggtctatatgtctgttttggtaccagtaccatgctgttttggttactgtagccttgtagtatagtttgaagtcgggtagtgtgatgcctccagctttgttcttttggcttaggattgtcttggcaatacggtctcttttttggttccatatgaactttaaattagttttttccaattctgtgaagaaaggcattggtagcttgatagggatggcattgaatctataaattaccttgggcagtatggccgttttcacaatatttattcttcctatccacgagcatggattgttcttccatttgtttgtgtcctttttttatttcattgagcagtggtttgtagttcgccttgaagaagtccttcacatccctttcttcctgtggccatcccccaacgcatgtcttcacatcatcttcccatggacgtcctccccctgtgtgtctttacatcatcttcccatggatgtcatcccctgtgtgttctcacgtcatcttcccgtggatgtcctcccactgtgtgtcctcatgtggtcttcccatggccatccccactgctgcgtgtcctcacatatcttcccatggccatctccccatatgtgtcttcaaatcgtcttcacgtggctgtcctccccctgcacgtcctcacatggtcttctcatggccgtcttcccgctgtgggtcttcatgtcctcttcctgtggccatcgtccctgtgtgtgttctaacatcatcttccctggctgtcctcccactgcatgtcatcacattgtcttcccatggacgtgttccccgtttttcctcacgtggtcttctcatggacatcttccccctgcagggcctcacatcatatcttcctttggcaatcctccccctgcatatcttgacatcatcttcccatggatgtcctccccctgcatgtcctcatgtcatcttcccacggacgtccttcctctgtgtgtcctcatgtcatcttcccatggacgtcctctgcctgcgtgtcctcatgtcatcttcccatggacgtcctccgccacgtgccctcatgtcatcttcccatggatgtcctccccctgtgtgtccttatgtcatcttcccgcagacatcctccccttgtgtgtcctcatgtggtcttcccatggccatgcccccacccccgtgtgtcctcacatcatcttcctgtggccatctcccctgcatgtcttcaaatcgtcttcacatggctgtctcctcctgcatgtcttcacgtggtcttcccgtggccatcctccccctccatgtctttatatcctcttcctgtggccatcgtccctgtgtgtgttctcatgtcctcttcctgtggctgtcctcccccatgtatcctcacatcatcttcccgtggccatcttccccgtgtgtcctcatatcatattcctttggccatcttcccccacatgtcctcatgtcctcttcacatggttgttctccccgtgtgtcctcacgtcatcttcccatggccatcatcccctgcatgtcctcgtgccttcttcctgtgcctgcgctccccctgcatgtcctcatgtcctcttcccatggccatctgccccctgcgtgtcctcatgtcatcttcccatggccatcctcccactgtgagtcctcacatcatctccctgtggctgtcctccccctgcatgtccttgtgttgtcttcccatggccttcctcccttgcgtgtccttgtgttctcttccctctgtatgtgtctatctgtgggtccacgtttctcctttttatatggatattggactagggcccaccctaatgacttcattttaacttatctctgtaaagactctgttccaaatcagatcacatcaggaggcactggggtgaggacttccacatgtctttagtgggggatgcagctcaaccctccgctttccccttgctcttccgcagctggaaggtgcttctgcatttcctcatcctgggcacagctctgtccctgggttccacactgtcacagccacccttccagacctctgagcacatagcaaatgctcctccgcaggcccgccctgcctgcctggtgttgtggtgggagtgctaagcccacagtggcactatggaaatacttggtgcatgaggctgtaaaacctcaataaaccaaaatgctcagggaatgaattattttagattaattttggaatcaacttgggcttccaaataattatttttattttaacactttcagcattatttctggaaaagacaagtctacctttctgcctcaggaaatctagtttgttaaataaaacggaactgtccttggattttgaagaccagcagc

SEQ ID NO: 471756 - DNA, 533 bp, Homo sapiens
tattattaaaaagtcaaaacatcacagatgctagcgaggctgtggaacaaagggagtgcttatacactgttgggagctctcccaggctgcagcgggaccacgaacctgaattccactttcagccagcagggggtgtctggtgcttacttccccaaccaaagggtgtttctcaaacctgattctatagctcacaaggacctggagttgacacttaaggtgacagctgccccttccttcaccctggaggggtttggggtgatgctgtggttgctattcttatcactgcccgcagccccaggcccagcccttagcttcacagcgagctcagcgtattcagttctgtgggtagcaggtgctcagttaaccttaacacagatgtttcttctgaacttcccaattaactgaggaggggatgaaggaaggatagaacgtggcctgcccttatgagctgacccaaggatggaagcacaaggggttggtggatttccctttcctagccaagggaagctgtgacagactaccttgaaaaacac

SEQ ID NO: 471757 - DNA, 1387 bp, Homo sapiens
gtgtgggctgcggcatgccaccgtaccctccctttgcctgatacctacaggagtctgtgttactcaggaggactcaggaatctggagattgtgctcttagatggaaaattggaactaggaggagaaagaaagcttaaaagtgtgagttctagaattagtcggcctggctttgaaccacagctctgtggtttactagctccatgacctcgagctaagcccttggcttctcactaagctttggtttctgcagcgtgaactagtaatgaaacaactgcctcagaggctgttgtgagagtgaacacagataatgaagagatgtcagtacagcagtgcagtgcaggaaaggcagagctagagctgcgcacaggggtccaagaaggcttcctagaggaggaagagtccacgtggcctaacggcttcctccaagagaaatgtggtggtcaactgcttgcccccacctctcctctgggttctgagccttgcctcatgaggctggcctccaaggactccatccccagggcccttgtgctggctggcctcgacttcttcagaggtctaaaggctgaaggccccagtggtggccaaaggcaggaaggctatgtgccctgcttggctggagggaccccacccacactatctccagctgctctgactcagaactgccagctgggagcaggccgcatgctggtctgggcaggccagctctttgcatctggagctcacaactctgtttaccacagacacgcactgtgcacctactgaatgtacgtgctgtacacttattgagggcccctgcatgcaagggccctgaggacaatttctcacgaggcttgcagctcctgcccttgaaaagcccaactctggtaggagacaggaggctaaaactaacatgcggagcatcccacaccctactctggcttagcccctcccaggaatgtccgtcatctgctgtttacaacttcaactcctcagggggcccttttaaggcccctcagcatctggcctgatctctacctcgcctgtccctgcccctccttacccctaagcttgcaagttccacccttcatgtgggcactcagcagagcatcccgcctccccagcctctccctgggtgttcttccctctcctcctgcctggaggacaccctctccccttccaaggtgcacttcaagcattcacttctctaggcagcttttcaccgtccccacctccccaccaggtgagggtaacagctcctcccacctcagtgcctctgctggaccgacacaggtctctaacacagacccagccaatgcctccctggcagaagtctgtctctcccgccaggccacgagcaactgaaggcaagaggggtctgttcatgtttctttcccaaagccagggcctg

SEQ ID NO: 471758 - DNA, 699 bp, Homo sapiens
gaggaccccatgagctggacgcaaagccaacctccccagtggtatcagttccataaatattgcttcattaagctgtctgtgtcggttcaaagagatggatttggaaatgtggccaagcttgttgcgatgaggcggaagactccgcgctgccagtgtcacttcgcctgcccacactgcgctagctgccacagtgcggggccatcagttaacagccggagctggcccgacatctgcccaaaggacgtgaagcagctcagggtgaaagccaggcccttccaggccctgggctttgaaagagtggtgtacgcagggatggaggggctccttggtgaggagcacccacctgagcgatttgagcagcttttctacattccaaacaccaaagccattgtttcttatttaccggtctccgcacacaccaacctgctgtgcttttaaccctgacaaggtgaaatgtggtgtgcatgtgtggattaacttatttctattttactatttacgtgtttatttttcaattgatgtttagagatatgtatccattatggaatgactaaatcaagctaattaacatgttcattacttcccatacttatttttttgtgtaacttggagagtaatatcaagttgtttatttaaaatctttcttctttttttgatataggcattttttgctgtttctttcataactgcttttgctgt

SEQ ID NO: 471759 - DNA, 733 bp, Homo sapiens
ccacaggacacatctgttccctcttctcccaccccccgctctcatcccagtagctcctatccgccccataccatgcatccctgaaagctgcccctgcatccgggttgataaaagacagacagccctggaggtggagtaatgcagacctcctcctcaggcggtcagcaccacaccaatggggatcccgtagatatgggaagcagctgcagttgtaacaggacccagttcggctgtgtactgcttaaacatcaaacacaagggtcatctagtggtctgggggagacaggaacctgggtccccagtgccatggcccatgggctcagcccatcctgctgttccagcccagtgccttccctgagctcccaggccccagggagggtaggaatgggagctcactgggtgcagatccaggagaggccggctggctcctcactgtccctgaagcaggaagctccagagcaaaggcctcagcgcctgccctcggggcctgctgcagctctggggctggcacaggtctcgctggcccctagagggagctcgaagcccctccagctctgatctgtcccttccaaggagaagagcaggcaaatgattacagatagagctagagtcttttttttatacacccctcacccccctgcaggaccactccttgaaataggatgtatccttccttatcaggctttggatacttttgcctcatgtatatgtatccatgaacagtatacataat

SEQ ID NO: 471760 - DNA, 588 bp, Homo sapiens
acagcaaagatggctgcctgctccttcctctgggatctccatcctggaagggcaccaacctgatgccagcatgaacactcctgtatgtctagacctaccccaggaggctctctggctatatgacatggagctcgtgacttatggcaaacagccccaaccagactactccatcagccccatcactgagatggtttggatgttcatcccctccaaccttatgttgaaatgtgatccccagtgttggaggtgggtcccggtgggaggtaactgggtcatgggagtggatcccccacgaatggcctggtgccctcctcatggtaatgaggtaatgggaatcggtgtcgtgctgatgataacagatgacggaactcgtacagagagagtgggaagtgatggactcaagattccaatcaaatggttggatggccagagccctgtaaaggcccagaaagggggcaaatttgttggcattgaaatcctggcttacctgtgagccagcatgctgaacagtgaggaacatttgaaatgtcaggagagaatgcgatggttggaagtggtgaaatggcaaccagcaacaaagtgttcacg

SEQ ID NO: 471761 - DNA, 607 bp, Homo sapiens
tccctagtgtctgtcattctcatcatgtcgttatgtatgtacccactgtttagctctctaatcacttctccactgtgcctatcacatcagcccctcccctgtgcccatcacacctgccccctcccctgtgcccatcacacttgccccctccactgtgcctatcaaacctgcccctcccctgtacccatcacacctgtcccctcccctgtacccatcacacctgccccctcccctgtgcccatcacacctgccccctcccctgtgcccatcacacctgccccctcccctgtgcccatcaaacctgcccctcccctgtacccatcacacctgcccctcccctgtgcccatcacacctgccccctcccctgtgcccatcacacctgccccctccactgtgcccatcacacttgcccctcccctgtgcatatcacgctaaaggctacacgatcccacacaattctgtcccttgtgcatcccggcatcccctccatgcccctgcctaaactgcacagcttcacactcccacgcaccctgtctggggcatcctgatgttgctgtgtatctcctggctctgattaatttaattaattaatcgagatggagttgc

SEQ ID NO: 471762 - DNA, 949 bp, Homo sapiens
ttcatgtggatgagtgctctgggacctgcagagtcgcacagaaaagtgacccacagacacagaaggcaggagggacccgagggtctcgccctgccggcctcatgttccacatccataagacaagcgtcagaacagtgcccacctctaagggtcccctgcgcttcaggtgactcgcagtcctcccggcaggcccccctccccgtgtgcttccttcctgctgtctgtgagcccttgggggcaggacctcggccctcctggtgaccctctttctcctggtgacccttgtccctccctgtgaccccgtgtctcctggtgactcgtttctcccagtgaccccattgtctcacagtgaccccgtgtctcccggtgaccccgtgtctcccggtgaccctcgtttctcccagtgacccttatgtcttctggtgaccccatgtctgctggtcctcgcagagaccttgggcctctgtttcctcatctgcataatggggacagcagtcagacctacccagagggctatcatggaccccaatctactcacagttcgtcagccagagatgaacgcgaacgtccacagaaataaatggatggacgcggcgttgaagctggagtatacacaatgcccgctgtggaagcagctcacagttgtcctccagcgatgggtgggtgcatggaccactgtggccgccgtacagtggagtggggttcagcccgagagaggagcgacacgctggcacgccgcagcaccatgctgtgtggaagagtcagacacgcaggaacagatgctgtccctctcctgtgcagagcacacggcagcaagtccagagggacggaaaggagttcagaggctgcagggcgcggcgggggaatgcgcggtgactgccgtgggcgcggaagggggaatgcgcggtgactgccgtgggcgcggagggcggaatgcgcggtgactgcc

SEQ ID NO: 471763 - DNA, 774 bp, Homo sapiens
tccggcgttcgcgtaactcccgtgtggggtcccgcctacatgcgtcccccctatgtgacagtgacagacatcgtaggaagctccggcagtgtcctgctgtgccacttctctctggtgccgccttatcacctaggctccatcaccctgcggccgtatcacccgggtggccatatcaccctgcggccgtatcaccctgcggccgtaatcacccgggcagcatcaccctgcggccgtaatcacccggtggccatatcacctaggctccatcacccagcggccgtatcaccctggcggcatcaccctgcggccgtaatcacctggtggccgtatcacctaggctccatcacccggcggccatatcaccctggtggcatcaccctgcggctgtatcaccctgcggccgtaatcacccgggcggcatcaccctgcggccgtaatcacctggtggccgtatcacctaggctccatcacccggcggccatatcaccctggtggcatcaccctgcggctgtatcaccctgcggccgtaatcacccgggcggcatcaccttgcggccgtaatcaccctgcggccgtatcaccctgcggcctccctagtgccaaaaaggttgggggccgctgattgtgaacgagctgaggcagtgcagcgtgtgaaagaacagcataatcacaaactcagaaacgagggggcagcctcggcaaagatttgcaaataagaacaaaaacctttcagaatgaagactaatgtagaaggaactcaagaataaaaacatc

SEQ ID NO: 471764 - DNA, 1103 bp, Homo sapiens
gtctggagggaggcctgagcataagctggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgacgaggccgcgggcgggcggtgccccgagtgccgcggtggggagggccggtagggga

SEQ ID NO: 471765 - DNA, 1774 bp, Homo sapiens
acagtgaacagggcctggggatcggaagccaccgaagccaaccatttacgtcagcttctgtgacacgcctgcagggacggggcatggagaatacagacctcgctgactgggatgttgaaggacaggtttttattcaaacacagaagacccctaaagtactgaactgtaaaaacctgtccaatagtaacaatctcaatgatggcagaatgaaatcagaatctgattggattaaaaaggagggaaagggtgtggctaaggtgggtggagacaccctctggtataaaagcccctggcaggcagctctcactccagatctgagctgtccgcagaagcagctggaggccaggggagaaactccagaaggagagacatttgccatggctgagcacttcaaacagatcattagatgtcctgtctgtctaaaagatcttgaagaagccgtgcaactgaaatgtggatatgcctgctgcctccagtgcctcaattcactccagaaggagcccgatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgacgttcgatgtggacacagccaacaactatctcatcatttctgaagacctgaggagtttccgaagtggggatttgagccagaataggaaggagcaagctgagaggttcgacactgccctgtgcgtcctgggcacccctcgcttcacttccggccgccattactgggaggtggacgtgggcaccagccaagtgtgggatgtgggcgtgtgcaaggaatctgtgaaccgacaggggaagattgtgctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatctacacattcatcgagattcctgtttgcgagccctggcgtccattttttgctcataaacgtggaagtcaagatgatcagagcatcctgagtatctgttctgtgatcaatccatccgctgccagtgccccagtttcttctgagggaaagtaaataaacatttgaacataatcatctttaggaagtttcagtgctcccatagccatagctaagaacttttccgctagatacacataggtacaaagggacagaagggaaagagccatcactctgtaaaccatgaacagaaagcaattatattaatgaggggaaaattacattgtacttaaagtttgtcatgttgttttctttggggcttatgtttatatttctgttcaataaatattttgaaaattcagattcatttgccaatcttttctattttctgcaagattagtttactatgtgttatggaagttatgaacgaaataataatttgaatgtgacccaacacagtaactgaatttcaaatgataaggacctatgaatacggcaaaattatatatgttcatgtattcagtttaacccaataactgaacactgacattcatttcaagtgcacactgagtgtttgccacgaatatgtgtggtcttagagagaactcgttagctttaaaattgaaatacaatacaccctctcctatgac

SEQ ID NO: 471766 - DNA, 1954 bp, Homo sapiens
accactgtctgaatagaagccagcggagctgctttctgtgaaaagatgcaattggaaaagatgtggaaagtatctaacagccaaaccaaccccaccagtattaaaaaggagggaaagggtgtggctaaggtgggtggagagaccctctcgtataaaagcccatggcaggcagctctcactccagatctgagctgtccgcagaagcagctggaggccaggggagaaactccagaaggagagacatttgccatggctgagcacttcaaacagatcattagatgtcctgtctgtctaaaagatcttgaagaagccgtgcaactgaaatgtggatatgcctgctgcctccagtgcctcaattcactccagagggagcccaatggggaaggtttactgtgccgtttctgctctgtggtctctcagaaggatgacatcaagcccaagtacaagctgagggcgctggtttccatcatcaaggaactagagcccaagctgaaatctgttctaacaatgaacccaaggatgaggaagtttcaagtggatatgacgttcgatgtggacacagccaacaactatctcatcatttctgaagacctgaggagtttccgaagtggggatttgagccagaataggaaggagcaagctgagaggttcgacactaccctgtgcgtcctgggcacccctcgcttcacttccggccgccattactgggaggtggacgtgggcaccagccaagtgtgggatgtgggcgtgtgcaaggaatctgtcaaccgacaggggaagattgagctttcttcagaacacggcttcttgactgtgggttgcagagaaggaaaggtctttgctgccagcactgtgcctatgactcctctctgggtgagtccccagttgcacagagtggggattttcctggatgtaggtatgaggtccattgccttttacaatgttagtgatgggtgccatatctacacattcatcgagattcctgtttgcgagccctggcgtccattttttgctcataaacgtggaagtcaagatgatcagagcatcctgagtatctgttctgtgatcaatccatccactgccagtgccccagtttcttctgagggaaagtaaataaacatttgaacataatcatctttaggaagtttcagtgcccccatagccatagctaagaacttttccgctagatacacataggtacaaagggacagaagggaaagagccatcactctgtaaaccatgaacagaaagcaattatattaatgaggggaaaattacattgtacttaaagtttgtcatgttgttttctttggggcttatgtttatatttctgttcaataaatattttgaaaattcagattcatttgccaatcttttctattttctgcaagattagtgtactgtgtgttatggaagttatgaacgaaataataatttgaatgttacccaacacagtaactgaatttcaaatgataaggacctatgaatacggcaaaattatatatgttcatgtattcagtttaacccaataactgaacactgacattcatttcaagtgcacactgagtgtttgccacgaatatgtgtggtcttagagagaactcgttagctttaaaattgaaatacaatacaccctctcctatgacggcaacagagtcaaattggaaatcaataacaggaagaaatccataaattctccacatatatgcaaattaaataaccacttctaaataaaatgatcaaatatgaaattacaatggaaattacagctatcctgagttgaatgaaaagcacacatttacaaaatttctagatgcggttgaagctcagtgagaaactcataataggaagaaaatatcgtaatcaatcaccttaatttctacttgaacttacttcactaagagcaattgaaattgtcagcattttgatcaaaaccatctgacaagtatctggg

SEQ ID NO: 471767 - DNA, 2618 bp, Homo sapiens
gaagccagttccatgtcgtgtcagcacagggctcttggggcggggctagcgtagcgtgggaggtgacaggtgtgggcaccccggtgtgggcgtggcccgcaaatgcggtggggacggggccgtgggcggggcatcacagtaggtgtggcctgtctcacgttccgcccctccccacgcagcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagaggggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttggacacgtggttgcctcctccttgcattcctttatcagcaaaaaaacaaaaacaaaaacctcac

SEQ ID NO: 471768 - DNA, 797 bp, Homo sapiens
tcctgggagcctggagcttaccagagatgggggcccagggaccaaccccatcctgcgcctacttgtcctgcttcgccccgtccccacctatccacagacaatacgccctctcagcccagaaccgcttccctttcagacttggttccgcccctcacgccaggaccacgcccctccgattccgggcccgccccaatccttggtttctggtcccggccccgcccctccgcagacctggccccgccccgccccccgcgtctcggtttcccgggcctgcgcgcgcggctcccgtcactcgaacgcgcgacggcggggggaagatggcggagtccggcggtagcagcggtggtgctggtggcggcggcgctttcggcgcgggcccgggccccgagcgcccgaacagccccggggacatcctgatctgctttcactctctgtagctttgccttttctagaaatttcgtaagaatggaatcagacatgtggcctttacgtctggtttctttccttaacataatgtttttgaagttcatctgtgttgttgtatcagaaatttgttctttttcactgtggagtgaaaataaacaaactgtgtccgtccatacaatctcgtatggacggacacagtttgtttatccattaactggttgatggactgttgggttgtttccattttgacaactgcaaataaagttgctgtgaacatctggatatgtgtctctgtgtggacgtatattttcatcctcttgggtaaatacttaagagtagaatgactagttcatatggtagatgtgtttaaa

SEQ ID NO: 471769 - DNA, 1079 bp, Homo sapiens
agggacatctgggccctcagtgtccctctgtgtctttcagcccagggggcggtctcatcatcatcgacagcatgccagacatccgcaagaggaaacctatcccactcgtgagcgacttgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctgggtgagagaagctgggaggagtttggtcgaggagcataatctgatgggggaggcagggtctaggagcccagtttgatgggagcaggaagcacccaggccaggagggtgagcagagcccaggaacctctt

SEQ ID NO: 471770 - DNA, 2977 bp, Homo sapiens
gataggtccggaaggatccacgtggactccccctacctcccaccctcacccccacacccctgtcaccctcgggctggatctccggggcctgcttcaaacggcctgggaggacccccatcaccaccctaggaaggaaaactgcagcccatggctaacctgtccccattggcacttccttgcagctgctgggatggaggcagcctggacttccggccgggctccccaccaccccatctcctgggccatttcccaggtacccctgatggccgggggccctgggagcacccccttgtccaggaggctggggagggcatcctatctgagcggagattcgaggactcagtcattgtgagaaccatgaaaccccacgctgagctagagggctctagaaggttcttacaccaccggggggaaccaaggcttttggagaaacatgcccagggccgccccaggttcgactggctccaagatgaggacgagcagggatccccccaggacgcagggctgcacttggacctgcctgcccagccgccacccctcgcccccttcaggagggtgtttgtgccagtggaagacaccccgaagacgctggacatggcggtggtgggtggcagagaagatctggaggacctggaggggctggcccagccgtccgagtggggcctacccacgtcagcctcggaggtagccacacagacctggacagtgaactcggaggcttctgtggagcggctgcagccgctactgcccccgatccggaccgggccctacctgtgtgagctgctggaggaggtggccgaaggggtggccagcccagatgaggacgaggacgaggagccggccgtgttcccatgcatcgagtgcagcatctacttcaagcagaaggagcacctcctggagcacatgagccagcaccgccgagccccgggccaggagccccctgcggacctggccccgctggcctgcggggagtgtggctgggcctttgctgaccccactgccctggagcagcaccggcagctgcatcaggcctcccgggagaagatcattgaggagatccaaaagctgaagcaagttccaggagacgagggccgggaggcacggctgcagtgccctaagtgtgtctttggcaccaattcatccagggcctatgtgcagcatgccaagctgcacatgcgtgagcccccaggccagaccaccaaagagccttttggaggcagcagcggggctggcagccccagccctgaggccagcgccctcctctatcagccctacggagctgccgttggcctcagcgcctgtgtcttctgtggtttccccgcgcccagcgagagcctgctcagggagcacgtgaggctggtgcatgcccatccccactgggaggaggatggcgaggcttatgaggaagaccctgccagccagccaggcactagccaggatgctcacgcctgcttccctgacactgctgtggactactttggcaaagctgagccgtccttggcccccatgtggcgggagaaccctgctggatacgaccccagcctggcctttggcccaggatgccagcagctgagcatcagagatttcccgctgtcaaagccactcctgcatggcacgggccagaggcctctcggaaggctggcctttccctccacactagcatccaccccctactccttacagctcgggagaaacaaaagcaccgtccacccacaagggctgggggaacggaggcgcccttggagcgaagaggaggaggaggaggaggaggaggaggatgtagtgctgacctccgagatggatttttcccctgaaaatggggtcttttcacccctagccacccccagcctcatcccgcaggcggccctggagctgaagcaggcattccgagaggccctgcaggcagtagaggccacccaggggcagcagcagcagctccgagggatggtacccattgtgctcgtggcgaagctggggccgcaggtcatggcggcagccagggtgcccccaaggttgcagcccgaggagctggggctggcaggcgcccaccccctggacttcctgctcctggacgcgccgctgggcggcccgctggggctggacacactcctggatggggatccggccatggcactgaagcacgaggagcggaaatgcccctactgccccgatcgcttccacaacggcatcggcttggccaaccacgtccggggccacctgaaccgcgtgggcgtcagctacaatgtgcgccatttcatctccgctgaggaggtgaaggccattgagcgcaggttctccttccagaagaagaagaaaaaagtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatggggcccagagcattggaggggcggggctggaggggcagccgctcagctttcctggaagcattttgagtcactttacaaagtatgttgatgactttccttacaaccaccctgctatttagattctttgctgttaatgacatcttctatcttgagaagcattgttgtatagaactttctgagatgatggctggaaatattctctagatatctgcacgtcttacagggacaccattggtcatgtatggctgttaagaagttgaaatgaagctagtgccaggctagtggggatcctattggatagtgcagatctagagtctagattttctttttttt

SEQ ID NO: 471771 - DNA, 639 bp, Homo sapiens
tgcagccctcggaatgagtgagactctgcccaatcgacgcgatcgtcttccccagaagacccccgcctccctcccgccggcggccgcggaggcggaagaaggcgcctttcccctttgcctgggcccctccggtcactcggacaaccgctacccgttccggtcaaccatcaacccgtcccccgtcaccccggcaaccatcgccggacccacctacccctggacgccgtcctggtcctgtccgcaggcctcctcgccccaaacctccgccgcgggctccgacgtccgcgaccccacgtctcaggggctccctcctcctcctgcccgtcttctcgcctccccggggcggggggcattgctcctcccctggcaggggggccccgggttggacccggctctgggggtccctgctcggtcgggacagtgggaccgccctgtgctgtggccgcgcgcagccccccgcaggcttcggcgctcgcactcttgcgtgggactgtccaaccgccacagggagctcttcaaaatgcaagccatgtcccttccctgctgaaaaccctcccctggctccccttgagaatcgaatccaagctcctcgcagcccctggcgatctggctgtgtggcctcttctctgaagcctcctc

SEQ ID NO: 471772 - DNA, 552 bp, Homo sapiens
ctccctctgttcctgtggaaagaatggggaccctgagaggcctggagcccagccctggaggaacttccagtctggggaagaaaaagctagacgcacacacacccagtgtggagggctcagggctgggccagagaaaggcatggaatctgggaagggcctggggtacacgggtggtgggccctgggctccggaccacagcaaccttccatgcccatggcctcaccctggatcttatctcctcttgctcacctctgaactgtgatattctgatgtcccctaactcagtggcctccaacctctttggcaccagggactggttttgtgaaagacaatttttccacggaccgggatgttcttgtcctccagtttccggtgggtttggacaactggaggcactagcagaagatcttaagagcctctctgccccacaatacaccgatgcttgctgggctatttttgtctttagcccataacatgcttctaagtccctaccccgggatccagcgccgtcagactgaatatatcccaaacctgcctctgtaccttctcagc

SEQ ID NO: 471773 - DNA, 1402 bp, Homo sapiens
gtgtggttcgggtttccttccagcatggtggtcttgggtcccagtggtttgttctagtttatctgcctcctcgtccagactgggtctccaccaagtgatcaagtgatgcttgtctatgttgttcactgctgaatattcaggcctgatacgctgtgcttttggtacctggtgggttaaccacccgcaggcacatacagacccattcgttgaaagacaaaatgcaggtggagggaccggtcaggtttgggcagagctcagcacttctgtggcagtcatggacagtgacaccacagtgaggtgtaagccacaggtggagaaggctttccacttgccccgagtagaagggatcttaaagactgtccagaaaatgcggatgtacgagagaaggatgcaggagaatgggctggtgcccacgacaatgccaaaagcaaagatcaccagctcgttggtgtgcgtgtctgagccggagagcttcagcaggggcatgaggtcacagaagaagtgggagatttcagagccggcgcagaagcagcagcccacagacaggggagcacatgagaaccaagtaacgctgtgggtggacaatggccacgaagcggtcgatggccattactgccaggagaaagctgtccatggtcccgaacaggtggaaggcatacatctggaggatgctggtgcttctagcccagggaccacacttggggagctgctgcattggagaaacttgtttctcaagacctctcctatctgtgcaggtgtcctgcagctgcagaccctcagtgcttttcctccacatatcctgccacagagggtctgccgatggcatcaccaaggggagggtcccgggaagcctccttctccaccaactgctagaggatcccgaggtcagcactaaacccctaggaagggcatgggggctactcacctgtgatcgctggggttagcctgatgtctatgggaaggattcatatgtgtacccccccgcccccagactctgcaggtgtgaggtgatacgtcattgacatcaaaattagtattgatagcaaaattggaatttttggaaagatattaggataggggttgtcaaaccttctctgtaaggggccaaatagtaaatagtttcagctttgtgggccatatgctgtctgttctaactactcaactctaccattgtaggttgaaggcagccgtagccagtatgtaagtgaataaacatgcctgtgtgccagcaaagctttgttgataaaaacaaactgcagactggatctggtgagtgagacacagttttctgaccctcatgtttggagactcccagaatcattgggtgtttggaccgcaggttggcatgtaagtaagtgtatagagctcagtgcatgcatcaccccagatctcttggcccttc

SEQ ID NO: 471774 - DNA, 636 bp, Homo sapiens
gaaatgtccgtggcttcacctctacccagcagatccctgacaagaatgtctcttgtggttcaccctaaccagaaaacacaggcatctagggaaaaagattctgggaagtgtagtttaacctggccaagtacctacgaggctagtgactggacactggaatggtacagccaaaaaaactcaacactttcaccatcctatgagctcacagcaaacagcaaatggcacagaaagatggtctcttttggtcttccaagtcttctgcgagggcctctaattcgcagagctgaatccacacccaaaaccacatctttgagcgcatctgggaaacatataaaaactctggacgccaaggctcgagtgggtttccctgattggcaacactctgcgtgtactgtcccacatgggtgcccgcagaagacagcgctgggaggagacagctggaagctttgcacttgggacattcctggatgcttccgcatgtgtctctgtcctcggctggctttcatctgtttcctttcactataataaaccctaactgtgagtctgagagcattcgagcccactaaactgatttagtaacccatgaatgggctatgacctgaagttgtgaaacactgttatgtaagccctgtgacc

SEQ ID NO: 471775 - DNA, 757 bp, Homo sapiens
gttacctggcacacaggtatcctcacctgcatgacatgatcagatcatgcactttctatgccagggccagtgccagggcaagcttgtatcttcagctttggggacactgtggggcgggtggtggctggaggccagggaagtcaccaggctggagagggttgatgtcagacatctcccaggccagggccctagagctcctggacagggagtttgcaggaacagtgatgcagcatacaacacagcacaactcgacacaacacaatctgccacagcagagcagcgtgcggtgcactgggctgcagcagagcatggcccagggtccagggagtcatgacacaccatataaacgtatcttaggtgatgactgtgacgcaaacctcacaatacccctgcagttcaagaaaggtcatggcaaccgctgatcagctttatgtcagtatagattaatttgcttcatgtaaattcaatcatacagtatggaatgttattatttcttcagagagtgttgtccttctggttcatctgtgtcatgtgtatgaatagtttataccttttttgaatgttaaatttaaaaaactacatacggtgatactcactatttttgatatcttggaggaacagctttgtacttttccctattcactatgatgtgaataggctgtgggcttgccatacatcgatttattgtgttgggctacattccttctatactcagtttgttaagagtttttaccatgaaggactgttgaattttatc

SEQ ID NO: 471776 - DNA, 536 bp, Homo sapiens
ccctcctgctcccccagaatctccccttgcctcctcaactacatctcctgtggcgtccccatctattgcctcctgattgtggccatggcaggaggagatgattttcaccggtatctccttgtgggcctcaagggagccgctcaaaaacccataaatctgtctgagacaactgaagttgtccaggggcctgatgaacctggaacacttttagaaagtctccaggaggcctatcaaacttacaccccttttgacccggcagctcccaagaatagccgtgctattaatttggtgtttgtggctcaggcagctactgatagtaaaagaaaattacaaaagccggagggatttgctggaatgaacaatagccagcttttagaagtagcccagaaagtttttgacaatcgagagtctgaaaaacgaaaacaggcagctgaggcagctgaaaaagctgctgataaagcatccaaaagacaagcaaaaatcttagtggtggccatccaggaagccaaaaagtaagggcccccatcacagaggaa

SEQ ID NO: 471777 - DNA, 936 bp, Homo sapiens
ctgactgtcaatatgccttccatatcctgcaccaccatgctcctgctgcatttggggggcattgctttgccctatgaactcaattctctgaagaatttaagaagggctattgattttcagtttgttcaaccttttgttgttgtgaggatgggagtaacaagctctttacatgctggaatggaaaccagaagtctagatctatattttctatttctcgttatcaagttctctttcccctatacttttgtcaatatctccttttcatgtggaaattttcagaagctttcacaagccaagctggagcttctatcccagggctacataatagaggccaggtaccagacagctagggatgacccctattccctgaaacctgtgaaattgttcaaactcatcaatccacagggagcctgaaacctaactagctccactaaccctgcttgccatacataagcagccctctacagttattccttactgttaccctgtccctgggtgcaaccccctgcatacccttgcctgacagccttctcccctttggagctgattttacccttccaagcccctcgagttctgtttctaaccagtcacataaataatgactaattgtcaatgagtaattttgtatagtactattatttttactaaaataaatttttaagggagaagtaaagctgcaaataattaagcaatttgtttatacattgggatccaccaccttccagaaagtcacattcttctcagtgtaagtgttgtgtcaaaaataaaaacgagttacaaagcaaaattaaattatatatatttacatacatatgtatatatatgtaaatatataaatgaatatatataaatatattcatttatatatttatatatttacatatatatatatatatatatatatatatatatatatatatatatgtatatatattt

SEQ ID NO: 471778 - DNA, 642 bp, Homo sapiens
aaactatcgcccgaggttacttagaagatggaaagtatttctgatgaactgttgtatttggataagggaacctccagacataatgctggctgctcatgtggctgagtatgataatgcataccaagagtgggagattctgagtggggagggaatttgtgttggtgtaagtgtgtgccccacaagggaaggacctgcccaacacaccgtgtgctttgccctcagcaaggagccacagctgcaggtggatttccacaccgggatggatgaggactcagacatcgctttccatttccgagtgcactttggtcattgtgtggccatgaacagccatgagtggggggtctggaagtgtgaggtgaaatctgacaatatgccctttgagggtggccaatcatttgacctgcgcatctgagtgctggacaaggaggaccagggtgctgtattaagctttctaatcaactcttttgtaattatcaacctaccaatacttacattggaggatacttgcaaagacataaaataattggttgaaaattgtgtgaaaaatcttaaaatttcataaattaatacctttaagatgactttcttcatagctacagcaatacagattatattgaaattttctcaccttctctaacgggt

SEQ ID NO: 471779 - DNA, 784 bp, Homo sapiens
tgttgcgcctcatgtcctacttccatgaaactgatgctggctgcctgtgctggaggacttccctataccttcccagctgcctgagaggaagcgatgacctaggccaggctttccacagctataagccccgactccccacttctagtaggtcacacaacagtatcctcaccagcttcccgggcctacccaaaatcagcgtcagcatcaagacaagtggttctccactgggtgcacccaagagtcaaccagggagctttaaatctccagggataggacctgggcttcacattatttttagaaaggccctgggggattctaacacaaagctagggacatattcacctaggtcagctctgtgctacctgatctatctgagcaggaagcagacaactgggcagctctgacccacacccaaggtctccctggagaactggaggaagtactaagctgggggttgtcggcttggcctctggatttcccaggtcttagagtcagaggttggccctgccagtcatttgctggggaacctgggggcatggcggctactcttctctgagcctcagtttcctcctttggaaaacgggtttaataaccacctcttcctacctcataaggtgagaacagtgagagcaggtgtatgagacacaggcacgggtcctggcacactgtttaaagtgccaagaactgttagctactatcattgttactgccctggctccaggcctggtgttggcagtggcatctcacccctggttttctgcctgcttctctggctgctctaggt

SEQ ID NO: 471780 - DNA, 1203 bp, Homo sapiens
agccagtgcctctcaagagcagggcttgggggctcggccacaacccagcgctattccctccccagccctcctgcctgttcacacctgcactggggccaggtcttctccaccctcaatgtacccctgggcaggccccgggccttgctggctcacccctgacaacacagggtgccctgtgactgcagccgtgaaaccatctccaagtggcagtgggtgtgtgggctccgcaatggtggtttctgacctttccagggctggcagaaggatggggaggaggaagacaagggacgggagcaacctccgctggctggcactggaggactcaggcagtggcctcaactccaaggactcctcctggggagtgtggtggggacactgggggtccctccctgaggcacaggggatgtggccctggccggctgcgcagcttccttctctcaaccctggaaatccagccagctgttcagctccccggtggggccacttgagcctcccaggaggacctaaggaagatttctaacctctctggatgctctctcaggttccaggtcccccatcatcagcctctctctgtgtggcctcctggcagctccggtcaccaggtttcgggggggacaacgagggggtctcagcctatcaccacctccctccaaagatgccatctccctcctttttgcgtgtgatcgcttcacccatgggagattcacacctacttgctctgcccgatggagagggtgccagctgctgcaccccccacagtcttctcccacctcctctctctgcctttctcccaccccacctagatggcaccaagcggcagccccagatgcatctcccgttctatgacagccccgttccctgggcttctgagatgtatggaaaatgctccaacatcctcctcacccccactcccacgatcacccacaccctgatggcttttcatcttccccacccctgggcttttgcttatacagactgggctgggctgggagatagctggggacagcaaagcccatgaagctgcctcttattccctcttataaacctgggggaggagggagactccagctcttcatggctctctttcgactgtgaggttttcagtttttctgttctctgccttggggtggcggtgcccattctgaagttgcaggattccatggcacctttgtcccctttctgagccatgaacacccctacctg

SEQ ID NO: 471781 - DNA, 489 bp, Homo sapiens
catacagccggccggatcatgtggcagtcaggtggcgaccactatctagcccaacgagcgcgcccgctgccctcagaccccatccaccccacggaccccacagacgctgagccgactgagccgcagcccacagatgccctcgcagccctttcgcgcttcccagtggagctgggctccaagagggatctagacacccaggtgggccgtctgcaccacctggctgtggctgggggcccaggatggggcccggccaggctcctgcggagaggtgagggcctggctgcaggtacatctgtggcggcaggatcaaggagctgtatggagggtgtggcttcagttggccagtcagcagtggtaccgaacaccgactgtgtcccgagctctgtggtccctgatggggctttaagggtgaacatgacccttggaccattgggaatgaaatgcagtgggatgaggatgagaccctagacagtatggcctttcaggtgg

SEQ ID NO: 471782 - DNA, 1538 bp, Homo sapiens
gactttggagaaaatgttccctcagggttatggtaatataagaggagactcccacctccacaccccatgtacttcttcctctccaacctgtcctttgcggacatctgtttcatctctactacaatcccaaagatgctcgtaaacatccagacacagagcagagtcatcacttatgcaggctgcatcacccagatgtgcttttttgtactcttagaagcactggacagcttactcctgaccgtgatggcctatgaccagtttgtggccatctgtcaccccctgcactacatggtcatcatgagcccctggttctgtggactgctggttctggcatcctggatcatcatgagcccctggctctgtggactgctggttctggcattctggattatcagtgatctggattcctcattacatagcttgatggtgctgtcactgcccttctgcacagatttccaaattccacattttgtctatgaacttaatcaggtcatccgccttgccggttctgatacctttcttaatgacatggcgatgtattttgcagtagggccactgggtggagttcccctcgctgggatcctgtacttgtactgtaagatagttttctccatacgtgcaatctcatcagctcaggggaagtacaaggcattttccacctgtgcatctcatctctcagttgtctccttattttatggtaggagcctaggggtgtactttagttctgctcctacccaaaactctcactcaggtgctgcagcttcagtgatgtacactgtggtcacccccatgctgaaccccttcatctgcagtctgaggaataaagacataaagagagctctgaatcaattcatcagggtagtgccattcttcaggaagtgacagtgatcccagagctctaagccttggactgagaaattgtgatttgtgaaccagattctggaaggaccagtgcttgactccttcctgctgtcttgtctggcgacagagtttcagtctccaccatcaaccattcagagaagaatttgaattcccacacagagactttcctctgagagatcccatccaggtctttgcgactatatttatccacattgaaatcattaaattactgctatttcgtgtctcgtttcggttcattactgatgcttcttttgattttatttaatatattgttattttgaaaccactatatttaaactgattttattctcttgccattcttttcatctcattacttctcattttcttaaaacgtgtttctatacgatgcacatgtattcacatacatttgtgaaaacacaaaagtgaacaaagcaagttaagtccccactcatttatatttggcatgagaatggtgaagacagaatacaatgaaataaatgtgtgtatgacacgatgtcctcagggattaattgcatgaagaaggcatttcagtgtaaaaggacttgtcacagtgtgcacagaattttacgtaataatatcagcgaagcctttgcatgttgcaaaaagaccagaaccagaactagagcgtgccc

SEQ ID NO: 471783 - DNA, 1930 bp, Homo sapiens
ggctgtctctctctcgttgtcactctttctaccttacacgtatgttacaggaaaaggctacaatggctgaagctaggcagcaaagtgggagagtgaggataggtcttgctgtaccccaagccctatttctgtccccatgggcactcacctgtgatgcctgccatctgaaggcagtagtgattatcctctgggcatggaagggggccacagctgtggaggtctcagcaggtgaagcagtcggtggtctcagctttggtgtgggtcacagttgcatgaggacctggggacagaggaagatgaactggatggaagacaaccagtgtgcatgcacgtgcatggagctgagtttccaggcacatcagtatgtgcccatgagtgcgcaaaagtgccttttgtgcgcacttctgcaagaatgccatttgtgtgtgcaagtttgcaggcctgttaagtctgtgtgcacatctggctgtgccttcctgtgttgaattgtctgtgtgtttctgaaactgtctgcaggaggtcagggatgtgtgtttttgtagctctgcaggacactgtgtgagtaggtgtttacctgcgtgtctgtataaacaaaggcgtgtgtttatgtgtatgtgtataaggctggttttatgggtatgtgtgtgtttctgtggctgggtgtgtctgtgtttccatcaaggtgtgggggtgcttgtatatatatatatgttggtatacagatgtgaacgttcatggatgttggtaatgtatttcagcttgcctgtgtatattttgtgcttttgtatgtttgtgggtgtttatgcctgtctctttcccatgtcatatatatgaaagcctgtgtgtccatgcatagatatgttctgtgtctgtgtccacagggatcatgtgtgcaaaaattccgcgtcccacatttctgttgttagtcttcctattttgccctttttctttccatcttgtaaatttcgagctcccaagaaatgtggacaccctgggaacacataggtttgaaaagagcataggggatccagggaggtaagaaaggttgggtttttaggaaggcaggggtcaaagcacctggatgtgtaggagtaaggcagttgcattcaggcttagcggtgagatgaaatccagagtcttctggacccagggtggcattctcatgtaagttgcagacctctggtgtagcacagcccttcagaatttggggaccccctgtggaaatgagatgagattgcaacaagaggctcagagtccaagccttccaacttgatgtctatctttcgctatctgaaagttgccatcttagtagttctatatgattcagtttcaaatctacctggtcagtttttacaacctcttgttgcctgctcacatttgtgattctaagtttattccttcagacatatcacgtgccggtacgctatgttctacagctgataattacaatagctgagctcctcacaggtctgtatctgtgatttgttatttctgctatcactcatggtggcttgtttccttgtgcgtttcatgaactatgattgtgagctcatatttggttgatattcatctgtgggaatcctgggagcttttccctgggaaggaattgcttttgattctactgagtgccaggaggtgctactgaccagggatcattttggcttctgtccgaggtcccttgcttatgtgggaatctaaattccagaagcatgctgccagcccaagacctgtttacctaaagcaggttattatcagcatttgctcccaggccaccatgccttccatgttttctcactgctcccattatgatttctgttcacatttttgttttgcttagggacacgtggacattttcttaactttctgcaaccccaaaaagtgtggaaaaatatttctgtacaggatcttgtttatctgtaaacagtggcat

SEQ ID NO: 471784 - DNA, 970 bp, Homo sapiens
tgaagtctggctgctcttcccccttaatttgtgccctcatgaagaagttctcattgcaagtgcgaaggatgcagcgagagatcaaacttgggcctgtagccccgcagcttgacgctctgctggttaataagcagacccttgcgcacttcgctgagcctgtggtcggtgacctcgcgctggcgcagcagctgtcgcacccgcccgttaatctggtgctgcgcgcggccgaggcgggcggcggtgaggcgcgctccacgcgcgtgcgcgtgcaccacctcggtggtctgcagggcgcgcgctttgcgcgtgacgccctcgcctggcggcggcttctccaaggtgccgccgcctttgatcatctccacgcggaagcgccagggctggatgtaggcggcgcggccgaggtggtgggccacgttcgggtccagcacgctgtccttgggctgccacatggtcaccgcctcctgcccgcagcgatcggtcagaatgtgcgcggtcctcgccatggcctgagctgcctcgcgccatgctggggccccaacgcgtgtgtcctggctgcgctcagccggggcaacatggcccttcttccagctttaggatgtcctaagcgcttccagctgtccaggtcacactctgtcgcatgtcgcacatggcccttctttcagcttcagggtgtccgaagcgccttcacacttggaagcttgggacttgctgttcccacagtgattcacctgcgtgtgtctgaacagaaacagtgatgttcaaaaaatctacagaaacattatgtacacaagaccgaggactaggaaaatttttcagtactctccaagcctaaatacctctcttaaactaacaaataagctatgaaagcaaggtaattatcagagacccctttttaggttccccgatgtcttcccttctgggacaccaggttctacttttagtaggtgcccctctttctcttggagat

SEQ ID NO: 471785 - DNA, 505 bp, Homo sapiens
ttcatttgcacgtatagaccacattttgtttattcattcacgatggatggacactgggcttgtttccaacttttagctattataaataatgctgctatgaacaaacacaggcaaatatctgctggggtccctgctttccattctttttggaatacaccaaaagctgaattgctgcattttgtgttccctacggataaacatcagggtcgttcctggtctgtggccatcaaaaacactgctgtgactagtctagaatgggtgccatttcatgcatttgcaattcccagaagtacactggttagtcagcaggtgagtgcattggtgagaggatgtgactccagtctcaggaaatacggaaaccttcttccctttctagctgcagcacccccagtctggacagcatatggaaagcacccatgatcatttgaaaatcacaaaataactctaaatttctgcacaaggccagtgagtcctaacatgtttgaacatctacccatgctattta

SEQ ID NO: 471786 - DNA, 558 bp, Homo sapiens
gtatgttaccatcatcaaagaccaaaggtagacaaaaaccacaaagatggggagaaaccagagcagaaaagctgaaaattctaaaaatcagagtgcctcttctcctccaaaggaacgcagctcctcaccatcagtggaacaaagctggatggagaatgactttgatgaaataaatagtgtagagaagtccttaaatgacctgatggagcttaaaaccatagcacaagaactacgtgatgcatgcacaagcttcaatagcagatttgataaagtggaagaaagggtatcagagattgaagatcaaatgaatgaaatgaagcgagaagagaagtttagagaaaaaagattaaaaagaaatgaacaaagcctccaagaaatatgggactatgtgaaaagaccaaatctacgtctgattggtgtacctgaaagtgacggggagaatggaaccaagttggaaaaccctcttcaggatattatccaggagaatttccccaacctagcaagtcaggccaacattgaaattcaggaaatacagagaacgccataaagatactcctc

SEQ ID NO: 471787 - DNA, 539 bp, Homo sapiens
aggagccggagggtggggcagatggggcgcttccggaaccctccccgactcgcgagtgggcggcgccggcggcggagcgtggggcgcgctccctggattttccctgattattatgttaactgcttggagagttagtcttgttctcaccctcacactctgtgtcttacaattttttccctatggcactgttggaggtgcagacatgaggtcgattatattcaagaatcatgcttggggaagggaggagaaacaagataaaggggctttgactcaggactccttcagtccactatcacaagaaaaaggagatttccaaagtattcagaccagatctctaattcagtgggtacatgtgcaggtttgctacaagggtaaactgtatgatgctaagggtttgacttctattgatccgatcatccagacagtgaacgtagtacccaataggaattcagttcttgtcctcattcctccctccctccttttggattctacagggtgtgttgttcccatctttatgtccatctgtatctaagatttgg

SEQ ID NO: 471788 - DNA, 665 bp, Homo sapiens
cggccaaaaggatgataacacctaacacatggggttcttaacagtcctgtccccaggcgttcccttctgctgttagtgaggctgaagctaacattctgagcctctgagggggatgatgacagcagctacgtctttgggtgatgagtgttatggctgcagaggaccttgcgagggcggggctgagtggccaggacacctagcaactagtctcaataacccattcattttctttgtggatagctctggaggagaaatctacagccctgcccagctgtgctctctgtttctgaccctgcagccctggtttagactcagtcgaacatttacccattatgttctagacctgtgtgatggtgcatctcccctccccctccatcacattttggagcacatggaagcttttccaagactatttcagcttgccagtttccttctaagttcaatagagctaaggagccctgaggctgaagtagccagggaagtctttccaagagagatggagcttgaactgtggcttggaggaattgtacctatctggactctgagtttgtgttttaccatttgcaactgaaccacttggcttaagcagaggaatatttggtttatgtaactaaaaatttaggggcttcaggcatgtctgaatccaggacctcaaatgaaataaa

SEQ ID NO: 471789 - DNA, 452 bp, Homo sapiens
agccgcgacaccatgaaatatgtatggcttccttctctgttcatcccctctccgtcagatctcccctgggaacacagaattattatccctgaatcacatgagacctttccattctccaaagctatggagaaagctacctcaaatgtcaatgtccgcatatccagtaaaagcaactggactgtagaggagatgaaagccagtctgtcgtccagcaccccagacaagactgggctcagggtccttcaggagtggctgggatcaagagaattcttagaagtctgcagtagtacaccagcaggttaccttccccacccactggtccccagaggaggacactcagtaggacagcttgcttctagcaaagcccaagatggcttttctctaaaaacattgaaaagatacatggtggatgcaaaagcatttggggtggacaatggcagcccagcgtgaca

SEQ ID NO: 471790 - DNA, 733 bp, Homo sapiens
gacgcacccatcatctgagcacccattcgtaaaaggccctcatgactaagcctcatgccaaaaaactcattacaaaagagctagggtcccagatagcgccaaagcttcatgagacctctcctcatctgtgcgcggatgagtggccgactctggagcccaggttgtttcttcccagtctggaaaccaccgagcaagtcctgcagatagggaaggaaacctcccccacccaatggggcaaatcctttaaagaactaagcccagaggatcagaaacatgcttggtttactgatgcatccaccaaatacattggtgggaatcaatgctggaaggctgtggcttataatcctattaaaaacaaaagcatttctgatgaaggaaggggtgggagcagccagttagctgaactagtagcggttcccctgagctattcagaaggagaccagagggatttttcacttctataccaactcttggtcaataccaaatggtcttactacctggatgccccaggcaacaaagcaaatggttaattgggaataaagagggaataggttacttttgtagtttccccataagtgacccgccttctttctctcttacttcccttacgtgactaccttatctaaaaagttttaagtatttagccaatcgggactggtttagactgtgcggtccaaccctaaccaataggggaaagatacagaagtagaagctgtgtcagagataataaaaa

SEQ ID NO: 471791 - DNA, 654 bp, Homo sapiens
ctgatcatacattctatttactgagataggagaaaatcaccttatggctggagcccagtcacaaagggcccttgtgactgagcctcatgccaaacaacttgttacaaaaagagctagggtccaagaccgcaccaaggcttcaagagacctctcctcgtttgtgcatggacgggtgaccgcctccggagcccaggctgtttcttcctgctgtggtgacaaatcctccatagtatgggaaaatcccactcgtctgggctgcccgaattcctcagagcaagcaggaggaaaggctaagtctgctgattcacagaggatgcagcctcttctccccctaggggctcaggcccagggagatcacagttctgtccctgagcccctggctggagctgttggagttcctgctgggaggccctgcccagatatggggcatcaggtactcaagagtggcagcaggaaacataagcatggaagagtccaggcactgggcacaggagatctcccacaagaggtgtccaaatataccaaggggaacctggaagtaacatgaggtgttggggtgatcagacccaacaccaggtcgtgggggtgacgaagtccgttggagtcaaaggactgagaaaaagacagtttgagagagaaagtgggaccaggggg

SEQ ID NO: 471792 - DNA, 1648 bp, Homo sapiens
gctgccaacatgctgtcaggaggcttcgaggccatgcccggtatgctgcccacctccttgagaccccttcctgacactttccagccggtgctacagccgcagcacgtgccaccactgaatacctttcagcagccggtgcaggcttcagacggcaggcgtgcccgacagccgtggcctcagcagctctttcgtggcaaccaggacagtcagggcagtgatgaagtgatgatgcctaggacgacaacacaggtagagcacgatctgcgggatgagctacacggccggccgcccagtgctggcgcagtgccacgtcctccagcacttcctgatgtgcctcagcagcaccgagagaaggcctggaaacaaggcaagaggaaggccttctgtatggcacagcacctcttgaggaaagaaaataagaaaactgcctccgatccaagcagagcaggtcagcgagaaggtgggcatcacttgggggagtggatgtgggtatcgaagacgaacactggatacgtggcctggtcatgggaggaggtggagagcatgattgacagcttcatatgctttctcaagaaggtggatgacggcgctgctgctcagccacagggcatggagttcacggcaagcagcccatcaaccttcactggaggtgcctacaataccatcgtcaagctcttcccagattggcccaggcaggacctggattctgtctgggacctgttactgctgtccaagcagcaacgcatcaaattcccagacatcctccacgttcacagaggagctcttaccaaagtcacggggagcaggagactcgtgggaggaggaatgatggaggtgcgggggctgatggcccaagccaggcccccactgattgggtccaatcatcagtcagccagtggccagagctgcaccgaccaggtccccgctgatgagttacttactaaccaagctcctggaaaccaggtttctgctgacaagaacctgctgaaaggtgttcgctgagtaggtcagtcctaaccagatcatccatgatcaggtccccactgatcatgtttccactgaccaggcccaaaaggactaggccccagtgaccaggcccatcactgagcaggcgctgctgacatagaacaggcccccactgtcaggcccccactgactaggccacaatgactatgtctcagctgaccaggccctgatgattaggtttaatggacaaaaccctcgttgaccaggtcccactggccaggtccccactgaccaggtccccatagatgagactctgagttaccaggaccccactgaccagacatctacagactaggccccaataaccaagacccactgaccaggccctcactcactgggctccaactgatgagattctgactgaccaggtccttagtgaccagactaggtcacttattgactaggccccactacccaggaccccaattaccaagcccccactaaccaggtcccaagtcaccagacccccactaactgtcccaactgacaaggcccccactgccgaggcttccactgaccaggtccacactgaccaggcctcgagagatgaggcccgacttaccaagaacccactgaccagagagacctccactgactgggcccaactgacaagggccccacc

SEQ ID NO: 471793 - DNA, 873 bp, Homo sapiens
gaatgggtatacttggggacagcacccaccccctggagtcaccacgaggatgaacaagacaaccgtgtacatggtcagcacagaacaagcactggtgagtgcccaggaatgaccctctttggcagctgcccagagaccagcatcacccaccaggcagtgactgtccccaagtcagcagggaaggaagagagcaggtcatgctcttgagtctgatctggcagctgttcggagatgtgcctcttgcctagaaaagagccctacgtgcccagcactcacagacactggcgtgcctctgactgctccgtgacacagaggcaggcagcatcccgcgtgggtgaacatctgtgtgagtgtgtgtgtcacactcacgtgcacacccacgtcctcatcactgtcaccctagggcccatggtcagcatcagagcatccatgggtgctcctcagtctctgccctctccatatgggtctgtcctggggatgcagacagaggatggaggcaaggaggcatcagggacaaactgtttacctgaggtcacccagcagccagctgaccagttcccactgacccagtccctgctgaccaggacagggctcctcatccaggacacagggagggacggtcagcctcaggctccaggtgcccccacaaggctctctgggcccatctccaaggggacagtgaggggtcctggcaccacctggacatgtcatctggccctattcctgagccttggagccagaggaacagagggatgaaaaagagtatggccattccttaaataaataataaatacaaagtaatcatatgatccaggaagtctgcttctgagcataccctaaaaaactgaaagcagcaacccacatatttgttca

SEQ ID NO: 471794 - DNA, 756 bp, Homo sapiens
ctgcccgccgccccctccgcccctctcccctgggcttgggtcagagggaagggcccagggaggaccctgcagctgtgcgggccccacgggggcctccctgggagctagaacggggtctccctgcgcttcccagagacccggcaggacaggggtctcaggaacgttcatgggatacaatgtggcagaggatggagctgagtcgccgcccttgcaagacggcagaggtacagcagcagaagaaacagaccttccgcaacttcacccagcgcggcgtggacctggaccagctactggacatgtcctcggagcagcggatgcagctgaacagcgcgcgccggcggcggctgaacccgggcctgtggcggaagcagcgctcgctgctcaagcgcctgcgcaaggccaagaagggggcgccgcccacggagaagccggaagtggtgaagacgcacccgcgggacgtgcttctcctgcccgcgatggtgggtagcacggtgggcgtctacgacggcaagaccttcaagcaggaggcggcccccgtcaccgggcccagcgcagctgaattaattagctgggagcgttcccgctcggctaattgtgccggagacgccgtcgtcacggcgggtgggatgcaggcgaccatcgtccagccgtaaagacctcagtcccctgggccggctgccccctcccagccctaggtgggctgttgctacttcccagagagggaaactgaagcccatggatggctatgaaggatac

SEQ ID NO: 471795 - DNA, 3307 bp, Homo sapiens
tcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacccggctcagttcggggaagctgcaggagttcggcgtgggtgatggcagcaagctgaccttggtacccaccgtggaagcgggcctcatggcctcaaggccggaacagtccgtgatgcaagctctcgagagtctcacggagacgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctgcccacatgtccacgccattgcctgagctcatgagctcacacccgtggacgcccgtcctggacatgcgggactgtgcccgtgccgggcactcacggccacctctgcccgcaggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaaatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccgaccccacccttccctctctctgtccctagcctggagctccccgtgagcctcaccaggactgagtcctctctggggtcccacctccacccatgtccgggctgggcagagatgaggcaataacactatttcatgtctttttttaaattttgtaacctgtatttcctcagtcggccactggagggatgacttgggggaccagagaggaagagcagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccaggtcttccctgtgcgcctctaaccccaggaggtgctgctggcatgcccacctctcagatgaagcagtgcggtccagagagcgtcttgggcaccgcctgcctcacagctgggcccctgaccctccagggactgtggctgagcagccatggctgcctggacgggtgtcccctggcccgtctgtccgtctggatgtgggaaccctccaggcacgctggggcgggcaggtgccaggtgcctctccagcaagatgcaacataggtgtcttcacttgcactccgtaggtcctgagcccctgcagctgcctgggagagtggggaaatactctccacttgtcccactccactgttgccatggagatacctcccaccctaggcagggccaccctgagcctggttggctttgcaggaaatccccactctttgacctctctgttaggcacaggacgtgtagtcccatgagagggaactgggcccaggtggagatccatccgcctaccccagagcgcgcatctgttgctaagcaacatctgaggctgcatggaggcctggcctttgggctgctgggatggcctggccggggcaggagtagacagggcctcccagcctccacattcctgagctgtgactcaggcctgtggggagggggtgagtcacagggaagggaagccgacccaccctgc

SEQ ID NO: 471796 - DNA, 605 bp, Homo sapiens
ctggatttgtttcaataaaaattacatggactgtgcctgcctctcctctccccttcctcctcttccacctctgccacccctgagacagcaagacccctcctcttcctcctcctcagcctactcaacatgaagacgacagcaagaccaaccccttcccttcctccccctcagcctattcaacatgaagacgatgaagatgaagacctttatgatgacacacttctacttaatgaatattttgtctccccaaatctaggagatgctgagtttttggggctgtccagaagtgcccagcacagactcaagaccaaagtcgacagcgttcactatggtggcactaatgatgctaataatgaagaccccgctcgctactactgttacaggaatggggtcccgatccagaccccaagagagggttcttggatctcgcgcaagaaagaattcaggcagtatgatctcctgatgttgctaaacattccctggcggaaaactctactctgctgggatggccccaatcaactgcaaactcaaacagctgatgtttgtccagcctgtgccctgtgccaggagtggggctgaacaccacctcatcacatgggcttctt

SEQ ID NO: 471797 - DNA, 579 bp, Homo sapiens
ctcagtgctgaagctcccggagcaaagactgatgaccagggaggacaggccgtggaggggcgagggtgggagtgggagcatccaggcggaggggacggcacaggtccaggcgggctatgacagggctggaccttggtgggagctgtgtacctgccatgtgccggccactgtgcagggtccttccctcccccctgcatccggcccccaggtgccgtcctgccccaggctgtttgcatgggctgttccctctgcttggaatgcccttcctccaatgtggctgtttctctacagccaccttgttcatcttcacatcctcagtgaccagcacatagcagccgtcccacgcctgaggttccaccggttgtcccggtgcccaggagcttgccggtatgccgccctcagattttgcaacagtggcatggcctgggcccctgctggcagttcctggaaccctggcatgtgctgagaagccagctgcagaaatctagcagttttggaaacgggaagacatcatgcccaaggaaggagctgcgtcattatttttgttatttactcaacaaacatttattgacttgctac

SEQ ID NO: 471798 - DNA, 1231 bp, Homo sapiens
cagtgcagcggtgggctgaagggctcctcaagtgccgccaaaatggtgccgaaagtgaagaaggaagctcctgcccctcctaaagccgaagccaaagcgaaggctttaaaggccaagaaggcagtgttgaaaggtgtccacagccacaaaaagaagatccacacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagatcaaacaggctgtgaagaagctctatgacattgatgtggccaaggtcaacaccctgattcggcctgatggagagaagaaggtatatgttcgactgactcctgattacgatgctttggatgttgccaacaaaattgggattatctaaactgagtgcagctgcctaattctgaatatatatatatatatcttttcaccatatacatgcctctctgtcaatttctggttgggctgggaggccacacacagacactgacatgacagggcttgggcaagactcctgttctacttatccttttgaaatattcaccctgccactccaccatgtgtgatcactccagagatctttgtgactagagttagtgtcctaggaaaaccagaactcagaacttgcctccatggttgagggtaacaagaagctgtacaagaaccccttttatccctggaagaggctgtgtatgaaaccaatgcccagggtttgaagggcgttagcatccatttcaggggagtgtggattggctggctttctggtagcattttgtcctcacacacccatctactgtgtccaaccggtctgtctgcttccctcaccccttgcccaataaaggacaaggacttcagaggaaaaaaaaaattgttttaattattacatttatagcatcccagcttgaaaaacgaagcaacagagacgtgtagaaagttaaaaggtttctactccaattgtaatttctccaattccatcgtggtatgtgcattcttctggatttttttcagtgtgcatacacatgtgtacatacagacacatacacatacactcgtacgttttttatattgatgggaccattactcacatctttaatttggaactt

SEQ ID NO: 471799 - DNA, 532 bp, Homo sapiens
gaaaagagagtcagcgaagggagatacgggtggggccgttttataggatttgggaaggcagatctgtctcccttagatgctgaaagatgccagatggcccaaggaccaccccttccccctcgtgcctggagagtcctgaggaccacacacatgtgcatgcgggcacacgcgtgtacctgccaaagacgtccacaggccccacacagctgtgttcccacagccgtgcccaggtcgaccctcagacctgggatgaggccagctcttccgccaccttccctgtgagcccaccgaggcctgatgtcccgtggcagatgcgatcgctttcctcggtgggcgagagagagcccaactccagggctctcagcattgggcaacttgctaccctcgtctctgcctcagtgtccctacctgcaccctggaggagggaagcctctcaccctctgcgtccccatccagtaagcctgggtcccttccttgcctccatatccggagagccatagggcctccctgatgaccctgtttaaaattgcaa

SEQ ID NO: 471800 - DNA, 571 bp, Homo sapiens
tgggtgtgtggagcccctctccccacgtgctgacaactcgggccccaccaccggagcagcctctgggatctgtgatatcttcagcaccctgcatcgggggtgattatttgtaagctcaaaccgtccccatcccggcagcttttcagacagtaatgaaatcacctaatcttgtgattggaggcttcacggacacgctgtcgaagaagaaggagaagaagaagaagaaggagaagaagagaagaggaagaggaagaagaagagagaagaggaagaagaacaaagagcagccgcgagcaaggccacttgaacttggaagcagatctttctctggtgaccttgagatgtcggtggccccagtccttaaacgatttctgcaccatcattttcaggacgctctgcagtgtcgctcagtctttttgcaccaggaagctggagagcgacccggagtgggagggataaaggacgccgaggcggagtgcattaggtacagtggtattttcttccctggtggagcctgtgaggaggagctggggaggcaaagagggtcaagtgtatgactccacgctcaggg

SEQ ID NO: 471801 - DNA, 610 bp, Homo sapiens
cgctgtccttcaggcggcctgacggatcgtcttggcgagcttctccgagttaatctaatttttctgggtctggctgggaccagccatggccaccttcttgctgtgttctcatatggcagaaacagagcaaactctctggtgtctcttcttgaactgcactgctgtgctacctgtgggcatggaacagccagtcagggaccaggcagacacggggagtaaccctgagaggtttgggagtgacactgaggtcaacctgcaccctgctggctctgatgtcctgacaggggtccctctgggctgtggtgctgtggctggcgtgattagattttcaccaaacgagggagctcggccagagctcgatgtcagggtgaagccagtcctggaatgtccggggtgccctgatttggaactgggggatggaggctgcagggcggagacaaacctcaggacaggggagtcgatttcagacttgatcggtggctttgaaaaaccctctgtccctttgggggcctcagtttccccatctgtacaacgtgatgatggtgatgatgaaatgagatagcaattgaaaacgttttttaaattttttatggttttttttttttttttt

SEQ ID NO: 471802 - DNA, 553 bp, Homo sapiens
tatgttgatgttccaaaaacacatgggacggagcctagcctacaacaggaacagcttgccagcagagggcacagcctgtgcaaaggccctgaggcaggacctcacctggggtgttggaggaacaacgaggaggcccatgtggctggagcagaaaatcaacaagttccaggcagtgactgctccatcagccagggtcctggagggaagtgataatcttcaagtccctggcccaaaaggtcacaattgcatatacaatgggctgtttgattactgcagcaaaaccaagcctatcctaacagatacaacaggaatggaggcttttgataccacagaaaaaggtgctctgcacagcgcttcttttgagagtttacatgcttacattgaatttgcacactcatgctatgggacctgtctgattgcagagtctgcctttgcccacaatccaccttcctcctggccatgatacgacgttccaagggtctgcagccacatggtttatcatctccaccaacgggacttgagaccacaagagaaaccacaaacctcaagccct

SEQ ID NO: 471803 - DNA, 1838 bp, Homo sapiens
cacctctgcctgcagagtctatcccagatccacccacttctccccgctcctgtgtctccctcttggtccagccccatcactgccctcccggagcaggtgaggcacctccaccctggcccctgccacccccatccccacagtcctctctgaagcagcaagagggcgcagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgtcctggccacaggccccctgggagaccccggagatgcccaaaggcctcatgcctgccgcctccagtgggacctagcagcacacagacagcgaagcgggtgaccatggggtggccacggccgggccgagccctcgtggcagtcaaagccttgctggtcttgtcgctgctccaggtgcccgcgcaggcagtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggcgccatcgtgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatctgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggattctcagcctcgctgctgttgggccacccgcctctgactggggttgggggacacccatccccatcaagcctaaggccaatccccgtttctgcgggcgggagagcgaggggtgtcccgggcacacgggtcactcatcctggatggccttattcttcattcacattttttcttttaaaataaacgttttattttggaactggtttagatttccagaaaagttgcaaaggtgccatagagttctccaacccctttt

SEQ ID NO: 471804 - DNA, 2036 bp, Homo sapiens
cgccaccgctgcatccccaatgagtctcggggctggcatacagtaggcgctccatacctgcgcgagtgtctgggatgggcagctcgggggtctttgactactggaggcatgggggagtcttttgtcctttttgctcctatgggaggaactgggcgtcgctgggggcaggagtcccccaagtccagcccctggaccctactgggcccgaagagggggaggggcaagtggggggtttcacagagaggggcatggggggaacgcaggtacccaggtgccaccctgggaacaccccgcccgcgccccgctgggtctccactgcttgcaggggacaagggaatgggctccaggctggccaatggggacgcagagggggcgcattacctcatcaagcggcgcggccattggctgcgggcgtccagtgggcgggagcagggcgcgagctcccgggacccgggaggggttgcagggtccagccccggaggatcctgtggaaggggggaaggggaggagaggggaggggaagcgaggggggagtgcaggaaatggggaatttgcaatatctgcggggctgacaaagtcccatctcctcagcatgtcttataagtggtctgggctctgctgacttccccagctacacccccatccccatccctgccccacttcccacccagtcacgctcatggttggtgagttaaagaaccttgatctctcttggatacattgtatctcccctaatctagccttgcagattagaactcccactcgccagctgctgacttccgggctggtaactgtttgcagggctcagaaattcaccagccatgggtttttggtggggaaattctattcttcccagaactgtccctctcggtatccctgaggacatcattagtttaaaaccatctcctctgatcagctccccgcaggctgccccccatgcaaccacagccccggggcggagaagtggggggttctttttgaagagtgctcctctggcctctgataaatcgagagaattaaaatccatttagagggaaatctctaaataggagcagaactgattctgacttaattgaatttaaaagcaggcaagagccagcctcagggtccttgccctggctgtcccctatgcttgaaactaccggcagataagcctgttttgcttcctgtatccccagcacataaaacagcacccagcacacagtaggtgctcaataaacacctcggtgcttatggaaggcataattcattaaacctgcattcatttggtgcatgccagaatatatatgcatagaaaaaaaaatctctggaaggatatatcccacccacacacccacccacccccgcagaactgggggtggtttttgctgagataacagatctcaacatttttaaatatttgccacaaagaatgtaacttcatcaggcatgaaaaaaacaaacaaaaaactcagtgccgtttcagtgcagtgacccaccagctgtgtgaccccaggcaaatggcattccttctctgagcctcaatttcctcatctcagaaagcagggattatcctagcactatccccagcaaagccctccagagctgtacctccaagtctcaaggaaagagttaaatcccggtctgaggcggtgatatttgcaatgcatgaggtttaaacattttcaataaagaaaaacaaacccaggccgacgcgctttctgatttatagtaattgcaaaccagcagccgttaatataattgtccggtggaggggggtggcggggggcttcacgcggggcccaatcagcccagggtgggatgcggccccagtcaggttaagcaaacgcattactttaataacctggggaggcagctggagccattagcaagaagggagaataaatattatcccaagaagctccagaatccgcagttttatcaccgagaattgtcccccgtgctatttactttcaatttagattttcgggaaagtggttcttggcacattttatatatgaaggagaatgactggaattgaaatatgacctgatttt

SEQ ID NO: 471805 - DNA, 490 bp, Homo sapiens
tgggtgggcagccacttcccaggaagataagatcagagcccctcaatgtagtgttcaaagccctttctatgccttctttctccctaaatttacccctgttacagttctacactccagccagactttattactgtgttttacccactcaaacacttagctctttccaacatctgaacctttgcatatgctgttcccttttcttggaatgcttttccacctcacaaactcctatacatcctgcaaagcccagcttccattacctctctcccagcagagggcacctttggtcagtgccccactctacaaccaggatttgtagctcccaggcatcatgtgtttttggcctgtcatcttccgcacttgacaatgacctccctggagtcaggggctgcattttcctcccttggacacttccccagccctactgcaggaataagtatggctgtaactgcatagagaagaaaggaagccctatcctgaggcattaatt

SEQ ID NO: 471806 - DNA, 643 bp, Homo sapiens
tgattggtgatgatgatgtcccttatacaaaggggaaatttggacacagagacagacccatatagaggggagatgatgcctccgttgtctcctgccagctggcggtgcagacagggcctcttggttcatcccttctcaaggagaaaggcttggattctccaccaggagcccccagagggcggagcaggaggcaccggtgacatcattctcagggccagccactcccagtgtgcaccagacctgatcaagatccaaagacgaccagagttcccagatgacactggggctgcaggcggcaaacttcacccacagctgtgggcgccaggccctcaagagtggctggggcaggacggctacaaagagaatttgattgctccggagttgaagcccaacgtgttcgaggagtcatgccaagattcagtgaaggtcacacaggatgcgagctgctgtggggaggggttgtccttgggactctcctaggacacgggaaggctccacctccatgagaagaggattcatcttcctagtctgttacatgcaaaggtctcgtctgagccaagtcttgcacagatgtcccttttcccggggaaggaagtttctagcaaacacccagagacttttctctttggagaacaataaaaat

SEQ ID NO: 471807 - DNA, 3674 bp, Homo sapiens
tgccttgagctgagcactgggcaggggtttgggagcagaagagggaggtgcagggcgggaatatcaatgttaggggagcagggggagcagggacaaatcatcttcatttcttgttgtcagggacaaattctggggcacagcacctggttctggggcacagcaacccactgctgcagacccacagagcctgtgtcctcgactcctctcctgcccattcctgggtattccttcctgcaccacgttctccgtgtggccccacctgctctcgttccagggagctgcccctggggggcatctggcaatgtccggagacattgttggttgtcagagctgggggagagcccacaaatggtgctgaacatcctagagctcacagacagccccaccagcatgaccaccccaaatgtcattgctgaggagtggagagccctgcgggtccagacactcctgccctgtgtgggtgctggggacatggccatgcgcctgtgtccctaaagcctctgtcactcaggatttgtgcctgaggaccttggctgggctgctgtgtaaacttccagatggagcctttcccagtggggcacgagtcctcccagagatttcaaggagggccttcaccaggaagaatcaggaggaatgtgacagccaccagggtgtagtttccctccagggcctgaaaagaggcacctctcttcatcatttgcccagagtatttgtactgtctccatcatgatggaatgatgccattttgcttctgttctgctaataataattttgtttctagctaatctgttgatgtagtaaaaacaattgttaacgttgctatgttaaagtgtggcattttaacatgatgttaaaacactatgttaaaccttgcatttctggggaagcaactcaaggtggtaaattctgactcattttggtcgtacttcatttgtggattttccgtctttgtttctgagtagggcctgcaattttactttttcattgtttcctggttggcctttgataagaaggttctacttccacaaaaatgagttaatgagtattgtttattttctttttctctggaagtgttgtgtaaggttgataggagctggtctttgattgttttgtagattttaaaaatttaaactgaagagattttatacttcttgtttggtgaagtaacatggacatagcataataaaatgtttaaatttacttgtagcctggaagtccccactttgaattgtcccacctttctgaaccaaaccaatatatttcttaaatgtatttgattgatgtctcatgcctccctaaaatgtatagaaccaagccgcaccccgaccaccttgggcacaggttctcaggacctactgagggctgggtcacgggccatggtcactcatatttggctcagactaaatctcctcaaatactttacagagtttggctcttttcgtcgacagtcttttccttcatctcttttcttctgtgttgttcatgaagtggggtactggataaagtttccttgtcatattccttgtctcatcttgtcatatgcccttgagggcttgatttgtgaccaagtgggagcactcattcttggtctccattatcagcagtgtgtgatttttgagtcacattaggtgaccagccttaaaatggttgggaacccgagattttttgttttgttttgtttgttccaaatgtgtcaagctcccaggagggcttgtcataagaagtcccatccataaggggcttttgtcattccaacttctgttgtctggatagggctgtggcaacaagagtcttttgctatcctagcctattgctgggagtgaatattttattttgttggggttgggggaaagacctctacaattgcttcttcattgaagagggctattgacttgagggctatttagaatcaatataccactggaaattctaattgtctatggccagaagatggattcctgaaatcagactcctatgttaaaagtattttagagatctcttattctaaacagttggtaggaggatcaaatttcaaagaaagacacgtaatcgtgttctggctagccttaaaaattctcttgactaaatttcagagcaaaaatctgacctaaaacaaagttaaatttttttgtaagctcaaactgcttgctttagatcccctgagggagtaagaataaaagccactccaatattccatttcatggaatagttaaaattccatgctttcactcctgacctggattttgtttcaagtcaaggaaccagcctcttttgttttgatatttatgtgatttttgactttttaaggtactcatttacctctttggagatgcctcatacatccttggctaagtcttggctaagtcgtaatcttgattaaggcttattagtttcagatgggaggatacttttggtaaaaaagtttcaaaaaccagaagtttcacctgtttgtcctagctaaaatctgatagtaagaaatctgaaagtgttacatgtatttagtcagacatgagcagggcaggagagagcctcccgtcccccgcatcaggactatcaggtgactattaggtgatggtcaggcagttgttaactgtctttctaaaataataattggccacagccagtgccagaaaaaggcagtctcccaatacataggaaacacctgaaactggtgattagcagcttcccgataagttctcagaagttgggtgagtgggctcaagcatgtgcattaagaggcaaaattgcagagtttaattggtatatgaccttccagggacctttgactggtaagggaagaaagcctcaagtgatcatgcgcacagctccagtaaacacactgcacatgctcctctccgaagtgctggcaggccactgtgcgtgccgacagcccactccaaggaaagaatcaggggaggagagatgcagaccccagaattagtccaacatacaaaagcctaagtcaaatgtcaaacctcatacttgatctcttgtcacctgcttagccctcttttaagcgtactttacttcctttaatttctgctctaaacctttttaataaaacttcactcctgctataaaagttgcctcagtctctgcttctgccttatgccccttagtcaaattctttcttctgaagaggcaagaattgaggttgctataggcttgtacagatttgctgctgctaatattctttggtgccatgactcagctacatttggctgctaagcaaagaatttttaaaaagagctctattgttaaaagtcagcttaattaaaagctgattttcaagccatatatttattttatattaaatatatatcttcatatagaatatatattcctatagaatatatataggatatgtagatattcctatagaatgtatgtataggatatatagatattcctatagaatgtatgtataggatatagatattcctatagaatatataggatatatatattcatattgtatatacattcagaaagggcttgaaggcctcaaggcctttctgcttttcttttttgtatctttaaaagtttttttccagttgactgaaatctttcaaaatcatatacttagtctctctgtttctttctcaaggattctttttcagttcctttctgttcctcctttcttttgctacccttgatgctacatgaggggacct

SEQ ID NO: 471808 - DNA, 1356 bp, Homo sapiens
cttcagaaagtctatgcttctctaagacagaacaggtggcctcatggtctctgagccctcagattgccatgcatctgttttctgacatacacacctgccatgggctttcaaggactcaattgggctgagagacaggaaattccaactctgatcaaaaagtgtccatggagcgataaaagttgccacacagggcaatcttctgttttctgcacagcgaaactatccaagcccttcgtcaccatcagcaactccaaccccgtggagaatgaggatactgcggccttaacctgtgaaactgagattcagaacacaacttacctgtggtgggtaaatggtcagagcctcccggtcagtcccaggctgaagctgtccaatgacaacaggaccctcactctacccagagtcacaaggaaggacgcaggaacatatgaatgtgaaatccggaatctagtgagtgccaaccacagtgacccagtcaccctgaatgtcctctatggcccagacgaccccaacatttccccctcttactcctattaccatccaggggaaaacctcaacctctcctgcaacacagcctctaacccacccccacagtattcttggcagattaatgggaagttccaaaaatcagcacaagagctctttatctccaaaatcactaaaaagaatagtggaatctacatctgtttcgttcgcaactcagccactgacagcaggtgtttcacgatcaagaagatcacagtcactggtgaggatgtagaaaaatgggaagaaaaggagccttggggcagactcctgagctgtgtcctggttctgaagtcactggctgtatgaggctgtgagcacagcacatgggacaaagcacagaggacagttccttcattttgcacaacgtatctgaattgtattccttgttaagattgaataacattccagtgtatggatatacctcagttttctatgcacttatctttcaattaacttttcagttcagttcatcacaacaacctgttggctgttgtcagtgatgctgctgtgaacatcagtgtacaaatatctgttcaaattcctttcagttctttgggtatatgtccagaagcagaactgctggatcaaatggtaattctttaattttttgagaaacagccataccattttccacagcagtataacattttacattgccatcagcaatgcaatagagcttcaatttttgcacctacttgaaaacacttgttttgtggtggtggtgttgttgctgttgttttatcaaagctatcctaatgtgtgtgaggtggtgcatccttgtggttttaatttgcatatccctaagtattagtgatgttgagcatcttc

SEQ ID NO: 471809 - DNA, 919 bp, Homo sapiens
tgagctttggggactgcagacctgtgcttctgactctaactccgtggctccaacagaagccctcagtccccgctcagagctctgtcctccccaggagaccccagccagtcactctgcttcctccttgtgttcactcccagaaagttctctcttcacctgtgagcaggagcccctgtcaggggatgcgctgtgtgcagggaggggctgagaggggcctcatggcttgtgctgcctgtgtgttctcttctgtggagatactgaagatgtcagttgtacccctcacatactcacaattctttcaccaagagatgaaggattttactggcagcagcacctggacaggcatcatggaccccagggaggactgtcactctggagattttggtggcatggactggagacctgaagccaccccaaggcccaagtcactggggagaggctgggtccagagctgctgtggagctttccacatggggcctttcccagtggagcacgagtcctcccagggatttcaaggagggccgttgcctggaagaatcagaaggaatgtggcagccaccaggtgcaggctcctctcagggcctgaaaaaagggacctcttttcatcatttgccactcatgtctgcactgtctgcatcaggatggaatgatgtggaatttcatgcaaggtcattttgcttctgttctgctaataattttttttctagttaatcttttgaagtaaaggcaattgttgacttttgggtgttaaactcacctttcatttttggggaacaaactcaatgtggtaaatcctgacttttttggggtcatatttcatttgtggattttccctctctgttcccaagtagggcatgcagttttactttttcattgcatgatattcacctccctgtgtccatgtgttctcattgttcaa

SEQ ID NO: 471810 - DNA, 859 bp, Homo sapiens
gcaaacattcgatctcgcttggagagatgtcatgctattgttagatcaaatcctagcctttattgaaaagaatgcagctttagctgcagcccgagagtttggagatacctggtatcttagtcaagtaaatgatagaatgacagccaaagaaagggacaaattccttactggtcagcaagccatccccactatggatccccactgggactttgactcagatcatggggactggagtcataaacatctgttgacctgtgttcttgaaggactaaagggaattaggaaaaagcccatgaattattcaatgatgtccactataactcagggacaagaagaaaagccttctgccttcctcgagcggctaagagaggccttaagaaaatatactcccctgtcacccgaatcactcgagggtcaattgattctaaaagataagtttattacccagtcagctgcagatatcaggagacagctccaaaagcaagccctgggccctgaacaaaatctgcaggaattattaaacctggcaaccttggtgttctataacagggaccaagaggaacaggcccaaaaggaaaagcgagatcagagaaaggctgcagccttagtcagggccctcagacaaacaaaccttggtggttcagagaggacagaatatggagcaggccaatcacccagtagggcttgttatcagtgtggtttacaaggacactttaaaaaagattgtgcaatgagaaacaagctgccccctcgtccatgtccactatgctgatgcaatcactggaaggcacactgccccagagtgcaaaggttctctgggtcagaagcccccaaccagatgatccaacaacaggactga

SEQ ID NO: 471811 - DNA, 1057 bp, Homo sapiens
ggagccagcggctgcaacaggttcactcctgaagtcagcgagatcacggtgcgaagaaacttgcgacatgccatctgtaagaactgtaacacttagtgctagggtccgggccttcattcttgaagtcagtgagaccaagaacccaccagttccagatacaaagagatacctcatacaacaagtagaccagtactactggtactatttactggtatcaatagttgcaatactactcattgtaaaggtgaggctgctcctacagctcaggttcaaagggaaccgggaaaactggggacatgaatgtagccagcgttctgactgtctcttggtctactggcctcacctcttatatcagcttccctctttcagcgggaaaaatgggcagagaggagccccgagccttacaacacatagtttttttgtcagagacattgatcttcttcactggttcctgttgaataagtcttggagaagagctctgataacgtcttctgagtcagttacccacccagggtgaatcggtgatagctagaagggaagaggcagatagccaaagtcttttcttattcatcagtcagctgaaggtagagggtgttggtagaatgtgaacatattaagtgaaataaaaacacttgagccagttttatgcagtattttcattgttttgacaaaacaaagtaagtatgcatgtacaagctacaaaatacaaattgtgtattcaatatacaagttaaaagttcttacatttgtgtttaaaactggcaacacataatgtagatgcattatgtggtgaaattcatgtggtgaaattcatatgaatactttagaattataatttttctttacttagaacattaaatgacaaaaaagtaacaaacaaacaaacaaacaaaaaaacaccgtgacaagctgagatgcactatggaagaaagaaaaaagctttatattttagtgactttaattacacttttttcctgatgtttgaataaggccttggtcctgcattttcattttgtactgggtccccaaaattgtgtaatgtgtcctgtcctcttcc

SEQ ID NO: 471812 - DNA, 854 bp, Homo sapiens
cttaagctaactcaatgcaggtttattatcctggcgacttgcagtcacattctaatgattttcaagggccaaaatatagtaataatcatttgaaatatccatcgcttccatgccttagtttaacagctcgtgatcttgattggcaagtagcaatggctgactttattcgtaatatcagcttcaatttaccagcctctaagctcctgaactttttacaaactatgcctgtgaagtttgtatctattgttgtctctgagcctttacttcatgccatcactctctttacagatggttcaggaaaaactggaaaagcagctatagtgtggcaagatgccatgcaaaactggcagtacagaatccaggagcattttaaaaactacacaacaggcagagttaggtgccttgatattggccttacaaattttcctcaccaagacgtaaatatacttagtgattccacttatgcggtgtatagtattactcatttagatcttgcacatgtgaagggcattactaatgaacccctactagctttgtctcttgcagcgcaagactcctccttgccagtcatcaccctctttacatcacacatattcgctctcattctgggctatctggtcccttgtcagaaaggaatgcttgagctgatgctctggtacgaccacagatgtggtttgcagattctcctgcttttttgcgagctcaagctgatcatgctgtttttcatcagaacgcctgcagtcttaaacaacagtttcatttgacacttgcttaagctcacatgattattaaaactgtcctgattgccaacagcgttctctttcccctttttccttagggcttagtgccagcct

SEQ ID NO: 471813 - DNA, 473 bp, Homo sapiens
tacgtgtcttcccgccaggatgcgctattacccccaccatggctctggcaaagagtggtaccctaaggtctatggggcaggggctgcatctagctcattcactcctccatccccagttcaggctataagtcctgtcacatattttggagtggatgatggtgaggacagctgggaatttgatggacagtctgatcatccaaagcaacacaggaagcaagctgcacctttcagaacttccccgactatccaagaagtggtggaggggagaaaagagactagcgagagactaggagcagaatgcctgggaaacagagcaaggaggaagctggggctacttcttatttctaagaagaatgtatttatgcaaagtggttatatttggggatatattctgtatgagtgggtattctctgaatgtatctttctctttatgacccacatcctccctcttattggaatcagcaaatgagctg

SEQ ID NO: 471814 - DNA, 986 bp, Homo sapiens
actactggctcagtaggtcccatgctgcccccattcattagctctgagcccagttcagccctaaggctctcctatgagttgcagtccttgcctgtgaccaatggtttagctagatggccagggacttggaaggagcactattggaaaactggtgacaaggaaatttggagaagagccactcctgtcattgcccaattggctcatgaacacagtggccatgtggcagggatggaggttgtgtttgggttcagcaatacagacttccatttaccaaggcagacctggctacagccactgtcacatgccagtctgctagcagcagagaccaacactgagtccaaaaatgacaccactccccagggtgatcagccagctacctggcgggcatttcaggattaccatgcaacgtggttaaggtcaacagaaaactacaacagcccaatccaggcaacattacactactaacatctcaaaatcttatagagtgaagatttggatcacttaaccaggtcttaaaaatgctatctacttcataaggtttggaagataattaaatgacatcaggtatgtaaaacatagcacagtgtccagcacacagtaagccttcaataaatgtcattaaaaacaataatagtaataaagctttatagtgtgttttcatacctagtagaagctaaacaagcactggccttgaaataaacaatattaaaacaattgcaactcaccaccagatgctcactaactgacaccctgttccacgagccttgattggacaacagactgatttctgtaactttcttctgatgagagatcacttattatgaactggttctggtgggttttacagagactgcacactggaatgccttcgtgtccctgcttcaccttttggcctagctgtaatacatttaaatgttaatcttccacccctaagtgaacatgggtggtgtgtaatatgcatgaggaccaccttcatgaatattaat

SEQ ID NO: 471815 - DNA, 1477 bp, Homo sapiens
ggctgtggggataccttgagaaggccgggcccaaactcggcaagtccagctagcttgggcagtgtctgggctttgcacagccccgtggagcacttctcccctcaccctgctcagtgaccatgccctcaaccactactgctgccctcacacctccacatgcatggtgggtgctccttggttcacagtgcccaaatgccagggggaggtggcagtgtcagggttccagggtccaggggcctactttcagcaagctggatggcgcgcagacggccgcgggcgccggggcctccagggcgagggggctggggccggggctggagcagccggaggacgcggcggagacggcagggctgagctgcacggccgtggtgtcctgtgccgtgggctcgctgctctccatctccagcgccacgggcccggcgcggccgccaccctggcccgggcccgccgcggccgccgagcgcccacggggcgcgaggccccggcggctacacacgcagcaggccgcgaagaagccgagcgccagcaccagcagcgccagccccacgacgagcagcgcgttgtgctcgggcaagaaggaggcgaaggcgcctgccagcgtcacgttcacgcccgccagcagcgcgcacagaccgcaggcgcagcacagcgccggcgacggcaggccgggcacccggccccgggcgcgttccgcgggcgccgggaccggtggcccctcgctcttttctgccggcggcatcggcctgcgcacgccaggcacgcatcaagctccctcctgccgccggcccggaacagcccaactgccaggagcctcctcacgctggtcctgtgggcaactgccaggagcctcctcacgctggtcctgtgggcacacagcaagagggcggcgtcagcagggtatcttgacctccagtcctaggctccgtctgtagctacactgagtgcctgggtgggcagaggtcatcttggccagccccctgcctctgcctctgggaagcaacaaaccatcccatatgtgaagaatcgacttgtttccccacctagttccgggggtccctcgtggccaatcttgccatcctccctctctcctcacttttttgtcctccaaacagacgctgcccctccaacccctctcctccaggaagcctacctgaactcatttgagtgagatagtggctggaaagtgctcagcacagtgtccagttcagcttaggtgctcatcacatgataatcatcgtcttcagtagtcctaactaccatttgctattgccccacatgtctcttttacactttattctatattttctaggcttttccttccttccttctgtttcagtctggatatttttctactgaaatatttttctactatctagtttactaatcctattttcacatgtgtcttttctgctgctaaatccatcaacggagttattgatttcatttgttataacttttcagttctggaatttccact

SEQ ID NO: 471816 - DNA, 568 bp, Homo sapiens
gttctccccagctgattcctgctgacccagcccttccctgttccttgttcacctgacgatgcccctgcccccacctccagaatctcccttccctatcccagcccagcccctgctcacccagaacagcagcgccaataaagacaccgcccatggcagctgcagccttggatacggagatgccgataatgatgctgccagccaccagcccgagagccacgcaggccagctgcaggccgcggaagtctctgctgctgatggggatgtccatgcaggcccacccggggcactgcctccagccggctcttcctgttgtgccacagctgcccctctgggccagggactgcatcccggaggggtggagcagcctgtctgccggaggatcctacagagggacagagtcctggctcatcttaagaggcccagacctacctccacagcacacagtgcttctgtagagtgctcccggagccaaggaccagggagggctcgtctctagcactgggaccatgagttgtgtaattctgccctggtagataacagtaaatacaggagtcccccattatccctc

SEQ ID NO: 471817 - DNA, 2004 bp, Homo sapiens
tgagaatacatagatactaggaggggaacagcagacactggggcctgcttgggggtggagggcgggaggagggaggatgagacaaaaatacccatcaggtagaggcattcctctcatctcttccatcttgggaaggagacctctggaggctgggtggaagcctagtgtgtataagtgcctgaagacaatttcacagccctcagacctcaccctcaacatggccccagtaggcattgtcccctccaaccacttggtgttccaggctcagctttccatggaacccactatgaaggctgcccaggaaattctgtccaacctagccccttctctgctgctggggtgcctccatgtcagcctctggggctgccgcctggagcaacccccacttagttcaaagctcttctatagaaagccctcagattgccccagtctggatgcaccctcctccttcctccacagcacagcatcctttctccaagggtgcccagaggacacagtgcaagctgctggctctgagacaaactgagaagggtgagaaagttccagcaatcaatcccagctccaatggggtgtgcaaagtaaaagtaaaaacttattgcaggggctcccaaatcaggctgagtttcagaattacctggagagttaaagaaaagaaaaatattaagttggtggaaaagtaattgcatttttgacataaatggcaaaaactgtaattacttttgcaccagcctaatattttctcaggccccaccccaggccaacagaatctatatctcaatggtgaagctcaagaatggacagctctgacaagtgcatcaggtgtttctgatgcccagtcgggtaggaaaatgacaagtgccaaaatgtaagatatgtctgctacttcttacctgaccagaggcaaggtcaaaatgggagattgaatgtgggttgaagaaatgagagtgcaagatggggatccataccatattgtgagtgtgggaacaatagcagtaacaaacatgatgtggggtcacagtggaccacatatcaagcaggacccagtagtgattgtttcaaaccatggcaaatattttttgggtaaatgaagatcttgagaggataccactaagctatggttactgccatggcagatgtagaaggggaccaagcagaacaaggataaagatgttgttatcaacctgtcacatcagaagaattgacaagaccaaagttctccgaaggaagtcttccctagttagaacatgatgtcttgcaaaattgtctggaggaatcagaggctgcaaacctgtacagcatgttactgtgctgaatactgtggacactgtaatataagggtaaatacttatctatcgtatctaaacatagaaaaggtacagtaaaaatacagtataagataaaaaatgatattgctgtataggacacttacaatgaatggagcctgcaggactggaagttgttctggatgagtcagtgagtgagttctgagtgaatatgaagactgaggaggacattactgtacactacagtaggctttataaacactgtacactaaatttataaaaatatttttcttttttcaataaccttagcttactataactttttaactttataaactttttaatttttaaaacttttgactattttataattgcacttagcttaaaacacactgtatagctgtataaaatattttctatctttattctgtaagcttttttctttaaaaaattttattttttactttttaaatgttttggttaaaagctaagacacaaacatgtacattagcctaggcctacacagggtcaggatcatcaacattactgacttccacctgcacatcttgtcccactggaaggtcttcaggggcaataacacacatggagctgtcctctcctataagaacaatgccctcttctggaacaactcctgagagacctgcctgaggctgttttacaattgacttagtattttttatacgtagaaggagcacactct

SEQ ID NO: 471818 - DNA, 1006 bp, Homo sapiens
ggccattatagcagtctatatcagggccagtagtttcgtgatctggattttttttccccttgggctcctctagcccagaatgtcaaagttttcagggaatttctctctctccacattcacgcccacagtccaactcacaacccaacccaatccaagaagtaacatcaacagcaataatttacatttaggcgttcatcaccctttcccatcccctgaaaatgaagtagatgacaccgaggtgaatgtgagtaaaaagaaaggagatggggatatactgaatgatcttatgaaaactgcaggcactgctaaggtcagggaggaggtccttggagattacctgaagacactcaagacagaatttacaatgggaatggttcgggcctcatctccagtggcactgggtgtaagaattcccgctatggctcttcccatgagggcacagtttgacgtaactgtagaacagttgtacagcatcttcactatgaaggatttggtgcaaaaattttctaaatcttctgctgtattagaagctgaaaagggagggaaattccaaatgtttgttgggaacatcactgatgaatatatagaatctttaacaaataaaaaaatcataatgaaatggagatgtaggaactggccagaagggcaaatggaattacaattcgactgtaaaggagttcctatctgtaaagaagagaacatgaaattctgttggcagaagcagcattttgaagaaataaaagatttactgcgctgaccaccctgaatggttgaattagttaaaattttataaggcattactttttctaagcagaaaatgtgtcacatttaccttttccctatcctttcttttcctttaaaagaggaaaaaaatccatgaaagtataccaaatttaaagcattgtttgactctttattataactagactctgcattgagttaaaagtagcaaacaacctgaaattaggtattaacctgaccttccatagatgttcccctggaaatc

SEQ ID NO: 471819 - DNA, 1256 bp, Homo sapiens
tccttgcgggagattgggtcacctgccaccatctggctcaaaagtgaaggaaatctctttgatgtttacctttcaagcactggcccatctttgttcactcgctgcgactcaggcaggctgttttctctgttctgtggtgcaggtctctctctacccttctccttccatttgccaagactgtacccatccttcccagggatgcatctcgtactcatttcctgcagagtgtgacacagccacagcttgcagtttcacatggaatctaaagtatcccaccatcctgggcagaggggctggggactggtgtccatgggagggcagggattctgagtcacatcatccccattgtgctgtatctttagctgtccttgtggcagagccatctttggggtggattggagcaccttggaagaaggttgccatgctctctggagcctcaactcaggacaaagcctgtagaatggctgacttctgtccagcccagctgcttcacattcctcactaccctcctgcccttcccatctccaccctccacccttttcccctgacactttcaggaccaagttaaagacacaattgacgaggaaatttgtacctctgtgccatcagaggtacaaataatttaacatcagaattataattattactgataaagtacactaattcatattagaactataggagtttcccataattttggaacacataccgatatcatatttatccaaatacagcccaaagaaaaccaaacctcatttcatatttgataattcttcctgtataatttttataccaaataggccaaattatgtcatttttggactttagggaacctaatatcttaaatgattaattgggtcagaaaaatgcataatttataatttgattttggaaagtctgccaaatatcaagggtttaaaacacttcatatcacaaaataagatcacacattttttgtaaaataagtcattcatttaaccaaagtgataactcaaggatttcaaaaaaggtgaaaaccttcattttttgaaaaagcagacttaattttccaaacaataagccccaataaaaacagcatgaagccaattaagtttgtttttcaaacgttataaagtctataacattttaatcttgactgtaagatttaacttccataagcccttttgtagcctttataacctttgttaaggagtcagttagtgcatcaaggaaaccttgttaatctgacacagaggcccacatactgttcttacatc

SEQ ID NO: 471820 - DNA, 808 bp, Homo sapiens
aacttctgcctggattttagaagttgtatggaaatgcctggatgcccaggcagaagtttgctgcaggggtggggtcctcatggagaacctctactagggcagtgcagaagggaaatgtggcatcagagcccccacacagagtccctactgggacactgcctagtggagctgtgagaaaagggccaccatcctccagaccccagaatggtagatccactgacagcttgcaccatttgcctggaaaagccgaagacactcaacatcagcccatgaaggtagccaggagggaggctgtatcctacaaagccacagcagtggagctgcccaagaccatgggaacccacctctttcatcagcctgacctcgatgtgagacataaagtcaaaggagatcattttggagctttaagatttgactgccctgctgaatttcagacttgcatggggcctgtagcccttttgttttggccaatttctcccatttgggatggctgtatttacccaatgccagtacccccattggacatggatgaaattggaaatcatcattctcagtaaactatcacaaggacaaaaaatcaaacaccacatgttctcacttataggtgggaattgaacaaagagaacacatgggcactggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaac

SEQ ID NO: 471821 - DNA, 1078 bp, Homo sapiens
taaatcttcctggataaggcattgttgcctcaactacttgctctgcagagcaacaaccctgattttttttttttttttttttttttttttttaatggagacaggggaactgaagggtgtttaatattgactgaagcacagagtatgggacgcaagaagaaacagagcttgttggaggaacagtactcacaaaccagtgtctgggtctccttgctgccaggatccagtttctgccacgtgtatgactcgaagaccacctgccaatctggactcagtgtcaaggcctgtgaagacccaggctccagaaatggagctgatattgttgcttccaaagaggatggcactggcaaaggcattctttctcagtttgttcaactgctggaacattccagcgatgagattgcaactccagaaggtctgggagtacttgtgcttaaattcatccatcacaaaggtactcgggcaagtgagcaaaggggtcttggctatccgatgctcagcagccagtgcctgctcacattcatccatctcctcaggagcaggaaggcaaccaatcagaggctgaagtgacgttacaaagttaaaccaatctgattggttgttttctgcaaccaatcagagatggaagtgaagttacaaagttaaacccatgcaaacatctgattggttgcagaaggtgaccaatcagaggctgaagtgaagttacaaacttatactcctatgcaaatgaaaacttggcctgagaccagcctgattggttgcagaagaggacaaatcacaggtactttcagtttttcatctgccaggcagaaaagtgggggatgcaaagggagtagcctctggtcctttcgttacttgggtgtgaaccatacttgctctagctgtgatgataaaattatagttgtcaaaattttcaactcgacaactatgtaggtatcagaaggaataccttgtaagtatctgtgctgaagtgtacaatctattggggtcacggaattcagagaatagagggatcacattcagtggagtgcagaggaggggtggtaatcaggaagatttaataaagaaggtagaggttg

SEQ ID NO: 471822 - DNA, 1137 bp, Homo sapiens
gtggacagcttgtggctcccaattcagatctgagcagtgacagacatggaattccagcacagcgccaagaaaacacagctccagctcccccactttttataaacaaatttgtaaacggccctcatcttaggggtgatgttgccagcccaacccagactttccgactcatttcgaaacgacgtcgctgccaactttccagcttaaaaagagggaaacttcataaaaggctccatttccatttggcctgtgggggaggatggaatacatgacaccaagccactccccctcccactcaatcacagcagaagactcggattcctatcttacacagaaaatggctgttactggtggctgccagacctgcaaacctcctgctattttccattctttcctgcttcccgccttcgtcctgtccaaggccaaggtctccgtctgtgccctacagcctgagaaccaggagggcgggtggtgcagctgcagtgtgaaagccggcaggctcgagacccaggaagagctgatgtttctgtttgagtctgcaggaaggaaaaagactgaagtctcagctcaagacagtcaggcaggaggagttcaactgattggccgaggcccaccccatgaggaaggcctgaaactgtgcaagggggaagctccggggggctcccacgttgcagacagcctacgaattctagtgttcgtctcatctaaaacagccgcacagacacacccagagtcacgttcgaccaaatggacacataaaattaaccatcacagcatcctcgaacgccagtgcctctgggggctggtgcacgtgaatgcagaggggaatagcctgagaagagaagcgtttgtgctgcattgagtatttgtctgggctttgaggttagaaatttggaaacatgaactcccatgaagctattcctacagttcaggcacctgcagttcccaatttctaatgtttaagctctggatttgttaatatccccccttcttgaaataatcaagtgtttatgatcacatgatgaatactttcagtcttcacaatgagactgtttataccatagaaaacaaacacaaaatttgctcaaaggagaacgggaaacacaatttcaaataccggctgttttgaaaatgattgta

SEQ ID NO: 471823 - DNA, 774 bp, Homo sapiens
gctataccctggatgatttcaactacatgacactctggaaaaagcaaaatgataaagacagcaaaaaagattggtggttgccaggaactggggagccaaatcaggggcatggatcatcatgttggggacactaccccaaaggaggagatgacatggctgtccacaaaccgggagcccagttgtgcccagaattggttccttctggttggttcttggtctcgctgacttcaaaaatgaagccgcggaccctcacagtttgtggtctcactgacttcatgagtgaagccacagacctttgcaaagaagaagaggaagaagacaaagaaggaggaggaggaggaggaagaagaaggaggaggaagaggaagaataagatggaagaggaggaggaagaagaaggagaagaaggaagaggaagaggaggaggaagaaggagaagaagaaggaagaggaagaggaggaggaagaagaaagaaggaggaggaggagaaggagaaagaagaaagaaggaagaagaaaaggaggagaaggtggagaaggagaagaaggagaaggagaagaagaaggagttcgtgaatgtgcattgactagaccctgggaccttggctgtaggagtgtatgacagatagagcctccctctgcctggatgactctgcccatgagaaccttctggatcatactggacagaccgtgtagagcttgaaggttgtgtgggcccatgcctgatctagcttgtctaaccgacagttctatgggagttcactcagcacagga

SEQ ID NO: 471824 - DNA, 1137 bp, Homo sapiens
gtgtgtgtgtgggaggccaccgctgatctctccacggtgcatccttgcccttcagatgcgtgatcttgacttacccagcccacctgcagtggaaccagcggggctgctgagccaccatgctcaagctgaggatgcgtttccaggaacaaaggggcagagggcacgtgggacgtcgttggggcagcaagaggcgagggcctggctttggggtgctgctggaggacagcaccatttccctccgccccgtccacccagcagatgtctgccaccccagtgccatcctctcacccaagacctggactgagagccacctggggctcctgtggccagcctgcgggcccatccctgtgccctggtcagccacgctgctgagcaggacccctgctgttcgcctcaagggccgtcatcgtgtgcgccactcgggtctttgcatggcgaagctttctcaggtcctgagcgaggcagtgcctggtgcctgctgctccccaagtctttaccacgtggcggaccctgcctggtttgaggacagtttaccaacagtcagctttctgggctgctcttgccccatgtctgcaaacacctagaaactgatggccctatcccagatgacaaagggtggacacacatttccggggacaatcctgaggctccaggaaaatgccctcaacaggttctgaagccacagcgcaattccaacgcctgcccccctgtggccatgtccacaccctgcaggctgcctgcagcccctttggagggttagagccccttaggcctgggatgcatcctccacctggagtgcagctctagagctgggtggctgggggtggggtgtgggggcactggtaggccacggggaggcagatgggggccaggcaggaggccgctaggatggggtggttccgatgtgtctcctgagcaggcagggtgccacatgcccatacatgctggtaacgcccacggattagaggtgtggggtgaatggcaaggggtgggggaagatgctcttagtcccaatgccagtgcctgcttagggcccatcccgctgcttggggagcctccaaagaaagacagcaccctcaccagggaaagcctcttcccagacagaggatgtttctggaagccactctgggatgcaaa

SEQ ID NO: 471825 - DNA, 819 bp, Homo sapiens
ctcagcagggttttcatctgctctttgggaaatttctttgagtttttttaaagtttacagctttgtgagcagctttgttaaggcctacaatgaggcaagtaaccatatggtttcaggacgctcggctggggtctgtgggttgctattcccaggaaggctcttcctgggggactgctgcagcccctactggcttagtaggatcttcctgatggaggtcattggcatgtgcctgggccgagagccacactctttccttctcttccagaaagagggtagagaagagaataatatagagatcatgctaagtaagtttataagactggctgagatatttaaattctttgatgtaagtattgggatcagaggagaaggacccaagatgctttttgatttgggaaagatcagtaagagagaaacgaacatggacatggacaattccttcagctcttgcgacctctcggagcgggagtaaggaagggcatcccgggtccgggagcagcttgagtgacagctcagcaaacagaaatctttgctccaaatctttgttatgatctctgtcataacattttgtttgaaaatcgcctccagacctaaaatgaatttgagcagccaatgtgaattaattaagctgaaaagaactctcaaaacaatgatttctctgatgtgtttttatccaaaccttccaggtcactaatttgtcctgttttctttaaaaggagaaaataatgaaggggtgtatttggtgccctctacagtaaaatatctttgatatcagtggagaaggagctgcttggcataaatgaatgttcttgaaaactc

SEQ ID NO: 471826 - DNA, 1595 bp, Homo sapiens
agtctttttgggcctcctggctggctgaccctccccgtgatgggggatgtgctctggtggctgctcctgaaggctgtggcagccccagggagagaaaagtggcctgagaacaccagcctgcttgtctgtggactccctggccagtcctcagtgttgccgacctgggatatcttcatagagtcctcaccacccactccctgctcttggcaccagaacctcgccttcctggcttcctcactgagtgcactcactcagggtcccagcggtcctcaaagatgtgtgcaaagtgtgagacaatcacaaagaaaggggaccctgctgatcaacaacatctttgccatcatccccgccatcctgatgggagtcagcaaagtggccaaggcttttgagctgatcgtcttttcccgagtggtgctgggagtctgtgcaggcatctcctacagcgcccttcccatgtacctgggagaactggcccccaagaacctgagaggcatggtgggaacaatgaccgaggttttcgtcatcgttggagtcttcctagcacagatcttcagcctccaggccatcttgggcaacccggcaggccaagccatccagaaggagctcactcagacccagcgcagggtccaggccctgccctaccatggccctaatgaggcagagattatcccctttcctgctataaaagagtaccctggctggccggtgcttctggcgctcacaggggtgcccgccctgctgcagctgctgaccctgcccttcttccccgaaagcccccgctactccctgattcagaaaggagatgaagccacagcgcgacaagctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgatcaactactatgcggacaccatctacacatctgcgggcgtggaggccgctcactcccaatatgtaacggtgggctctggcgtcgtcaacatagtgatgaccatcacctcggctgtccttgtggagcggctgggacggcggcacctcctgctggccggctacggcatctgcggctctgcctgcctggtgctgacggtggtgctcctattccagaacagggtccccgagctgtcctacctcggcatcatctgtgtctttgcctacatcgcgggacattccattgggcccagtcctgtcccctcggtggtgaggaccgagatcttcctgcagtcctcccggcgggcagctttcatggtggacggggcagtgcactggctcaccaacttcatcataggcttcctgttcccatccatccaggaggccatcggtgcctacagtttcatcatctttgccggaatctgcctcctcactgcgatttacatctacgtggggacaggatagtaagggggtgttacgaacactggaatgccaataaatatgacaacctagatgaaatggacgaactccttgaaaaacacagagga

SEQ ID NO: 471827 - DNA, 847 bp, Homo sapiens
gggaggcacgtggaatattttggcgtctgtgttgtaggtgaatgaatgaaagacaagctgtgtctctgaccttctgcttctttctcactacgacccttaagtgttcccagacttctttctctatggtagctgttttggggaatgtggcaactggtctagctatgccccgacagcagccgctggtgatggagcttgtgaaatacgcttcaaagagcctgctcaccctggggctggagaacaacactaggttgggctttggcaggtgcagcccagagggggctggcaaagcagaaggcagcctacgccaaccagtagggagtggctctgggtcacttcccagaaagggacttctaccaactcagacaatcgagtcaatgggtccacccaccagaggcaaaatagattgcttccattgtttgcaagcagagttgagcaatgggaatggagggagcacctgggcaacaggagatgctggttttcagtgtttgttcattcttccattagtgcccctgggtccttctgctgtcactctactcacaagaatccagtgccttcctgcttccttgggcgcatcaggcccacttccctccccatcactttggcttttcctcttgggacagtacctcatgccttgaatgcattcatcatcacctctccccttccctctgtcattcaaactcatcagtctgtgtcctctttccatagtgcctgctctttcaggtgaattactgtgaggattgggctctgaatctttgtctttgtgttccctacactacccagtaccaggaaaactgaagaacttgtgtaaacactgttttggactccatctgttgaatcggtcccagcc

SEQ ID NO: 471828 - DNA, 1197 bp, Homo sapiens
ggtgaagataagacgatgaggtacgtaaaagtgtctgacatgaagatgctagccgcatttagcaagagtttgaagagaaaaattgacagaagttcaattccagattttctaatgaatttaagcagtacccacgcagttaagtcattcatagatcacttattaaaagtattgcagtcaaaacaggtcaacccaatagatgctttaaaagcaaaagaaggctttgggaaaggattctggtgtgatttaaggatggactttcagccccaggagtctcatctccctcttcttccctctatctgccactgccccaaactagaaggagcaacgaccacattaaataaattttcttttggtatcaccttcacacctacccagacccatatggaagctgaagtcactttctctcaatgtggtacagacacatgaactctaaagagagaactagaacacaatttatgccaaaataattagtgtcattgacataaagttttagtgtacctcaaaaatcatattttattaaaaatagcaattatgttttctcaataccctactttgccttccataactggatttcaaattatctacaaaacagtatgtaacttgcaaagatgaattccacttagaattgttgtctgcagttcctttttaagctaaaactcactttatttttttaaataaatggaattttcctctaatggattaattggctccataagtctgctatattattatactacttgaaccatttgctgctaaacagtaatagtagaacctataatccagtattaatttccacaaaaatttgacattctttttttaatcatacacctgttggagccatctaatgcatctccatttgctaaaattatgtgtgaggccgtttaaatctgagcaatcactcagactgtttatggaatcttggaatattaaactgttctcagtgtcctggtgttctgctctaatgggaaaataatactctctagaatttctggagaaaagaaatactgtggagcttgagaagcagatgacacatgtatgtaaagaaagggcatgtgagctgtaagaggaaaggggacaaagcggatgcagtataagaggatggaagaagttgttatagaagaaaatgcagaaaagtagcaggtagaaagcttactgttatcagagttgaataattcaaaaatagctttggttgtttcc

SEQ ID NO: 471829 - DNA, 1396 bp, Homo sapiens
gctggcttcaggagtgaagctgcagaccttcacagtgaatgttacagctcataaaggaacagctccagtctacagctaccagcgtgagtgacgcagaagaagaatgacttctgcatttccaactgaggtaccaggttcatctcactggggagtgtcagacagcgggtgcaggacagtgggggcagtgcaccgagcatgagccgaagcagggcgaggcattgcctcacctgggaagcacaaggggtcagggaattccctttcctagtcaaggaaaggggagattaccctccagcgcacctgactcagagggtcctacgcccacagagccttgctcattgctagcacagcagtctgagatcaaactgcaaggcagcagtgaggctgggggaggggtgcccgccattgctgaggcttgagtaggtaaacagagcaattaggaagctcaaactgggtggagcccaccacagctcaaggaggcccgcctgcctctgtagactccacctctgggggcagggcatagcaaacaaaaggcagcagaaacctctgcagacttaagtgtccctgacagctttgaagagagtagtggttctcccagcacacagcttgagatctgagaacggacagactgcctcctcaagtgggtccctgacccccaagtagcctaattgggaggcaccccccagtaggggcagactgacacctcacacagctgggtactccccagaggaatgatcaggcagctacatttgctgttcaccaatattcgctgttctgcagcctccgctgctgatacccaggcaaacaggctaaaggaggagtttcgaacccatggcaaagaagttaaaaaccttgaaaaaagattagacaaatggataactagaataaccaatgctgagaagtccttaaagcacctgatggagctgaaaaccacagcacgagatctacgtgacacatgcacaagccttagtagccgatttgatcaactggaagaaagagtatcagtgatggaagatcaaatgaatgaaatgaaattcaccaaagttgaaatgaaggaaaaagtgttaagggcagccagagagaaaggtcaggttacctacaaacggaagcccatcagactaacagcggatctctcagcagaaactctacaagccagaagagagtgggggtcaatattcaacattcttaaagaaaagaattttcaacccagaatgtcatatctagccaaactaagcttcataagtgaaggagaaataaaatactttacagacaagcaaatgctgagagattttttcaccaccaggcctgccctacaagagctcctgaaggaagcactaaacatggaaaggaacaaccggtaccagccactgcaaaaacatgccaaattgtaaagaccatc

SEQ ID NO: 471830 - DNA, 1040 bp, Homo sapiens
ttgagcccagacaaggcagtgggatgagccaggaagacaggctggaaaagtcacccgaggaggaaactcttttatgtctgcattctttcctcccccacctgcccccccacccccaaccccacccccgccaactctagcagcctgggtgaccaagcaagatcttgtctctaagaagaagaggaagaagaaaaggaagaggaagaaggaggagaaggagaagaagaaggagaaggaggatgaggaggaagaggaagaattatcctgctcccatgtgggaggctttgaaggcctcatcctctaccacctgaacttctgggctggcagccgattgcatggtgcccacccacgagggtgggtcttcctctcccagtccactgactcaactgtcaatctcctctggcaacaccctcacagacacacccagaaccaagactttaccagctatctaggcatccctcaatccagtaaagttgacacctaatattaaccatcacacaatacatagcaaaatgctcagtaaatattagctgttgttattctatactttcatctagcataatcctcatcacacatcaccgtgatgcctatttaatttgttaactttccagaatgagtggaagctctatgaggtcagggagcatgtctgccttggtcttactcccagcatggtggtctggcaggtggtaagtaatcaataaatttctgaatgcacccatgcaagaatgcaaaaatgcaaagctaattccctgggctatgtggattggttgctgatactttgtaactaacagaaaattttctaacctttgaatactgtaggtaattgttctgagttgctctcctctttacttaagaatagaggaaatgagaggcaccattgcaaagtggttaagagcacagagagcaaagccagagtgcgtggatttgaaacctggttctaccacttaccaaaatgtgaccttatgttacttcaatagaaataataaagtacctacctcaggtgggtcttatggagattaaatgagttaacagatgaaatgtgc

SEQ ID NO: 471831 - DNA, 775 bp, Homo sapiens
aggaaaaccagagacctttgttcacttgtttatctgctgactttccctccactattgtcctggatgaagcccacttgatcatggtggataagctttttgatgtgctgctggattggcctcttttcactttcacttggactggccctgacacccatcggtctcagcaacttacctgggctgtaccgctgcaaggcttcaggcacagcccccattacttcagtcaagcctttcttcatgatttactttctttccatccatctgcttctcaccttattcaatattttgatgaccttctactttatagcccctcctgcgaatggtctcaacaagacaccctcctgctccttcaacatttattctccaagggatattgggtattcccctccaaagctcaaatttcttctccatctgttacctacctcagcataattcttcatgagaacacgtgtgctctccctgccaattgtgtccagctgatctctcaaaccccagccccttctacaaagcaacaactcctttccttcctgggcatagttgtatactttcacctttggatacctggttttgccatcctaacaaagctgttgtacctgagcgagttagagaaaatgtcacactttgagatgaattaagagtccatttatttagccagcggccaacagatggctaatgctcaaaattctctcagccctgaagaaggggctagattttcttttatactttggtttagaaaggggagggggctctagttaaaacaattttacagaaataaagt

SEQ ID NO: 471832 - DNA, 800 bp, Homo sapiens
ggcgctttgtaggaggaacctggaagggggacccgggggtggacgcggagctgagggaatggcattcctcagcagtgctgtgggtggtgcagccccctccgcatccccctgggacctagcaggaccccacatgctcacttccggcccccagctgtccctggctccagccctggcagggcccctgtcttcttggggtgtgtgttggattttaggtgtgcggaggccacagatgtcggacatcattgcgggccgctggcacgcgccctgcagccggcgctcggtcccgtgggtgtctgtgctcccctgtgggcaacgtgaccctggcagcgcccagcagtgctcagtctgccgtgtgcacacagagccccgtgctgcccgctcgccgtgcttggggggcttgtgtgagaggacataccacagggcggacggcaggctcctggtggccacagtgggcccctgaccactgactttgcagaatgtggccaactctttgtggagggggaagagggaagctgactctgccatggcctctgggggtgtccgtgctgtgtcagcaagtgggtcttgggtgctcatgggaccctgctgaagcatccttgctggggccttccatagagcagtcacttaactgtctcaggccttcttctcgtacaggctcttccatggggttttgctcccctagggtccagcagctgaaagcacagcagcctccctggctcttctcaaggccagcgtccaaggagggattgctggggctgcagggagcacaggcagggcctccaccctggcccaccacactc

SEQ ID NO: 471833 - DNA, 630 bp, Homo sapiens
ttaggtaaaggaaactggaggtggagaatacaatgcaaggagtgacgtggggagtcacagatctcttagcattgactgtgtgctccgagcaaagtatggggctgccctggactagtggtgaactgtatacgtccaataggagttgccccacagctcagagttgtggtgggaataaggacctctccaaagccaagcagcatctgaaaactcccgtaattggggatggtctgcagcttattgcaaaacacttgtggcctaagccaagccaaaaaatgaaagtaagagcagcttcgctagcagatacagagttaaagaagaaggcccagagggagcaagaaaagccagttttgcaggagccaccagagggaataaagattcctactccatatgtcacagcctaccccactttaccaaggccagcagccccctgggaaccagattcaggtgctagcacaccccaactctcaccctgaaatgaaagactggagacttgagaggtcagggaaagaagtcaagatagtcaagcaggccatctcagatctggttgtgcttgagatatgcaaatgcctctcagggagacacgaggacccatttattaagataaccaaggccaagtccaagggtgggaac

SEQ ID NO: 471834 - DNA, 779 bp, Homo sapiens
ctcctcacttctcagacggggcagctgccaggcggaggggctcctcacttctcaaacggggtgatggggcggccgggcagagacgctcctcacctcccagacggggtctcggccgggcagaggcgctcctcacatcccagatggggcggcggggcagaggcactccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggtggccggacagaggctgcaatctcggcactttgggaggccaaggcaggcggctgctccttgccctcgggccccgtgggcccgtccgctcctccagccgctgcctcccgggcggcgctcgccggcgcggcggcaaagactgagacagctccgctgcccgctgaactccatcctcccggcggtcgggcggcagctgctgcggtcggtcgcggcagcagctccgcttcatatctgcagctggggcccgcgggcgtcagcgccgcgactgtcccggctccgcactgccctgggccgcagcgcagccgcgccaaccaccacccgcggccaccatggccggacagtataatttcaatggtggaataggttcatgtgtgagattcaggacctcaccaatgggctc

SEQ ID NO: 471835 - DNA, 937 bp, Homo sapiens
cagcagcacagtccagctttggctcggcatgagagggagaccgatcccgaaggtgccttcactaattgctacccacgtggcaagccagggcactttgagaaggggtgcccaggcaccaagaggaatccacctcaaccctgtcgagcctgtggcatggtccactggaatcaaactgcccccagaggtggaggtcatcagcttcagaaccagtctcacagatggtccagaaggacttatgggtcctggggctcaaactcctggctccagtggctcaaactgccattacagcacaggatccccaggagagaacttattcaaaacagtcaaacaggttgttaaggcttatgaagtctaccttaaagataatctcctcaacaagacagcttcttcctctttgaacccaaagggtgggaagctatgcaagggagatctggcagacaaacttcacccacatgtcaaaaccaaagggcatccaacgccttctgaaccaaccttgctattggttctgttcgtgattcaacctggttccatcgatactgcacactatgtgcagggcactgtgctaggtgccctggccttggtgattattacttcgcgggcgtcggagggttgtggcccggcggcccctgttccaggggtggccgcgcggacttggtggtggccgtcctgtccgcggcgggaggtgggcggggcaggcctggcgcccttcctcctctttctgccgcccgggagaccagccgaccgctggggagaggtgggaatgaaggtcagtggactcagactcaggccgcaagcgtcacacttggcctcttcccgcggtggccacgttgaccagatctgtgacccagacttactggctcaataaattgtaccactgttcacctaggatactgggagagtttactcaatctgtatctccccatgtcctaaacaaccc

SEQ ID NO: 471836 - DNA, 557 bp, Homo sapiens
agtaggctcagagagactgcagcatagccacatggtggaaaaagatttatggacagaaaaagcaaagtgacatacagaaaatggggcagaaacagggtttttcgtgttggcaagccttgtctcaaactcctaacctcaagtgatctgcctgacttgaatttcattctctttctttcttttgagacagattctgtctcacccaggcaggcatgcagtggcatgactgcagctgactgcagcctcaaccatctgggcccaagcagtttttctcacctcagccttctgagtagctgggaccacactcatgtgccaccatgctcagctaatttattattattatttttagaggacaagcggcagacaaaagccctcagacaccaagttaaagaaggaagggctttattcagctgggagtttcagcaagactcacgtctccaacaactgagctccccagagttttattaaaaaataatatgttgtatatttatgtattgtgttattaaactgtaaatgttattaaaaatagaaaatctttttttatttaattatgtaaaagg

SEQ ID NO: 471837 - DNA, 626 bp, Homo sapiens
aagtcagcggcaggtctgtgacagcagcaaacagcagtggtggatgctaactgccaaaaaggggctataggaaagcaattagaaaaatggaggctacagaagaaagtgaacggaagcgagaggaatactcaagggaagccttcatatgctcaacaaaacagcccttggattcaagagggcaatgtttatccaaagctgtggacaaattacttcaaaagtcactgagaaactcattcctggagcataacagaaatgaaaagtatacaataagtcataagaagctggcagagccagagttggaattagtgtggattagtggaattagattagaggcttatcttctgcccaccggggagattgtaacatgtcccttgtcccagcactatgttgacgttactcttgccttcacactgcaatcacaagacattgtgacatatttctgggcccagcgccaaggtgatggcccagaagataggtgggattgtgaccctcatatgaaaacccagctgaaagtaaggatggtcaagtaaagatgtaagccatacatcaacacagtgcactgttgaagttctaaatctcacacccagaggcagtcagaagattaaaaaaaaaaaaaggctcttgtg

SEQ ID NO: 471838 - DNA, 724 bp, Homo sapiens
ttgcagtgagcggagatggcggcagcacagtccagcctcggctttcacaactttggagttcgggcagcttcaccctcagccgctccaacagtccgtccatttggctcaagctctaggcagtttctcctggttcttctgttcctggcgtctgagatttgtcagcagggccagattttcaggaaccatgcatggctatcgcctcctcccgcctggagggctgctcctgcgcctctgaccggcgctggttccagccgcggcccagctgagcacagcaggaaccgcagtagcagccggagcgcccacgcccggggtcgcctagcccaggaacgccttagttgcaaccctgcgtcgaggcccagctccgtgcgcagaaagccgaggccaaccagagcatttcctggacgagtcctctcggcctgcggggccagttcctcctaccagcttcctgctgccacctcggcttccatcagagggacgcttaggatggcgcaggggcccggagacactgtgaagaaatgctggggtaacattaatttttcaatggtgccttctgaatcttaacgttgattaccttttatttgagtctattaactaaactgtagtgagctctaagcaattgtaaataactaccttccaaatatgtataatttatattttttatttatataccataaacgtttattaagctgtaatatttacaatattattttctgttctgagatct

SEQ ID NO: 471839 - DNA, 1909 bp, Homo sapiens
gacattagccgtggagcctggttatggagagcgtggtggagaataagttcggcagcatcctgcagatggacatgatggacatgctggccctcatgtgcccctgcagagtgctctcctcactggccattctgcatacatggctgctggtcaaccagactgtggtgctgggcggtgaggtgaagctccgctgtgaggtgtgcagggacttagcatttggaggcgaacagcagcaaggtgggcaccaatgtcatgccctcctcaccatgctcaagcgacgctggcctgggaactgtccaatcaggcacgcagctggagcggaaagggcggcttccgggatgtggcggggtctttgtctctcgctgcagtcggagtatggtctagtgttcgctgttctgcgtcctctggtcctagaggcccatcctctgtggccctgtgacctgcaggtattgggagatccacagctaagacgctaggaccccctggaagcctagaaacgtgtaggtttcttaacataagtttattgtgttttttggttttacaattttagacaatttgcaattctgtttttacattcataccaaattgttttaattctgtagctttgtgttttgaaatcaggaactgtaatgcctccaacattgttttgttttgtttttaatatttttgggtactttattgtatgtagagattctgtatactcgagggattgctgtttctgtttcttcaaaaatgcagtgagaaatttgaaaaacattgcattaaatctgtagattgcattgagcaggatggacatctttacagtattacctttttcagcctttcacaagagcatgctcaagagtgtgttgtttaatttctatatatttgttaatttttcagattttttttctcgttgtatactcatttcattttggtgatagaaagtaatttataaaatttcagttttaaaaaaactgtgttttttatcattagatctctactgactcttgtagaaaaaaaagttggatcttggtttttaaaatttttaatctgttgaaagtatgtctcgatttgaaagttaattttatatatacatttaaataattgataaagacggactgttacatttttaattattttatttgattcttgcatctttgtttctcattttctctctttgtgtctttttgatttttgtattgatatgcttttacttatttctaattcacttttgtatatttgtacagatttttttttttggtggcaccttgggggttgcataaaacttctataagaaacaacagtatagttttaatttggtataaaataaatctcagttgaataaaaaaatcttcctcattacatctgccctgaaatttgtctttgatgttgctaattatgtttttacattgtatattcattaacagttgtttataatttctgtgcttttatttttcaaaatttagagatcatttaaaatgttttctgcaccattatgataatgccacaagattctgtttttatgtatgtgcatatctttcctggaaaataatgtatttttatatgattatgtgtttttttttttaatacttttactttcagtttaaggaactgctttcatcatcttttatatgtagggcatatgcagtgctaatatactttttcagaatttggttgttttggaaggttttttctttttatgtggcaggacagatttgttgatggtattatcctcaacttgatagctttttttttttttttcccctcaggactttgtgtcacacggtatctttctgatctgcagaatttttgttgataattcactggtaatatcataagactatgtttgtaaatgacacattacttttaccttgtagctcctaagactttcttcttgtctttgatttttgaaaatgtgcttaatatgtat

SEQ ID NO: 471840 - DNA, 849 bp, Homo sapiens
caagtcacaggacaacgatgagctttattggctcgagccaggacttctcaagaacatgggatggacatgctctcttgctccttctcataattcaggaaatatacttgtccctggggtggaacattggcttacttgtggggcaagaatatgaaacgctcaccttccaaaccaacagaacctttgtgtgccgctctgggacaaagcttccagaggaaggaacaggcagcaatcttactgttctgcagactccactggtgatactcaggcaaacagggtctggaatggacctccagcaaattccagcagacctgcagaagaggggcctgactgttagaaggaaaactaacgaacagaaaggaatagtagcaacatcaacaaaaaagacgtccactcagagacccccatctgaagattaccaacatcaaataccaaaggtagataaatccatgaagatggggagaaaccagtgtaaaaaggctgaaaactccaaaaaccagaatgcctcttctcctccaaaggatcacaactccttgccagcatgggaacaaaactggacagagaatgagtttgacaaattgacagaagtaggcttcagaaggtgggtaataacaaactcctgtgagctaaatgagcatgttctaatgcaatgcaaggaagttaagaaccttgaaaaaaggttagatgaattgctaactagaataacctgtttagagaagaacataaatgacctgatggagctgaaaaacacagcatgagaacgtcatgaagcacacacaagtatcaatagccaaatgaatcaagaagaagaaaggatatcagagattgaagatcaactcaatgaaataaagc

SEQ ID NO: 471841 - DNA, 735 bp, Homo sapiens
ggcttttcagcccaaccacagagcctcatggagtttggggtgaaagaccaggacaccgacatggcccattttgaccaccagctccgggtgccagctggagccccagaagaggatcaggcatcgtgtttagtcacaacccccactccttcattgggccagcaaatatctatccatcttcccaccgtctactcgcagccaaccatgttcctgacactgaagccagagcccaggctagagtgcagtggaacaatcagagctcactgcagcgtcgacatcctgggctcatgtgatcttctcacctcagccttccaagtagttgggaccacagaagtattttggcttttttattcttatgaattttcgtgtgaatttagaaacagcttgtggattttaaaaggaaatgtctgcttggatttgaatggaattgtgttgcatccagatcactttgaggaaatttgtatcttaattctattgaattttccaacaatagacatgatgtagctctctgttcagctcttctttgattttttaaatagacatttacagtttttggcacagaatctgtatatgttttgttagatttatagctaagcattttatgtttttgatgctgttttaaaattttaatttccaactgttcattgctgccatacagaaataaaacagaaatacagaaatacagggtacaaaataaacttgaccttgtttctttcactctagatagtattgcttatt

SEQ ID NO: 471842 - DNA, 990 bp, Homo sapiens
actagagtcacgacgacatcaacccaataacttgggggcaactcaagaaaaccatgcaggaagctgagaaacaagtggagcatcaaaaccagacaaaaacccctaattacatgttcatggccatgttagccataatgtcctgtgcggtatgttttccatgtgcagaggcaaaaacatatcgtgcatatcttcccaattccccagcagtacaacctatactttggagtgacactcctcctgagatttatcatgatcaaggagcatgggcttcaggacccctaactccccctgacatagaacagttagactctcagaataatgtcattaattatatcgctccactggaaggacttctcatgtgtatcaccacaaagatgtcactcagccataggtgtcttacaattcaagctcaaatatggttgagtcactatagaaaaatcatgtccttattaagtcttagttctattaatgtaactggtgtgctaaccaaccattcccagcccaattgtcctaattgtgctgctctacagaatggattcccttcaatagttcctacccccctccttggacccagtgtcttggcccagtgcctagaaaacaatctatgttaactggagacattatggattggggacctaaaaaaatcaagagtgcacatgaaagcattctcttgaataaggaaggaagccttatttctaatcttctatagactgaattatggaaggtaagattagtgaaacactctatgtccagagcactgaatgtctttctgtccactggccacaggcattaataattggatgcttggtgtctcagggtttattctaaccaagatgactgagagtaatggacacagttttacctttacccaaaaaagtttatttcaagtgaaacattttttaaaaatttactttattaaatataactctaagaatatagagggtttttttttaatgacttctcaagaacaggtattggcaaactttttat

SEQ ID NO: 471843 - DNA, 623 bp, Homo sapiens
gtcctccagcatcctggaatatgggcagagtcagaaggacgccctcgtcagggccgcttccctcccagagaaacagagtcagatctgacttaccttcccaggaccagaaatgcaggactcaggagttgattttggagggcacacaccggcagtcgatccgttcccctccggaagacagtggcctacgggtctctggaacagcttcaggaggtgcctcccctataagcccgctgtccagccaggagagcctggagcgagtccggcactcaccaggtggcaattatcttgctggggcttccaaatgttgtaaccgagcgagttgtagagaaacgccacactctgagactaatttcaggagtccttttattgccggtgaccgagagacagctagtgctcaaaattctctcggccccgaagaaggggctagattttttttatatcgtggtctaaataggggaggcggagtttagctaaagcaatttttacagaagtagaacaggcagaaagttaaaaaaattaattggttacagaagcagttacagaaaaataaacagttccaggtgcaggggtttaaactatcacaaagagattgtgctctcctgaagtcagattgggataggagg

SEQ ID NO: 471844 - DNA, 894 bp, Homo sapiens
accgtggctggaaccggtgcccgccagaggtgcaggagccgccccgcgggcagaaggaggcggtagccgtggtccctgaaaaccaggccctgctgacaaatctcagacgccaggaacagaagaaccaggaaaaatgcccgacagcttgagccagatggacggactggtctccctgaccaagctggtctcggcaagtggcgtccatttgtgggggcttcaatccaggtcaaagggtcaccggagcaatggttggaatggaaaactagctggaggacacccgagtactcttaaagcaatccccatggcaggaattcagcaagctagacgagagggtgatttagagccttggcagttccccattagaacacaacccccagatcaacagggaaatattacagctacatttgagccttttcctttgaaattactcaaagaattaaaacaagttataaatcagtatggaccaagttctccttttgtaatgggactattaaagaatgttactgtttccagtcagatgattcttactgactgggatgctcttactcgagcttgtctaactcctgctcacttcttacaattgaaaacttggtgggcagatgaagcttccattcaggctgctcacagtgcccaggcccaacttcaaattaatataactcagaccaacttttggggaaaaaatcaccgagtcgggccaccagataggggaaaaaagaaaactgctgatcctgaaataagtccaaaaggaaaacattgggctaatcaatgtcattctaagtttgataaagatgggaacccaatttctggaaacgccatgagggtcccgtcccaggccctgttctaaaccggggcatttccagctcaggccattccctcacccctgtacaatggctg

SEQ ID NO: 471845 - DNA, 477 bp, Homo sapiens
gtctgtgtgtgtgtgtgtgtgcacgctcatgcacggaaacctgtgcaagtttaatggtgcagatatgagtgtgctccatacgagaaaattggcagaaattctcaagatctcagggactctcattctcaaagcaaaccccatcttcctcagttggacagaaatagatgagttctgcactgggcagctggaccttctgtccaaaaaaggtcacgcgcacaggatccttcaaggaccacagacaatttcagggatacatgtgccggatgtgcaggtttgttacataggtagatgcaatgccattgctggggagtggctggaattcaaagccagtgggtcttatcctgtgaagctctatgaaagtggggtccacagactgatgctgctcagccccatggattcagctttcttcctaggggtgtttacagaggtccaaattcttgcattttctgagtagctttcacctttgccagagatccc

SEQ ID NO: 471846 - DNA, 728 bp, Homo sapiens
agaatttaggagtggtgttggacctatgaatgtgttggaccccactacttgtgttgaacaggataaaagtcatggagctgctggcccaggttaaaagttccaaacacaaaacattaaaaaataataaaagcacaacatgtgataaatgtggaattcttgttggacttagtcgccagctcaccatgtctaaggtcaaactgatggctcttgctggtgtcaaggttgaccacatggctctcattggcagcactattgttcaggcccagcagagggatacaatcatgattcaatgcagcaacgatcttcgtggtctcatccggaagatgtcagccacgagtgttggacttggtcgccagcttgccatgtctaaggtcgaccatttggctcttgctggcagcagtaccattcaggtccagcagagggatgcgatcatgattcactgcagcctgcatctccccactgcgagcattggacctggccgccagcttgccttgtctaaggtcagccagatagctctcaccggcagcagtattgctcatattactcagcatgaagctcagaaataaaaatcacaggatatacaacaaaaatattcactgtcacgaatttaccttgtaaaaagagaaactgatgttttaatgaatctatgtgactcactaattacctaccacattttcttgtggaaatgtatttattttctgcagccaaaatagaagagagatttccct

SEQ ID NO: 471847 - DNA, 667 bp, Homo sapiens
acagctcattgagaacgggccatgatgacaatggcggttttaattcacactaaaaagacactgttcaaatgtgaagaatgtggcaaagcttttaaacagtcctcaaatcttactgaacataagagaattcctactagagagaaacactacaaatgtgaagaatttggcaaagattttaagtggtcttcaaatcttcctgaaaatgagataattcatattggagaaaaaccttgtaaatgtgaagaatgtggcaaaacttttaagtggtcttcaaacattactggacataagataattcatactggagagaaactatacaaatgtgaagaatgtggcaaagccttttactcctcctcaaaccttactttacataaaatgattcatactgcagagaaaacctacaaatgtaaagaatgtggcaaatcttttagccagtactcacaccttactacccataagggaattcatactggaaagaaaacctacaaatgtaaagaatgtggcagagcttataagtggtcctcaaaccttactgaacataagataactcagaactggagagaaaccctacaaatgtgaagaatgtagcaaagcctttaactggtccttacaccttgctgtacataagataattcatactgaagagaaaccctacaaatgtgaagaa

SEQ ID NO: 471848 - DNA, 651 bp, Homo sapiens
ccaggtgtcccttgccctgctccaccccgccattaccgagtgaaggtgccacagaggagacatagattttccctgagcccctcccccagtaaattgagaaaaagacaagggatacactacagttatgggaccctgtcttaggcaagcagcattagagggggagctcttggcttgcctgatgatggaagatcaacaaggcaatcatgtacatgaacccattgctttcaagacttataaagaaataagaaagagcattagagaaaatggagccactagcccatttatgaaaggattaattgaggccatagcatataacttccacatgaccccatgggactgctttttgaagcacatcttgaccttttgtctttctgttccctgggatgaaaactcatcttcagtgctgtctacaacaaaagagaaacatcatgttactaaaacctcaggaacagagattgcagattgggctaagattgtacactttcttaaggatgatctgcatggaaaagcagcaaacaatttcagaaagatacaagaaaaattgcctctaatgggtacttatactgtagttcaactcgatttgttctgtaagtggtagggaaaataggataaaatacttcatgttcaagcatttttgctgctcagtcagaa

SEQ ID NO: 471849 - DNA, 2855 bp, Homo sapiens
tgggaagagctttttgtccccagacctgatcacctgtctggagcaaggaaaagagccctggaatatgaagcgacatgagatggtggatgaaaccccagagaagtcctacaaatgtaaagaacgtggaaaaatctttaattggtcttcaacccttactaatcataagaaaattcatactgaagaaaaaccctacaaatgtgaagaatatagaaaagcttttagtctatcctcaaatcttactacacataagataattcatattggagagaaaccttataagtgtgaagaatgtggcaaaacgtttaacaaatccttaaccctaaccatatataagaggatgcacactgaagagaaactctacaaatgtaaagaatgtggcaaagcatatgtatggtcctcaaacctaactaaacataagaggatgcacgctggagagaaaccctacaaatgtgaagaatgtggcaaagcttttagccaatcctcaacccttactacacataagataattcgtactggagagaaacgctacaaatgtgaagaatgtggcaaagcatatgtatggtcctcaaccctaactaaacataagagaatgcacactgcagagaaaccctataaatgcgaagtatgtggcaaaacttttcatcgattctcaaatcttagtgcacataagataatccatactggagagaaaccttacaagtgtgaagaatgtggcaaagcatttatatggtcctcaacccttactgaatataagaaaattcatactagagagaaaccctacaaatgtgaagaatgtggcaaagcatttagccgatcttcaaccctaactatacataagaggatgcatactagagagaaactctacaaatgtgaagagtatggcaaagcttttagacaatcctcaacccttactgcacataagatgattcatactggagagaaaccctacaaatgtgaagaatgtggcaaagcctttaactcgtcctcaactcttactaaacataagataatccatactgaagagaaaccctacaaatgtgaaaaatgtggcaaaagctttaaccagtcttcaatccttactaaccataagataattcatactggagagaaaccttacaagtgtgaagaatgtggcaaagcttttaatcgttactcaaatcttacgaaacatacaattgttcatactggagagaaaccctaccaatgtgaagaatgtggcaaagcctttaaatggtcctcaaatctaactaaacataagataattcatactgaagagaaaccctacaaatgtgaagaatgtggcaaaacctttaaccagtcttcaattcttactaaccataagaaaattcatactgtagagaaaccctgataatatgaataatgtggcaaatcttttaacttatcttcaacttttaataaacattgaggtagtttatactggagtaaaaccctacaaatgtgaagaatgtgggaaagcctttttctcatcctcatccctaactacacataagaaaattcatactggacagcaaccctacaaatggaaaaaatttggcaaagcctttaaccagtcctcacttattactacagataagtcatattggagaaaaatcttacaagtgttaataatatggaaagcctaaaaaagtcctcaattcttaacagacataagattattcatattggagagaaactctacaaacctgaaagaaaagacaatgcttttgacaacacctcaaacttttctaaacataaaaacatgttgccaacaaattctagaaatgtgaagaatgtgacaaagcctttaaatgattgtcacgcttgattatagataagataattcatgctgagaaaattgacggtgtgaacaatgtggccaagcttctaaccaatgctcacatcttattgcactgtaaagcatttatacttgagaaccaatgtacaaatattgacaaaaaagccattaatacctgctcaaatcttactcaaaatcagaattcatactaaataaaagcattaaaagtttaattactatcaaaagatctatcagaaaatatgtctataaagtgcagaagagtatttattttgaaaaagcattaccaatatgaagagggttgtaatatctttgcttgtatcacagatcgtattgtacacattttgtactagaggaaaatcttgaggcagttgttaaaattttgttcaacatcaaggagtttatactgaagaaaaccctgccaatgtaataaatttggaaaaacatttttttcaaaaactgcaaattataaaacaccaaagagtttatactaaaatgtatttttgcagatgcattaaatatgaaagatattcagtccaaagttagttagttctatgtaactatcagggaatcattcacagtagaaatatctaggacactcaaactttagacattatactaaatcagaatgctgagtataaaaaatacagactaaagttcatataaacattatttgtatataactttaaaaaaaaattttggagagatgtaattacactcaaagtatactttttgtgaaaatatggaatttttaaaaagtgaataataatggaaattaatgtcttaaattacttcatgctgtttcatcattcctggtgtattcacatgtgaaaatatgtgactaaacattgctgaataaaagatacgaaagattcttttttttaggtaggtgttatttatgaccttttctatggaagggtaaggacattataatgtaggattcatgatgaaaatttaagtagagaggctctttgtggttaacttataacattgagtgatgtatgagtttttgggaacaagccccccaaaatctgtccataaa

SEQ ID NO: 471850 - DNA, 646 bp, Homo sapiens
gcgccttatctctcccctttgaacccagtcccctcttctgcccgagatgctctggctctgctcatctgtccacacccccacactcccggggcgccctgagcctctggggcgcgcagttggatggtgcacaggggaggcccagatttctccaggcctcagcggccaccctgggtaccccgagtctggggccctgttggagggccagtccaggggttcgcccgaggcgcgcgcgggggccaaccgaggcggtgagggcaccgggcaaaggctgcgatttggtggggtgcaggggtcaggcgacagagctggggagataagatgggagataggccgggtgggtggtggcgcagccctggttttggctgagggcagcagcagtgggggctgggtcccccgcttgcctggtagaaccgaaaatgacccagtctcagcagcgcgcaggggcagggagcctgggcgatccctgaacagaggacagccccaggggttttcatagtcgctggcccaccgcatgtactctgggcaagtggcttcgcctttggacaataagcctctgtaaaatggggataataaacctttctctgactcagctcagcagacccaagacccatggggtgaagttggggcctccctgccacagggccct

SEQ ID NO: 471851 - DNA, 1680 bp, Homo sapiens
gcagcctgagtaagacaggggtcgtgccccggggaactcaacgtcccagcggacggactaatatacaagctcacacagtcacagacaaccacagcttgtttgcctcccacactccagggagggatcctggggggtcagccctggagcctggaggagggagagagagggtcccagtgtggtccctgcctggacccagcctctgctgttgtccccagaccacaacgagtgtgccaccagcaccatgtgcgtcaacggcgtgtgtctcaacgaggatggcagcttctcctgcctctgcaaacccggcttcctgctggcgcctggcggccactactgcatggacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccgctgagttccaggcactgtgcagcagtgggcttggcattaccacggatggtcgagacatcaacgagtgtgctctggatcctgaggtttgtgccaatggcgtgtgcgagaaccttcggggcagctaccgctgtgtctgcaacctgggttatgaggcaggtgcctcaggcaaggactgcacagacgtggatgagtgtgccctcaacagcctcctgtgtgacaacgggtggtgccagaatagccctggcagctacagctgctcctgcccccccggcttccacttctggcaggacacggagatctgcaaagatgtcgacgaatgcctgtccagcccgtgtgtgagtggcgtctgtcggaacctggccggctcctacacctgcaaatgtggccctggcagccggctggacccctctggtaccttctgtctagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcgttgcagaccctgcctgtgcccggggctttgcccggatgacgggtgtcacctgcgatgatgtgaacgagtgtgagtccttcccgggagtctgtcccaacgggcgttgcgtcaacactgctgggtctttccgctgtgagtgtccagagggcctgatgctggacgcctcaggccggctgtgcgtggcatcccggagtgctggaagtccagccaggatttatctttgaggacagtattaggttcacagcaaatatgaacacatagcccccacctccacacacgtacagcctccccaactctcaacatcttgcactggggttagaaggtgcatttgttacgatggatgaaactgcacgggtacagcattgtcatctctaagtccatagagcaccttagggtttacccttggtgtattggacattctatgggtttggacgaacgtataatgacgtatgttcaccattgtagtgtcatacagggtagtttctctgccctaaaaatcctt

SEQ ID NO: 471852 - DNA, 990 bp, Homo sapiens
tgtgcaaaggccctggggtgggcctgagggatggaaggatgatgcctctgtggctgaagaacgtggacgagtgtgcaagggacccgctgctctgccggggaggcacttgcaccaacacggatgggagctacaagtgccagtgtccccctgggcatgagctgacggccaagggcactgcctgtgaggacatcgatgagtgctccctgagtgatggcctgtgtccccatggccagtgtgtcaatgtcatcggtgccttccagtgctcctgccatgccggcttccagagcacacctgaccgccagggctgcgtggacatcaacgaatgccgggtccagaatggtgggtgtgacgtgcactgtattaacactgagggcagctaccggtgcagctgtgggcagggctactcgctgatgcccgacggaagggcatgtgcagaactgcttgagcgcccccagactactcgagtgaccatcgctatcctcacctggctacaggtcgtcctggggcctggggagcagatgtgtactgggtggtctatcagggcaaagctaagcacagtccccaaccctgctcccccagacgtggacgagtgtgaagagaacccccgcgtttgtgaccaaggccactgcaccaacatgccagggggtcaccgctgcctgtgctatgatggcttcatggccacgccagacatgaggacatgtgttgacctcatgctctcttccccaacagatgtggatgagtgtgacctgaaccctcacatctgcctccatggggactgcgagaacacgaagggttcctttgtctgccactgtcagctgggctacatggtcaggaagggggccacaggctgctctgtgccccggggggtcccctgaacagctcaggaagggaagccccaagtgtctgcagcagcatttctgaaacgtgaatccctcataatttgatgcaatacagggatgaacacttaaacatttgaatagtgactgtgtt

SEQ ID NO: 471853 - DNA, 1311 bp, Homo sapiens
ggaaatgctgatgtggatgaatgcgaggttggaggacacaactgtgacagtcacgcctcctgtctcaacatcccggggagtttcagctgtagacctggatgaatgcgtctcccaggagcaccggtgcagcccaagaggtgactgtctcaatgtccctggctcctaccgctgcacctgccgccagggctttgccggggatggcttcttctgcgaagacagggatgaatgtgccgagaacgtggacctctgtgacaacgggcagtgcctcaatgcgcccggcgggtaccgctgtgaatgtgagatgggctttgaccccaccgaggaccaccgggcctgccaggatgtggacgagtgtgcgcaagggaacctctgtgcatttgggagctgtgagaacctgcctggaatgttccgctgcatctgcaatggtggctacgaactggaccgagggggtggcaactgcacagacatcaacgagtgtgcagacccagtaaactgcatcaacggcgtgtgcattaacacccccggcagctacctctgcagctgcccccaggattttgagctgaaccccagcggagtgggctgcgtggtacagaacctgtgcccgggtggtgagggcttccagcctaaccgcatcactgtcattctggaagacatcgacgagtgccaagagctgccagggctgtgtcaggggggtgactgcgtcaacacgtttggcagtttccagtgtgagtgcccacctggctaccacctcagtgagcacacccgcatctgtgaggatattgacgaatgctccacacactccggcatctgtggccctggcacctgctacaacaccctggggaactacacctgtgtctgccctgcagagtacctccaagtcaatggtggcaacaactgcatgggtgacccttacccacattcttctcctgttgtcgccaactacagatatgaggaagagtgtctgcttccggcatctacaacggcacatgtcaaaatgagctggccttcaagcgtgacccggaaaatgtgttgctgctcctacaacattggccaggcctggaatagaccctgtgaggcctgccccactcccatcagtcctgactaccagatcctgtgtggaaatcaggccccgggattcctcactgacatccacacggggaagccccttggtgatccctggaacccaccattctactttctgactctgtgaatctgacggttctagggacctcctctgagggggtgggtgagtgtgaagaggagctgtggaggagagaaggggctccactgaaacaaaagttgggccggtgt

SEQ ID NO: 471854 - DNA, 604 bp, Homo sapiens
tccgagtgttctcatttgagataaacctggtacctcagttggaaatgcagaaatcacccgtcttctgcgtcgctcatgctgggagctgtagactggcgctgttcctatttggccatcttggaactgctgaagatattttcttattacaagtgtatacatgcacaaacatctttttaacaaaagaagaagaaaatactcatgacaatttcagtccttgttttgcagctggtcatgtggttgtacctggtattgatgaccgccttcttctactacccattctgtattccctttgccttcagcaaacacctcagcagtttaatggaatcgttgtcgtgtctcctggtggcagcatctctccctctggaactaagaccaccagagacagcgctgtgtggaataccatgacagtggataaggcattctgtgagtccacagatggtagttttggcagaagcattgcatgtgggatcggcaaacccatatctggagtaagtgtctattccagtgaggacaaacctctgtcctttgtataatggaagaggtctgatataatcaacctgctaccaggtagctgcctgatcactgcaaggaatggtgccatatc

SEQ ID NO: 471855 - DNA, 1331 bp, Homo sapiens
gaaaccatgaatgtgatcatctgactcctgtttgagggtgcatccatcttggtgtaaccattctcgcattaatggaatttaaagggtacttgttagacattcattgctttggcagtgtcatgcacaacacagaacatcttgtttatattacgggtataacattttattcaggacttgcactattagcacaagtgtctggggcaggcccttcaagaggcattcctgaagaagacattgttatcataggagataacagctcatgcatgttactgcccctgaagaccttccactgggacaagatgtggaggtggaagacagtgatatggatgctcctgggccctctaaagagagcagattggtggcataaatacaattgccagtgttgctgctgtccgctacccgctccttggaaaaatgaaaggagtgctatttatagctattgtaaaccagagtcaagtttagtaatgctgccacacaacctttcgctggaatcaagcaaggccggtatcatgaaagaagagatgttctgttgtgatgaagctgcatagaaatattttttcattgctttttttgacctcagaagagaaacagcaattggacattttacttatgtccaaggcatacaagagaagtatctgaaatgtagttaaaacaagatttgcaaaatatttgttttctgttgtgtgtgtgtgtgtttttaagtggatccttttgttttcactctaaatttcaaaattctgattgtggcagataagacattttgtaatttgttcatgcatgcttctctagagtcaactacagccaccctcagaggggaatctcttttttgcctttttacattctgtcttctttttttttgtttttcttttttttttttttgtttttggcctgaaatactttttcttgcttcacctggttatccaattatctttcaggatgatgtcacttccttcatgaagtcctcttcacatgctaccttgggttaaatgccccatttgatgctcccttagcgtcctgtacttggcattgtcatagcgttcatctcagtgtaacatgattatgcgtttccttcacttggctatgagttgtttcaggacaagttttttttttttttctttctctgccaatgcctaacattgtgcctggtatagagtaaacaatcagtaaacatatttttaaaataaaggatagacctttcttattaaaatatagaatttgattataagcatgaactttaataaaagggagagtgagaggattataaacctttgaaattgtgcacattctgtgttcgtatactttgagcatattacatctctattaagcttggt

SEQ ID NO: 471856 - DNA, 903 bp, Homo sapiens
ctgaatatctagatgcaaaagaatgaaattggacccttacctaactccatttacaaaaattacctcaaaatggctcaaagacctaaccatgaaacttacaactacaaaacctttgaaagaaaacacaaaggaaaagtttcacaatactgaatttagcaacaattttttggatatgataccaaaagcacaaacaacaaaacaaataacaagtgttggtgatgatgtggagaaactggaaccctgcaaaccactggtgggaaagttaaatggtgcagccactatggaaaacagtatgacggttccgcaaaaagtacagcctcattcctcactatcttctgggcacatctgtgagctgcctgctgatgccatcggctctttgttccaggaagccatctaattcccatggtggggaaccacagccagctcccttacaggactctcagcagtggaatcagcatgatagtcagtctaaccctgttttcttaagatgtatccagctctctactttctccactttgaggttaacagtaagactttggatttagtcaatgagggtttggattcagttccctcacttactaggtgagagacctcaagcaagtcactaagcctctccaagcctcagtttccttgtatggaaaatgggtacaatactgcctacctctataaactagtgtgaggattaagatgatgtgtacagagccagcacagggctgggaaaagaataaacccctaataacccatagctaggaggataaggagaaggttaatgtcaacattagcagtactaccagaattttatcttctctaagacaggcaaaggaaattctcactggtccatctttgagttttgaacttcgtatcttttgcatttaataataaaatagattactgccaaaccac

SEQ ID NO: 471857 - DNA, 670 bp, Homo sapiens
gcgtcttcattcttgaagtcaggaaaactctgtctttccaggaagcagagaaggggaatggagaaggaagaagaagaagaagaaggaggaggaggaggagggagaaaagagagagaagagagatctacgggatgggaaagaaacagccacgcaaagagcaaagcgaagagagtttcaacagataagacagcaagtagacagaacagatgccttggagcagaagacggtgtgggatgtttgaggaacagaaaggaaggccatgtggctggtgggaggcagacaggtcagattaaacagagcattgcagaacagggtaagaagtctggactttactccaacttccataaaatgaatgaaattggccatgtgaccttgaacaatccctttctagcctcagtctccatttttttaaatctattgggcatgggtaagaagccctgcctcatgtacatttcagagattgtttaaatatcaaatctggagactttctggtcacagagaaagatggctaatttacctgatacatttatctgtataaaagtggagtcattggaagactgattgtagaagaaaggaagctgaaccttggggtttctgaaggttaagtctctcattgattggtagtaataatagtaataagagtaaatattccataaatgattactctacc

SEQ ID NO: 471858 - DNA, 800 bp, Homo sapiens
cttctccaacaccattggagcccacagtcctgatatttacaattttccccttgtggtacagggtagaatgtgggtttggaatgaggtactcctgagcttggggtcagactctcaccatcaaacagctatgaccttgagtctgattgtcagtgaaggaaactcatgtaggacagctgagcccacatcacagctttctaaaaacaacttaaatgccaaccctaaaattctgaaaccatggtataaatcctgcttcagtcagactaggtctaggcactgggatgggtctggtccaggaacagtggctgctagactgccagggcttactggaggctgctttggcaaacagaggccagctagtccaggaagtctgagctggaccccagagtccagggtgcttctggagaaagccaaggcttgtcccatgtcaggaagaaacaggctagctgagcagcaaatacaaatcttgatgaagaagaaaattgagaatacagaactggcaatattattcaaggcttggagtctgaagaacaaggcaagatagtaaaaggaagcaaggcataagagtatgtttaagcttcttactggctgtttcagtgtactcgaggtgattggctatataatacactaaacctttcaatacttattttacaaaattattcagctctagcaggctagacaatttcataaggttggtctctaaaggagacttatctgcctataagatgaaacggtgtacatcctcaccaaaaattcttagcatttcaataagttctaaggacactcatgattaacagtaatat

SEQ ID NO: 471859 - DNA, 524 bp, Homo sapiens
ttgttttgtttcaaattgtactgaatgatggataataaatgcacattgtttgggtctccctggggaaagggccgacacttgtgctcatttgcacccaagctgctgagggcttgcactgacagaaacagatgtcagcagggtgaaaccaacacattaattttgcctgatgacctaagccagatgtggatagaagtctccagaggccctcaagatgaggaactttcctaccctgttccctgcacgtgccccactcccacatgccatgtgaccaccgatgttccttctgtccctatcaatggaataatacgaaagcatgctggagagcaccaggggaaagttgatatcactgtggagcacaggaaacccaggacagcgtcacggagaggggagcaaggcgttctgcctctgcccacactgcctcctccactgggataggctcagggttaaggggacttcttacagggaaatggtaagctggagatccccagtagtcttcattgtcactaccaacgccatccaacctt

SEQ ID NO: 471860 - DNA, 1555 bp, Homo sapiens
tgtctgattcaattccacatccacagcacgtaaagcaacgtctggcagagcaaagaactcacccatcaattgaatgacatcatggccaatctacgattttacaacatgatttctgagatctcttccaagtctgacatgctagagtcctctgacaggaatctagagtttctagtaaattctgtgagatgtgaaggccttcttcgaggcctccatattggcatccttcagcttgctggttggagcccaggtgacggacagctgcagtctgggattttcctgaggtcgacttcactggtgggtaggcttcgattactgggcatgttccagcaggctcagggcacccctgtgggcaggtcagtaaatactggctgcttgacgatgtcttggatgggaagccagttggatgagggatgtgtgcgaagccctggaaaacgcagcagttcaaaggctgtgctgagtaggtttccaaatggacttaccctctcagactttgaattccagctccatcggaaaaacacaagtgtttgattccaacggaatggcttctagtaataataataataataaaaagggctttgatgacttcttggaaatcagtttctataaaatggtgttttgagaatttgagtgcaagtcaagcagaaacatggattgaaattcttccctttcatacccattcttttaaaatattttatttttaaatatgaaaataatgtgtgcatattattaaagaatgcaaacactacagtaaagtacaaaataaaaagagcaagtctttcttcctccctcccttctcatcctgtctcatgggataataatttatttatttgtgtgtgtgattacttctagaggtccactggcatcccttggcttgtggccccttcctccatctacaacaccagtaacattacatgtccctgaccatgattttgtagtaacatttccctctaaccacagtgttgaaggtttattggtttttaaagaagacgttgattcttttaattgactaatcaaaatggtatatatttgtggtgtataaaatgatgtattgaaatatgtgtatactgtggaatggctaaatcaagctaattaacaaaggtattaaagtatcttgcttttaatgactcatgtcaaggtctttaatttgattgcatctgcaaagtttcttctgtaatgaaaggtaacatattcacagttttctggaaatacaatgtggataactttatccgtggtggaggctaagaggagccttgttttttctacgacctaacatttcagaatcctcccaaatactggaatttctttaattaagcttcacactgcttatagaattctaggttcaaaaacatgtctcctcagaactttggagacacttgtcctctgtcatttggggtctagtattgttgaaacaagatctgagcgcagtctgatttttgtcctttattctgtcgtttgcattttcttaatgtttgtctttttctttctcatcagttttcctcaaaggtggacccagttgacttccttttatttgtgaatctcttgcttgatagcatac

SEQ ID NO: 471861 - DNA, 1512 bp, Homo sapiens
aataggaacagctccggtctacagctcccagcctgagcaacgcagaagacgggtgatttctgcatttccatctgaggtaccaggttcatctcactagggagtgccaggcagtgggcgcaggtcagtgggtgcgcgcaccgtgcgcgagccgaagcagggcgaggcattgcctcacttgggaagtgcaaggggtcagggagttgcctttcctaatcaaagaaaggggtgacggacggcacctggaaaatcaggaaaatcgggtcactcccacccgaatactgcgcttttccgacgggcttaaaaaacggcgcaccacgagattatatccccgacctggcttggagggtcctaccccacggagtctcgctgattgctagcacagcagtctgagatcaaattgcaaggcggcagagaggctgggggaggggcgcccaccattgcccaggcttgcttaggtaaacaaagcagccgggaagctcgaactgggtggagcccaccacagctcaaggaggcctgcctgcctctgtaggctccacctctgggggcaggacacagacaaacaaaaagacagcagtaacctctgcagacttaaatgtccctgtctgacagctttgaagagagcagtggttctcccagtacgcagctggagatctgagaaccggcagactgcctcctctagtgggtccctgacccctgacccctgagcagcctaactgggaggcaccctccagcaggggcacactgacacctcacactgcagggtactccaacagacctgcagctgagggtcctgtctgttagaaggaaaactaacaaacagaaaggacatccacaccaaaaacccatctgtacatcaccagcatcaaagaccaaaagtagataaaaccacaaagatggggaaaaaacagaacagaaaaactggaaactctaaaaatcaaagcacctctcctcctccaaaggaacacagctcctcaccagcaacagaacaaagctggacggagaatgactttgatgagctaagagaagaaaaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaagagaatttccccaatctagcaaggcaggccaacgttcagattcaggaaatacagagaacgccacaaagatactcctcgagaagagcaactccaacacacataatagtcagattcatcaaagttgaaatgaaggaaaaaatgttaagggcagccagagagaaagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagc

SEQ ID NO: 471862 - DNA, 611 bp, Homo sapiens
gacctggatatgagacctggaggccccaaggctggaatggctaagtcagccaaacagcaaagatggcagcctgcccctccccctgggagtttcatctcgaggaggtataatgctgttaccagtggctggctggaattccaagccagagcatcttatcctgaggatgtacaggagtctaacctcctgcttgccagagttgcagctgcttttgcggggaagcccagaaagcttgggtatctaaggctccttgcccatgtgactttcaaggaaaataaaatccaggtctgtcctatccctaactgcaaatcattccgttgccttcaaaatcaaagccaaacatcttaccatgtgcacatagccctctttgatctggctccttcctaccactcctatttcaccttctaccacttcagtcaggatgacatgagttatcttctcagcaagcagctttcctttattgacggcagtgacaggccaattgccctgatgtacgcacacttcactctccttgtcagactgtaacgtgagagatatgtgtattggtttcttaaaaccgacagattcatgaaatgagagtgcctgggagagaaaacacatgaaaatggaaaatg

SEQ ID NO: 471863 - DNA, 572 bp, Homo sapiens
accactatacccggcacacagtaggtatcaaggcagagcacaggactcctggaagccatgtctgatactccaggcatggttctcaatactccattaaacggtgctcatgaaggaggtatcaatgggccctcgccatgcaccaagggctgtgcaaaaggctgggaatcccgtggagaagagatcagatgctgccctggctctcgtggagcttggggtccagctggagagaaaaacgttagaccaaaacaaattccagacatgcatttactcagcctcatgatttttaagtgccaaggagggaagcttagggaaggcgctagaggaaaaacagccgagggctaccataacaaattgccacaaaccagtgaggacacttacttgcctttggatttagggcccacaaagataacccaggatgatctcatcttgagatccttaagtacatctgcaaatacctttttttccaaataacatcacattggcagtttcccagacatagcttttttgggggatggggttgggggaaaattcaatttactacagatgaaaatcacataacttgtttcagagag

SEQ ID NO: 471864 - DNA, 708 bp, Homo sapiens
ctctctggaataggaggggctggtgaatgaggggaacagtagtaagagctggcaagaccaagctggcaagacctaacagtagtaagagctggcaagatctggaattggaggggctggtggagacactgaaggattgcaagcatacgactgacatgatcagacaggatggtctcaggaaccactctgaagacaactctggctgtgttttggttgttctcagaagacaactctggctgcattttggagggtggtttgaaaagaatctactgctgctgagagaacgtgagagcactgggtcttggaaggagacagcagcaaatcagaggaaagagactcttctctgggtgtgttttggagccaccccttttcgcattcaggaaagagagaaaccaagagacagagaatgccagagaaagggtggggcctgttctgtctgtatttacaagtctgaattcacatccgtggattttgaaggtgtctttccacccaaggacttgagagctgttataaggcataaaagagatttctcactgtattggctaagcttttcctgaaatcatgctacgtccaaacccccacaaatgtagtagctgaaaacaggagtcactgattggtacaactagtggaactagagctgttgtaagggaagagtatatatttattacgtttatttggagttgcacctattttcaagctgccggtctgtag

SEQ ID NO: 471865 - DNA, 512 bp, Homo sapiens
tctgaggaggaggcaatagaatgataatctggaacgacaatcagaattctccatcacacttttcctctcgtattgctgcttcttgtctagtgtttgcttttgtggagagatccaaagctggaactggggtcactacagctcccagcccagtgagtccctgtgccctggggcacttccctaagccctggctggatccatccatgcccctgggcatgcccacaccatctttgcttctgggatttccctctgagatgttggggggcaggggtgataatagtggagttctgccaggatctctttctttaacttcatgggagccccccaatccattttctatagactgggcgcatgtcaggccaccccaatctcagaacctctctggaatattcttccccttgcccttctcaggactgactccttcctgacatgcaggtattagctcaaaactcaccgcacttggagagctttccaaaccaccctggagtagcctgcctacccatgtgcgtttccca

SEQ ID NO: 471866 - DNA, 765 bp, Homo sapiens
gggcctgtacagcagaggagaaggacttaggagcgctttctgggggtgagaaaagatggaggaggcacagtttctgggggagctgtcagctcagttcctgagttgaaaggaatgacagaacattatgctgtcagagagatctgctgctttgctcttcaaaagacagatgcagaagcatccccttcctcacttgtctcttaggaatatcagttcacatctgattgaggtgatccctcatgcttcagggtcatccatgtttcttatgtcccccacagaatccctggtggcccacacattctgctcaatggctatagagctggccccactgcaccctttggatttaactgatactggacccatcatgaccttgacccagccatcaggctcctctgctcatcccttctatctgctggagaaatgcccatcttgctctcagtgcccgggagaggctctcacaactctcagcttctcaggatttcttgttcctagggtcctgcaccacctcctggggcttccctatgccctgccctctccgttacgaatggtgcctctataaatgctcctcactgaccctaggttgcttgtgaaattggtatttttctttttaaaatgtaactattctttttttttttgtctccctcccccacaccaaatgggtaacttttcttttaaaaaaaaaatcaatatgttcattgtgataccttcacttgagattagatcagattttctgtaataaatattagcttttacctcagaatacctcag

SEQ ID NO: 471867 - DNA, 645 bp, Homo sapiens
caacgtctgcttcagagggttgtagatcagatgagaatatgtacattatgtggcactcgtctctctcatggctacaggaaatcaaagtcacttcaaagcttccataaaggccttctggttttcacagcatagcctgaatatacagttggagatcttgtgccttttgttctctcatttcaaggtgtttagtgcagttaacaaaaggccaccccactctaatctgtgtaattattattgtctctgcacattcaattaccgtaaccaccgtaacccacacctcaccttccaactagctcttcatctccgtcagcctcaggcggaagtcttagttatcagaatgccactgggtgtcagggggctggcacccttgaaagcagagcctgagacaaaggcttatatacaagcacttttttgggactatgatcccagggagcagaagtgaaggacaagtgagtggagccaggcaggagagcaagccagtgcaaagatgcattaacctggctacggtcataagcaactggtcgctcagtcccacaagaccatctgaaaagtcctctgaaatgtgtctcagccaacacacttagaggcagaagagggacatttatctactgattgctgtcacccatgggtcacagcattgcctca

SEQ ID NO: 471868 - DNA, 938 bp, Homo sapiens
cagtgcctggcacagctgggtccctgcaggctggctgcggagtgggtggaagagctggcattgccctctcctctatcctccatggccagcccagcaggtaggctagtgtgcatttgggggagggactgtgtggagcaagagggtggaggagaccctggcagcccgagagaggggggctgtgtgtgtatggtccaccatgggccagctgcaggcctctgccctagtctctgatgccacgtatgtgatcatctgcatggatgtgtctgggggtgtggatgaggtcgtctgtgtggacgtgtctggggatgtgggtgaggtcgtccgtgtggatgtgtctcggggtgtgggtgaggtcatctgtgtggatgtgtctgggggtgtggatggtgaggtcatccgtggggatgtgtctgggtgtggatgtgtggatggtgaggtcatctgtgtggatgtgtctgggggtatcgatggtgtggtcatctgtgtggatgtgtctgggggtgtcgatggtgtggtcatctgtgtggatgtgtctgggggtgtcgatggtgtggtcatctgtgtggatgtgtctgggggtgtgggtgaggtcgtctgtgtggttgtgcctgggggtgtgggtgaggtcgtctgtgtggatgtgtctgggggtgtggatggtgaggtcatctgtgtggatgggcctgggggtgtgggtgatgtcatctgtgtggaagtgtctgggggtgtggatgtgtctgggggtgtcgatggtgtggtcatctgtgtggatgtgtctgggggtgtgggtgaggtcgtctgtgtggttgtgcctaggggtgtgggtgtctgcactatccctggagacaataacaatagcagcaggaggagcagcagcagtgaactttcgtaagtcaaccatgcttagcatttaaatgtattatctcgggccaggtgtc

SEQ ID NO: 471869 - DNA, 1037 bp, Homo sapiens
cgacggggctcccctcccacgatgacagccattccagcagcagtgcgtccacagcagctttccccacagcagctccccccacagcagctccctcacagcagcagctcccccaacagcagctcccccatggcagtttcccccacagaagctcccctcacagcagctccccaacaacagctcccccacagcagctcccccgacagcagctccccaacagtagttttccccatggcagctcccgcagttccccctacagcagctccatgcacagcgtctccctcagagcagctcccctctcttcctccctggactggctccaaatcaggatgcatcctgtgggggagacatgaactcttccttgtcttgcccacagaggccctgtgtgtcatcatggtcttaaggacctgcacaggcctgcaagctgcaagctcctccatgatttggagatggtgttcccaccacgcagggccatcccagctgtgcgtttaaaggtgtgagtcccctttccctgggagcacctgcttttttgtaacatgggctctctgcactgaggctgcaatttaatttcaggctggggtactttatgcaaactctgagtgaaatgctgtttactgtttattatttctgcaattatttgcttagtgctggtagcctccgtgttctgtggtggtggggaccatgtacctagcacatatagcaagcatacaataaatgtttgttgaatgactgaatgaaggaatgactgaagggagatataggttctagcaactgaatgtctccgtatggtctctctagacatgggaaaacttactgtgcttttttcttttttctttttttttcaagagtaaagttgatggtaaagggagaatttgaaagaagctaggtactagatgcagtgttgaaagataactaagcagaactactttgggatcggagagatgacaagatccggggccttgcgcctgttgacatactcaatgggccttttgtgggctctacagagggggcgaggacattctgcctgtgggagaaatgcc

SEQ ID NO: 471870 - DNA, 1106 bp, Homo sapiens
tcacagctctggcagttaatgggggcacagatcaggctagtggacacacagcagctgtgagaagtgcaggcacagagctgggcctggcagccacccacacctgcagttccagccacaagagcagggccacagagagccacaacccacagatggagcatagtgaaccactgcagatgggcctgaggcagggcagcagcccctaatgggggaacaggaagatttgcagacagcgctgaccgtccataatcagagctttgagcagcagacagttcgcaagattaaagctgggaggcacagcagcagccagggcccacctgtggaggatgaagaggaatgcacccagggcctgaactgcccagaacttcagaccctggatacaagccccagggatggggaagctaagcagccagtcccccagctcggagaagggctgtccatgggccaggagaaagatgcccctggttgggggattgaggacatggagggctggggaggtgctcgccaagagttcaaatgctgtccccaccgctgccacacggcctaccaagcccccatcatcctcccccaggttactgctgtggcctcctctctggtctccctgcctccacctttgtgcccctataatctgccctcacagcagccagagcatcccctgatgacctaagtcagatcgtgtcagccctcctcagagcctcaggtgattgtcctcactcagtcaaagctaagtgcttacaggagcgtaggaggtctccccacgctctggcctcctttgcctcttagcctctcattccagcaggaactctccaccctctcattgccctacagtctcaccacccttcatgggccttgaacacaccagatgcactcctgctgcaggccctcggcaccagctgttccctctgcaggaagtagccttttcctagacttctgcacagctttctcctttacccacttccagcctttggtcaaacatcacctattcaaggatgccttccctgccgccgtctttacaattacacttctgtcccccttgagccagcagttctgtcactggtaaactgagttatttccctactttgtgtcagttacagagaaagaacacccaa

SEQ ID NO: 471871 - DNA, 805 bp, Homo sapiens
gttcatcctcagaaccatgcaccatgctgccctgctgtgtgccaggccttgtgctgggaacacagatggaggatgcactgtccaagtggggcccatgcacccctggccccattggctttcctcctatgctcattggtgcccaaagtccagagggggccaaagtgtcagggggctggcatgtcagcactgccctaagcatgtgcacacccagccgggctgtgactgtgcccaggcttagtgccgactttgctctaagattggaatgggtgctgacagcagggggaagccaggcagtgggagcaggcatttccaaccctgcaaggacaggggctgccttcctgggcccccaagagtgcagggatgccagggtccatagctgtggtttgggcggctacagctgtgcccagtttgggttggggtgcagggctcctgcttgctccatggagcaggagacaatgggtctgcagccacaacttgggctgctgtggctgcatctggggagctcctgccccaccaacttggaagggtttagaagtaaataccccttcctccaggaaattttcctgctctccttctctgagcccccacagcacagcatcatctagctctatggcaattatttaacaacttgtttccttcaatggattctaggctctaggaaaattgacaataataaatgcctgaactgtaagggagtggaaaaagaaggacgcacaaaccaagagctacaacatgccaaggcctgcttcgagtcagcctcattgggcttcttctatgccataccagttgcaggaaacactgtgtg

SEQ ID NO: 471872 - DNA, 838 bp, Homo sapiens
ggacttatatccgcaatagttcaacaacctgggtcataattgacgaatccaacaaaacctgtggcctgttgagcaggaggcaggacagggaggccccatgaggccgcggccaggaacctcctggtggcacggctgtctgcgtggccggcaacgctaggaacatccggcctgcacgctggaccctggagcctcacacgtcctcagcctgtagaattcccccagcacctccacgaatgaggcaaggggccctgtggacccaaccacaatgggacctgatgcccaggcccaggtcagacacaccctgcacgcccaccaacaacgctgccatgaaagctggcctccaactcagagccgaccatcagggtggcagtgccaggcagcaccaagaaacaacagcactcgaccgcatctgccactggcctgacagcctcgcacactccaggcattttgctaaaaacttccacttgactgaaataatcaaaaagtacactgaccactatttgcacagagaagacgtgagaaggaaagacagtgagttaaacagcaaacccagctgcagtgactttcacttcactgtgggcaaaggaaaaccaacaggttcctctttgctgctgctacaggccaggcacacggtaggtgccccttcacagaagagcagccccatcaggcccgactgccgcactctctgagactccctcccccaatggcactcacagccttcggccccagcaggtcactgtcatctcttcatcacacagaagccctctccatgaacaccaccagtcccggcagagcccccgcccagctcgcacaaaggaggggtggggagtctgacttg

SEQ ID NO: 471873 - DNA, 1172 bp, Homo sapiens
ttttttttaagtggtcaagagtctaatacagagcccatgccctgtgaccactctgagtgagctggcagccctaggagcagcgggacatgcccctcagtgggtgtctcacctgggagacaaagctcgccacctctgagggcgggtcattcttgctgtcctgccaggtcacctcgcctgatgtcctttactgatacgttcttcacatggaagcccaccttgtcaccaggcagggccttggtgcatctccacagactcgacttccatggtgatgttgcatggggcgaaggtcaccaccatgcctgcttccacctgccccacaagcacagtgccaatacctggagggacagagcacccagggccatcagcaaccagaccccagtaggcccccaaccccaagcacctccacaaggcatgaacttatccccagtcttgtacctgcctgtcaggggcagctgcagaggcttgtccgtggagtgggtagcagtgtgattgagtccagtgcttttagcagtgtcacacctgccacattccattccttcctggtgaccttacagccttcaaaccagggcatctgtgactgtgatcatgttcttgatgaagtcacagtgacccatggcatcaatgatggtgacatagtattgctttgtcccgaacttctacagaaagatgttgatgggatgccactcatatggtttggctgtgtccccacccaaatctcatcttgaactgtaattcccataatccccacctgtggtggaagggacatggtgggaggtaactgaatcatgggggcagttccctcatactattatcatgatagttacaggtagtgatagggatggttgggaaatgtagctaatttcaccttcctgtaagctttgttttccatgaattattttgcatcttggtgtattgatgtaatttcttggctataactcccacaagttcataaaaggcactttgatttggtctaagacttcagctcccagctaaaactgcttctagctctaaggaaaaccaatactggggcctggtgcatatatatatatatatatatatatatatatatatatatatatatatatatatatatatatttaatatataatatatatatataacttttaaaaaaatatatatatatataaatgtaacaaggtatagacattttg

SEQ ID NO: 471874 - DNA, 883 bp, Homo sapiens
cccagggcctagtgcagtgactggtgagaaggagaatgacctcgatggaccttcacagatcatttggtccaacacccttatttgacagacatggaaaatgtcattcactgactcccccaatatcacacaacagaatcctcatcatccccatcatcatccccatcatcatcatccccatcatcatcatcaccatcaccatcatccccatcatcatcatccccatcaccatcatccccatcaccatcatccccaccatcatcatccccatcatcaccatcatccccatcatcatcatccccatcaccatcatccccatcaccatcatccccaccatcatcatccccatcatcatcatcaccatcatcatcatccccatcatcatcaccatcaccaccatcatcatcatccccaacatcaccatcatcatcatccccatcatcatcaccatcaccatcaccatcatcatcatccccatcaccatcatcaccatcaccatcaacatcaccatcatcaccatcaccatcatccccatcatcaccatcatcatcaccatcaccatcatccctatcattatcatcctcctcctgatcaccataattgtcatctgcatggaagctagcctatattgattactccctgctgccaagctgtgtcccatttcatcatcaaagcctcttgaggtggccactctcattattttcattttacaggtggtgaaacatcacagagcagtgagctgcatgatgtcagtgtcattgtctgtcttttcattcctgtgtccccagaatggtgtgctgcaggcccagtgcctggcatgtactatttatttattcagcactgactgcaccaccccacctccaaagccctttatatgaattaactc

SEQ ID NO: 471875 - DNA, 1636 bp, Homo sapiens
ttagcccacgacgcaaaggcccaggtgacctttgtgggtgacatcaatggcccccattgccctctggcttctggctggctcctatcaggcagccctgtgcatacatctctggccatgggtccaggtgacctctccctccccacccttcaggccacaggtggtaacagctcctcatattgcctgccagccctgggtgtcatggtcagcaattccctcctcaccaaaacatccagaaacacccactcccgagcctcgtgtagtacgcagagttcacagtgaattagtcaccatcatcttaaccctgatagttgagaaattaaaatgtgttgagaaagcttctggtggtggccgtcagttcttggcattccctggttttcgacaaacacccctccagtttcagcctccgtcatcttgtggcattctccctgtgtgtctctctcctcttcgtataatgacaccagtcatatgggatgaagggcccatcctgcttcagtatgacctcatctgaactaattatacctgccacgaccttatttccaagtaaggtcacattctgaggctcagtctgctccattcagacaaatgcccatctccatccctgccatgtagacccggttcaggcctttgcctttacctctggaactattgcctcagtcttcagactgatttccttgctaccagcaggcaatcaggtcaccctaaatatgaatctgatcacttctctcactgccataaaactttcgatggctccctattgctttcagaataaatgtaaatctgcagggttcagaccagcagctggagatggatgggcaggaagcagtaacaatggatgaaagaccctctgtgcccaggtgggtgggggagggaaaggcaggaaacagagaaaccgcctgcctatggaggcctggagccgccagccggctggagggaggcctgggatgccagaacccgcagggtttatttggattccccaaggatccaagctggggagccctttgcaaacatcagaccagctcatctccatggggtgccaggcccaggacctgtgcgacaagaatgtcgctttcattcatcattgtttgtccccagggcctaaaccagggctggctacacagtaggggcttgttttgctgaatgaaaaaattaatctggcactactaataactaaataattatagtttcatattgatttgcttgtttagaaaaataaaaaggattcccaaccatcccttttccccctcacagctttttgcatatgctgttccttccgcctgccgtgctctttcctctgctttttgcaaggtcagctccttctcatcctctagttgcagctcaaataaaactcttcagtgaagctctgggaacctgctaaggtaacccactttccctttccccctctaacccagcactgggtgatttccttcatgacacttattatcagagatcctctcatttaatatgtatctttatttttgaacttcctgtctctcccaccagaatgtaagctccaaaagggcttcttgctcattgttgcatccccagggccaaggacttagaaaatgctccataaatagtcgttaactagataaagagacgaacacttgaatccctgtaataatgtcattcacaccct

SEQ ID NO: 471876 - DNA, 1821 bp, Homo sapiens
ttgctcccttgagaaggagcacaagctctctgggttgtatggtccccgccactctgggttggttaacatggtaggcaggatcatagtcacctccaaagatgtctgtgtcctaatccctataatttgtgaatgtactgttacacggcaagtgggaattaagtttgcagatggaatgaaggttgctatgcaggattatctaggtgggtccaatggaatcagaagggtccttaaaagtgggagagggcagcagaaaagagtcagagaaagagaggcaaccacgaaaacagggtcagagagatgccatgttgctggctttgaaaatgaaggaaggggtcacaacccaaggaatgttggcagcctccagaagctggaaaaggcaaggaaatcaattatcttccagattctccgaaagggaagtccctgcaaacaccctgattttagcccagtgagatcaggttggtttgagagcataaacttaagttgttttaagtgactaagtttgtagtcattttgttatagcagcaatagagaagtaatacagttaatatgggcccttgtaggtctccagggatgggggagtggggcacagctgtgagagctgttcttaaaaaaaaaaaaaaaaagctattaaaagaaagtaaaagtttcaaaaccaaatcctaggcaaacaaccctgaaaacaatacacacacatacatatacatacagcacccaaggtagctctgagaacaggatatgaaaccttgcaggccggcactaagaaatgattcacaggcctttgagatgcttctatttcaagacacagtccacccactggatctggtggctccaaaaacaaactttcagctgctgtttcttatcgcagtgtggttcgcctggccagtatccttgggtctcaagagctccagacagaagacaaggttgagtcctgtgaattccctttctgttctatttcaagcctcaagctgctggcttgtttaaagaaagtcttttgcatccaccttttggttggctgacccgagtttaaagcaacatagcctaatggagccttcagggtaaccccaccctggcgacacctgcttttggactgctggcctctagaactgtgagagaacaaatttctattgttttaagccactgagtttgtggtagtttgtaacagcaaccctacgagatgagcacagaagctgggctgcagctcagaaagcaacgctcatctgcaagttgggacagcagaggcccttcattcctccccagggctcccacaccttgggagggactgtgaagagtgactcttgtccagtggttttcaaactgggttcctctaagccctggggtattagtgccccagggacccctgaagtttgttactgctgctctgaagcttttcagcatttcttgaaataatgaattccagtaacactgatagctcttggccggcccaccatgaagcccttgatcccagcctggctgagaatagactgtttcacacatcactaactctgccccagcctctggctcagagctagtagcaggacatgaaggtttactgaacaccaaacagatggtgagtgccctgctaagaacttcacatacatctgccccctccatcctcctcactgtgaggaagtgtcatcgtccccaccagaaaaacaaggactgggaggtgtcctgacttgcccaggcagagactgtcatggccaacactttcctccattttggattctgtctgtccagcccccaagcttagcctttcccagactgaatctctctgccttctaagacactggaatgcttcttcccccaccccatgacagctct

SEQ ID NO: 471877 - DNA, 647 bp, Homo sapiens
ggccatggcttgtgtccaggtttctcgcagctcatgaggaactggccttgccttctgtgtccttaccggttttttggttggttggaacgcaattcttttcccagagtattaattatcaatattccttgctgggaaaagaatttagcaatagctctcctacttgcacatccgtttataggctctctgcaagaagaaaaatatggctctttttgcccgaccccgcaggcaggcagaccttatggttgtcttcccttgttccctaaaaattgctattattctgttctttttcaaggtgcactgatttcatattgttcaaacatacatgttttaccatcaatttgtacagttagatacaattatcacagtggtcccgagaccgtctctgctgcctgccctcagcttgactacttcccatggaatcctgacccactttcagatatttaggaacttagaaatcacttcctcatatggagttgtctttgttttgccctaaattcgattaaaaaaaaaaaaaaaaccctaactattgaatgacccataaagcctaaaatatttactatctggcctttttcagaatagtgtactagttcctggtctagaacaatgaatctcactgagaaggatgacaccccacgccatggggctta

SEQ ID NO: 471878 - DNA, 659 bp, Homo sapiens
gcaggcggtggcctgggcctgtgagtctattctaggtttgtggaatgcaagtgaccttgtggcatccttgtccagaggatgacacatacggaggagaaaagcccaatccttgcagcattatcaccattgtcatcactataaacattaccatcttcactattaacatcaccatcattaccaccatgttcaccatcataatcaccatcatcttcaccatgttcaccatcatcaccatcaccatcatcattcttcaccaccatcaccatgatctccattaccgtcttcaccatcaccatcaccatcaccatatcatcactatcttcactatcatcatcaccatcaacaccatcttcactaacaccatcaccaccatgttcaccatcatcaccatcaccatcatcatcaccatcttcaatatcatcaccattgtcactaacaccatcaccatcatgttcactatcattatcaccaccatgctcaccatcatcatcattatcatcttcaccaccatcaccatcattatcaccatcatcttcaccatcaccatcatcatcaccatcttcactatcaatatcaccattgtcaccactatgttcactgtcatcaccaccatcatcctcaccatcatcatcatcaccatcatcatcactaggtagagc

SEQ ID NO: 471879 - DNA, 785 bp, Homo sapiens
ctcccgctaactcaggccaccctcacagtgagaattcacagactaggatgattgggcagtgtttcatgccggcctgctgcctgccagccctgggcctggagaggctgttgatggtgaggctcgatggagaaaatgcttccaaggagctgtctgctatccctggctccaattcctctccccttgagctctcactcctaccactccaccaatggctgtatgccacatatgacccccgtatcacttatgacctctgcatcatctatgacccccatatcacttatgacctctggatcacctataacctccacatcatctgtgacctctgcatcacttatgacctccacatcatctatggcctccaagtcacctatgacctacacatcacctgtgacctccacatcacctatgacctctacatcacctatgacctacacatcatctatggcctccacatcatctatggcctccacatcacctatgatcttcatgtcacctatgacctccacgttgctgaatgcagtatcaaccctaagtcctcagcagacttggcatgttcattcccttgacacagctggccatttcccgtccctgaactatgtccttcattggcttctgggaaacctccctggctgtctcagtctctaacctcttaatgttgaggattggactttattcatctactgtctacacttgtgcccttggggatgccatccagtcttgtgagatccaccatggcccaaagtgaactccacatcttcctccccaggagtgtccccagctcagct

SEQ ID NO: 471880 - DNA, 615 bp, Homo sapiens
tgctcctggaaccatgcaggagttcctcccaaggagaaggcaaggcaaggctaccgtggagcactcagcaccacttcccaacaggatcagacctggggaaactgaccagcttggtccgggagtgttattctgcccaaggaccagtctggagctggatttagtttctagaagaatctttctagctcagcagccccgcagcttcagaagatgggcatgtcagggcaagctctgctttctgcctcttcgaggagtcttgctgccactcagagacctgctcacagaggcaggaaagtcaaggatctgcttccccaaagaacaggctgagcctcacacggccaaatcccagaatggctttcaaggaagagaacccagtgtggaccagaggattcaaatgacctccttggtgtgggactcaccacaggaggtttattttattctttgagcctacagcagagagtgtcatctttctccaagatcagagaaatgcccattacttaatatttaaaacaccatggataaatcatagagaggaaaatgtgcatagatttgaagtactaaattagaaagctccaagaagaagtgtgccagtggctggttgcttcagctcctgcctct

SEQ ID NO: 471881 - DNA, 802 bp, Homo sapiens
gctgaccaccatggtgggagtgagcaagagggagagcgtgactgtgaaagatgccaaccccgaagagacaggaagaccacagtctgaaatattctttgaatccccggatccagccatgcctgaagctatgcacacctggatttttcaggtggcctccccaccaggtcacgtgtggtctgagcagggaacaggctttggtgcagggacctggggggttgaggacacgccacccctcttggagaagaccaccaggctctacctggaggaatggagcccatccagcccccaccctgtaggaatccagcaaacagagagctctggggtaggtggtgggggcacctccaaacacctggatcaagagcctcaaggattcttctctgccctctatcttccctctttcctcacattcacttgctcccaaggctgtgaaaagccagggtccctgggagcccaggccagtgatctgcagagccgtctggctgaggccttggcctgtgctgggaaggagagggttaaggcttgagaagcccttctggttagtgtttaacttgcagtttctgaaggccatcgggagccccatggagctaatgttttctgtcttaatgacactgtagcagatgaaggcgggacccacctcccagagagcattaaaaagaggcatccattacccagaatggcctggcctagaagctggattaactttcccaaagacctgggtggaggaggggtcttctcatccttgtcatcagcaagttttccctgtccccatggtccaagatttgggaggtgagcatggatgccc

SEQ ID NO: 471882 - DNA, 1312 bp, Homo sapiens
tctgataaaaaaattaccctcacatctgaaagtttactgaatgcttactctgaactatgtactcacataacctctattttcatgactttccaggctgtgatgatgacgatggtaatgatggtgataatggtgatagtgatgatggtgatgatgatgatgatgatgataatgatgatggtggtggtgatgatgataatgatggtaatgataatgatggtgacaatgataatggtgatgatgatgatggtgatgataatgatgatgatggtggtgatgatgataatgatgatgatggtgataatgatgatagtaatggtaatgatgatggtgatggtgatgatgatggtgttgatgatgatgatgacaatagtgatggtaatgatggtgatgatgatgatagtgatgacgatgatggtgatagtaatggttatgatgatgatggtgatggtaatgatgatgatgatggtgatagcgatgatgatgatagtgataatggtgatggtgataatggtgatggtgatgatgatggtggtggtggtgatgatgatgataatggtcatgatgatgatggtgatatgatgatgatgatagtgatgatggtgatggtgatgatggtggtgatgatggtgatggtgatgatggtggtggtggtgcaattgaggaagagagcagaggccagtgtttctgaagcaaaagtggggccagaggagagtgtgcaaggtggtcactcacccaaggagttactgaaggaacagcatgcttgtcctgaacaagaagagttgaaagtgatcgtgaaagccatcttcaaacattggaaggctgtcacatggaccagagcattcaagtacataaagcacccagccctgtatctggcacaaaataggtgctcaattaatgtcagtgatgataatgatgatggtgatggtaatgatggtgatgatgatgatagtgatggtgatgatgacgatggtggtggtgatggtggtgatagtgaactcaccaatcaattcccgactaatcactcaggcatgaaggcttcaaagaaatcttgatctacttccaaattatgaagatatatattcaatatttttctcttatctttagtttttatgtttaggtctatgttttatgtcaaattcatttctatgtaaggtgtgagcaaactttttctataaagagtcagagagtaaatattttaagctttgcagaccataacgccctctgtcacaactacttaattctgccattgtagcatggaagtggccacagacagtatgtaaacaaatgagctttggctgtgttccaataaagg

SEQ ID NO: 471883 - DNA, 1455 bp, Homo sapiens
cgtgttgtcagtcgtcactggatgcttttgctacccccttctcctgggcactgcctgggctgcagccaccggcctggtcctgagcctatgaagacaaagtgagggactccaggttcctgtccacgtctgtgctgataaagctgggaagataaagcagcttccgggactgcacagtggagggggaggcaaagcactgacatctgaatcctggaactgaggctgcagctttagagcaacaggatcctgacttgcagccaaagcagccatcgggtccccagtgagtggtgaatcagcagagactccccagacacggctgtgagctcaggttcagctcaggaggggagccagaggcactggagcagggaagagaagaggcccagagagggagcaggatttcccaaggccacacagcaaacatgggcagaactggagacggctccagagccccactttgtgccctcaacaccagctccctgctggacgtcataaccaggggccgtggactctctctcctgtggaagctagtggtccttgaggaaactgctcctgtgatgctggagcccctttcagggtgcaccttgcaggggctggggcctggaggtggcaccgtggccgaggcggcagcccttggcaccttcctctgccagcagatctgctggacagcagccaccccagagcgtggatccctctgcatggctggggctcaccgaagcacagagtacagagccccacctgggctgagcagacgagcctctagggcagcagcacgtggtgccaattgtaactggcaagttaacagctcacagcctggttccggcacagcttcgccagtcttgcgtggagcagtgaacacagcagtgcccgcagtgctgcccactaaggtcctgcagggcttggggagtgggtggccacaccaggccactgacagaggacagagcctggaatcatctggccaaggagagactccttgcctgggggtcaatgtggggctggacaggccattgtgctgagggacagaagccaggggttgaggggaagaagtgagctctaggaaggtagcaagacagaaccccaggcacatgtgtccacaggcacacgtataaggctccacacctgtgtgctcaccagccgcatgatgggccgtgtccgcccagcaccagccccacagagctcagagcagcccaggcctcttctctgttttgttgctcccagaaaattggaaaataaataaatgttaaaatagaatcacaaatactgggatattacctaaatatttacattgtacaaatgaacacttttgtcaacaaatatgtgatgtgtgatttatcaggtaatcacaaggtttatttttaaaaagctaattctttccacaggtgaggcagagtggatgggaaccaggacacacagaggaggctgttagatgaaagtcttgccttctttccctgtgcccctgag

SEQ ID NO: 471884 - DNA, 5575 bp, Homo sapiens
agctgtgcaggaacaatggcgagcctctagccctatggggagcggcaatcggcgcctcactggatcagaagcacagtggacaccctgccggatccggaggggtggaagtcagcagtgggtctgcaacagcattgatcagcagtggtggacagggagcaaaagctcagctcgagccggaacaaacatggaccagaagagtgtgctgttgcaagatttaatagagggtggagtggagcaggctaggctgggcccagttttggggctggctttagggctggacaactgttcaccagcacagtccaggaggaacctggggcctaagcacctgagcactggggaggccaaattccatgatcaaagcagaggggctggggatggaccagccaagggaaagagcacccaggtccggcctggcagctccaggtatccagatagcatcagagaagggcctcccaagaggtgccccaatccccagcagtgtcccctgctgcccacctttgtgggcctgaatgagagtacacagcttcgaaaagcagtgtgtagcagaagacgagagggtgtgtgtaaagctatgtttctagaatataccaaaggaaatagacataaccccaacgtggccttgcagaccctcaatgctgctgcatacccggggcaggcggctacttcctccagctgactttgggaatgtcataatgctcccatttctctaccatgcaaagccatctcaagtcccccttcctagtggtgagatggtttccatctggactggcactcagcagaaaagagaacttcttttcctcatggttgatcaaaagttctaggccactggctctaagaaccacagccccatccctgaatcaccagaaaagatagaggcctggaatatgtcaatcagggtctatcccatgagtgagcttaaccccatgtagactgagagttggggagagggcagttttatcagtaaaagaataaaagtgtactaggccaccaaaacccatagatgcctggagtgagtttggggcagggagcaagaaaagaaaacgtattaacagaaacaaaagggtggataggaaaaatacaaatatttatgcatcctggattgatttcatttcactttcccaataatacaatgatattggagctgttataatcctaggtatagaattctcggtgtttagagttagaaataccttcaatactctcagaccaactctatatccttatttatgtattttaattgacaactaaaaaaattatatatctctatggtgtacaacatgatgttttaaaatatggatacattgtggaatagctacactaagctaattaatatatgcattacctcacatactcatttatttgtggtgagaatacttgaaatctattcaatgtcacttttataggcagggtgtcaaagacccagaaaggttaagtgactgtctccaggtcacatgcctcagggtaagatggtggagtagggaatccatcttcccatctaaatagcagttgcactagcaaaatcttctgatataactattttggaactcgaaagtctatgcaaaggcttgaaaattagagggaaggcttatgtagtacatcacagctgatttccctcaacttcagctcttagttgggtagcagcttccaaccctccatcccacagccatgtggcaggtaaccctgactaacgacttgccatttcatatttatatttgttagctcgctggatccatacatgggttccttggctgttgtgaactggcagtaagaggctaagtgcctgccccaggccccacagcgaggtgttggcttagccaagctatccccagagcatccaatggctccctgaaatttgttcttctgacctctttgtctgcctctctttttctctctgtcccaattctctgcctctccagattcccagaccagcccggatcagcacattcctgcagcctggaaaggaggtggcagtggtttatcagttatgttgctgacaccactttcagcttgaactactttaaacaactctggtattcaagtccaaactcaacaaacccccggccacacccctgtgtcacagcccctcactcacattctgctggtagatgttcactgggaataaccttagtggaggatatttgcacaacattcattaaaatccagatgcatgtggatttgactcagcaatttaaattctactagtaagtcatttcaactcataggaatatttatatattcaaggatgttcacatcatgtgtaaaaatgtaatatcaaaaatttgaggtaatctaatgtctattcataagagattaattacataaataatggcacatttctggcagtcattaaaagataataagcgtgagtcctatgcactggctcaggagactgttcatcatattttttagtaaaaaagtttgatgaaaaatatgaactgtctgctgctgctttgcataaaatttctgatcattttgtacgtgcacagataaatatcttgaaggatgaacacttgtactaggagacccttgaggaaatccttaatgtgtctgacactctctgataacaagaactatctgaggccatttgtgctcaagattaccttccccctctcactgttcaaggtcattgccccagaattcctctgctctctttcctgcatcgtccatagggtcattaccctcatgtgccaataccacattatctctccaaactcaaaaaataaaacaaccccaaatcaaaaccaaaatgaaccctcctctgctacctttgctttcctttacatgaaagcaccatacctgctctctctaattttcctcctcccattttcttttcatttcactctactgggatttcagccctcacactccaccaaaaccactctcattaaggtcaccaatcatctcctcattgataaatcctatagtcagctttcaatgactcttgacctgtggtcatttggtaagtggcttactcctctctgaaaccttctctccccttggctcctgggatcccctcttctcctgggtctcctcctatctccctggctgctcctcctttatttgctttgctagttccttcttggcaccttgaccagtaacccttgagctgtccccaggctctgtctttggtcctcttcttgtcctttctcactcccttggacctttacatgccattcctatgcagatggctccccaatttacatgtcagcccgacacctccctgaactccaggcttatacatccagctgcctactcaccatctccctcatctcggttaaagcaactcaggccaaaaacctggagctgtggtggacccgtcttgctctcataccgcatgtcacatctatcagcaaaactactggtcctttttcaaaacatctccagaactgactgcttctcttcacctccacagccacctcctggtcctccataccagtctcggccccctctctcctggatgattgcagtggcctcctaactgctctcctcactgcctccctccccactaagaatctcttcctcacagagcagcagagtgatctcatgtcatcctatttcatttgtcagattctatctctcctctgctgattctcattaggtcagagaaaaatccagagtccttacaatggaccatctgcccctacagggactgagccccgaaccacaaccaccttgctgaccttggtcctgctgctctccccctgctccctttgctccggccacactgacctcatgcttttccttgaacatcccaggaggtttaaaatttaacattttctcttctgtggctgttggcattgttttatctttgtaccgtatgtgtgcatgtattatttatattttggcgttgttttacctttgtactgtatatgtgcgtgtacatttgtactgtatgtgtgcatatgtgtgtgcatacacatgtgcatgtgtgtgcatatacatgcatgtgcatatacatgtgtacgtacatgcatgtgcatatgtgcatatatgtggatgtgtgcatgtgtgtgcatatttgtgtgcatatgtgtgcataaatgtgtgcatgcatgtgtgcacgtgtgcgtatattgtgtgtgcatatacatgtgtgcatgtatgtgtatgcatatgctaatgtgtgcatgtgtgtgactatgtgcgcatgcatgtgcatgtgtgtgcatatacgtgtgtgcatgcatgtgcatatatgtgtgcacgtgtgtgtgcatgtgtgtgtatgtgtatatattaacctgtgtgcattgtgtgcatatattagcatgtgtgcatgtatgtgcatgtgtgtgtgcatgcatgtgcatgcatgtgtgcacatacgtgtgtgcatgcatgtgtatatatgtatctgtgcatgcatatacatatgtgcgtgtatgtgtacatgtgcatgaatgtatgtgcgtgtgtgtgaatattaacgtgtgtgcatatatgtgggtgtgtgcatatatattagcatgtgtgtgcatatctgtgtgtatattaaggtgtgtatgtcccagcttccgaagtgaggtttatttacagtagaaagggattctacagtttacaaaaggatttgccaaaggcttctttgaagtgctgtgctctccagggactagcagaaaagcttttcatttataaacccttcccttgcatgctctgaagcaacccttaaacacatggtcaatttccatttcaagttctgttcagtttaagccacagtctcccaagttgcagtgtgcagcattgtgcttggcatagtgggggaacaaagatgaagacttgtgttcaaagagtaactggcactgtcaactctctcacagaggagacctctaacgaccttttcagaaactattgccagaacggggactatagcatgagaaaatcacacaaatacacatcaaatgataactgtgacttctgcttctggctaagatggaataacagggactggatttcccatgctgcggaaaacaactaaaaaaactggaaaaaatatatagaacaatgttttttaaacattaggcaccaagcaaagagggcacaatgatccctgaaaggcaggaaagaaaaaggcaagccctgtgagtatttcagctttgtagatcaaaaaacgtttttatttctcctttgtttctgaaaggcattcttttagcgtttagaattttagagcattttaaaatatttatccaccatgttcgcacttgaataatttctgaggagaatctgctgtcatccatatatttgctcctctgtgcataatgtgccttttttccctttggctgcttttaagatttttttaaaaaacactgcctttgagccctttgattaggatacaatgtattagggttctctagagggacagaacaaataggatagatgtatatatgaaggggagtttattaaggagtattactcacatgatcacaaggtgaggtcccacagcaggccgtctgcaagctgaggagcaaggaagccagtctgagtcccaaaacctcaaaagtaaagaagccgacagtgcggcctttagtctgtggccgaaggtcaagagtcccaaagctgaagaacttggagactaatgttc

SEQ ID NO: 471885 - DNA, 1595 bp, Homo sapiens
cccatggctcctgagaggtgggaaggggctgcctgcatccgtgggccctgaatcacgacatagaggaagatgcctctgcttctcgatgttggagctatcctcctgctgtggcaggaggccctgatcctaaggaccttcagtcaacactggatggggctcctttgttctggtcgtcccttagaagctgccctaaagaaccccctggatcccatttcacctgttccaggtgggaagaaagcaagggcaggacaatgccctccaggagatgccaatgtggatgaatttagcctgcagtacagacgaggacactcaaactctccagagatgaagtgtcacctcaaggccacacagataatcaacagagaagcaggccctacactcagctgtactgtgagctccacagcagcagggatactattgtcctggttcacccctgggtcccaaatcccaggacagtgggggcaccaaggagatgcccccataaactggcatcagaagccccaaatagagaagcggcagtctcgtttccaatgcaatggaaaatgcgagtggggaagagcaagcccttaggaggcagccagccactaagaacaaagtttagagggaaagcagaccttggagtagctgattacaacagactagaatgggtgctttgaaaggtcagcgccttgcttcattcacaccgtgaaagtcctggcaccatttgtaattgatgaatcattttaaatggacatattttgcagccagggagagctgtgagaggacacaacctgagtgtttgttggagcacagaggaaaggcaactggccttgtcttggaggatccagatgggttcctagcagagatagggtccaaacagaggcctgaaggacaagtgtttccaaggctttaagatgtcagggtttgatccaaaggttataaaactacaaactcagcctaaaatagaataatctttctttgtgcaattctttgaagagtaacattaatgtaatattattagtttaatgaaaacagctgtagcttctaaattatcagcaagatatttatatatttaattttaagagtcctacttaggtaacacctgttagtcacaggatgtaaaaatggttaccagggaaatagcttgaaatgatgactgtctttgtctaatatctcagttttaataaatactccaagtgtaactgttaaaaataaataaattatgtaaatgtaaatgggatgtttataaatgaaatttttgtgtaattaaaaaccttaaagttactttattttaaattaaagaataaatattcattaagtgtctgggtcatttccaaataagaaaagaactgaaataaaatgctgagcataaatatgtctttgttttggcttcacaaattgtataacaaaagtaaatacatttgggtctattaatgtacattacaattatgttacaggaaaacattttttaaagaataaagtggttattgttacagacaattcaaaacctttagctttgtaggttttcactgaaaattaaggttactatgagttacatttctgaatcatgtatgtaattctgtatacaaaatgtatcaaaagatgtttttaatttg

SEQ ID NO: 471886 - DNA, 1056 bp, Homo sapiens
ttttaaggatttagggaagagtctccatgggatacttgcctccgcaggcaccataggagcagtggcagcttggctgatgagctataagccagccttgtttgggttcctattccttctgctgttgcttagcaactggttggtcaagtatgaacacaagctcaccctcccagagccccagcaggaggaagagaaaccaaagacttctgaaaacgactccaagaacagcaaggccgtgaacacaaaagaagtcaatagaacgcatgcctgctttgccctccaggacgagatcctccaacggctgttgttcagtgaaatgaagatgaaggtcctagaaaatcagatgttcatcatatggaataaaatgaatcaccacgggcggtcaagcagacatcggaattttcccatgaaaaaacacagaatgaggaggcatgagtcaatttgccccaccctgtctgactgtacttcgagttcccccagctaatgaggccgaggcgggctggcctctgccgatgttaccttttacctcagtaaaacccagtcacagcctattgaatgttcatagtaagtcataacagaaaggtgcctaggagccaggaagaggatcagaggctgaaagattgcctctggaaaagaaatctgtacacaccaggtctaccagtctccaccccaagctgtgggtcctttgaatcctccttttctatgaacccatctgacctctcccctctttcccaggctgctcctttcgaggtcccaattcttcctcagcctccgctcccccaccctataatccttctatcacctcctctcctcacacccggtccagcttacagttttgttctgcgactagccctccccagcctgcccaacaatttcctcttagagaggtgactagagctgaaggcacagtcaaggttaatgctcctttttcttcatccgacctctcccaaatcagttagtgtttaggctttttttaatcaaatatgaaaacccagcccagttcatggcccatttggcaacaacccttagatgccttactgccctagacacagaggggct

SEQ ID NO: 471887 - DNA, 538 bp, Homo sapiens
tctacctgcagtactaagtgatttgttcctgattgagcaaaatgtcagagtattttagattctgctttgtgacctgcagtgttctagaccccaacaagccacagtccctgagatgcacagagctctacactgttctcctggaacctgcagtccctggggaagacagaggagtgctgtgggcgggcaacatgtcctgtcccttggcagaaaacagatggttcccccatatgacttgcttcgggcaatgggatgtcggcagacgtgacgctgctgtgacgcacttgggctggctcttgcatcttaccactgctgtgagaacatggctggacagccttctgaaggatgagaggcacacggagcagagccaagtttctcccgtcaccccatccaaattcaactacatcagccaaggtcagccaacatcagccagcaatgatggaaccccccagacatgtaagtgaatccaaccaagagcagcagggctgcctagccaacctacagctgaccccagaggagtgagcaataaatgtgttctgac

SEQ ID NO: 471888 - DNA, 1517 bp, Homo sapiens
cacccattttctggagagctcctgagtccggaggatgatcagagggcctcaaggtcagccagagatgaaagaggagagctttcacgggtctttcctgggtgtaggctcagccctgtacatgcacaaggacttctggagccccaggaatatgctgacacttttcaatgccccctacctatggatatttaactttccagatcctccttttaagtttcttggccagcatattgtttgcttcaactggtattactgtcttctctgctgcaaggataaacaatttctgctgattgtttttagcaaacaccctgaagatagggctttccccacagctgctatgctgctggtgctcacagctacaatggctgctaagttgttgcttttcaaggctactacacaggaggagcagaacaggacgctccttggattgttgcaagcctttgattaatttccagactttctgaacaagttgattttgacaattttaccagtgttcttgtttctttcatagaggagcagaatgtttaaaggcccttcctctgccattccagaattcctaccttaaaggcagctatttgtgctattactttttataatagctttattgatgtataattcacatatcataaaaatcacccatttacaatgtacaattcaatggtatttagtatatcacagatatgtgcaaccattaccaccatcagttttagaacatttttatcacctgataaaaaaatcccataccctttagctatcaaacctttattcttccatcccccaagccccaagattagataaccactaatctattatgtgtctgtatagatttccatcttcttgacattttatataatggaatcatgtaatatgtggtcttttgtaactagcttcttttacttagcataatgttttcaaagtttcttcaagttgtaacatgtattaatacttcattcctttttatgttcaaataatgttcttttctatggttaaacgttttgtttatccattagtcagttaatgggcatttgggttgtatctaccttttggctattatgggtaggccactgtaagcatttgtgtacaatttttgtgtggacatatgttttcatttatcttgggctcatatcaaggagtaaaattgatgggttttattgtaactctatgtttaacactttcatgaattgccagaatgttttccaaaatggctacaccttctacattcccaccagcactgtataaggattctaatttctccacatccttgacacttgtgacactttttagattcatctgatttttctagtagtttcttggcagtatcccttgatgtacaaatgtttttaatttttattgagttgtttacctattttgctttaataactcatgctttaggtgtcatatctaagaattcattgccaaatctgaggtcatgtggatttacctgtatgtattcttctaagagttgtataggtttagctcttaattatgcgtgagccattttgaattatttttcatatata

SEQ ID NO: 471889 - DNA, 599 bp, Homo sapiens
gctgcagagctgtctgtaatgacctgctcctaactggtgctcacggcttccactttaaactgtgacacctggggaagcgatgcagtgtatgtgggtctgtcagccctgcgtcgccagcacccaccgaagtacctgcactgcctttgagggagcagtttttgcaccatgcaagaggggcacgctctgcctaagtgcgagttcactggtgtgctctggagagagagggccctttaaggaggtggggctggagaaggcggcgctgggtttaggaactcctgtcttctctgttacttacaaccaccctggtcctaccagccttcccacattcaggctagtggagagtcagaatggaaatctgggacctcagcccatgagagctgtgtttgaagagggtttgtttatcctggatcccagggtccctgtggcctctgcacagaatgatcgtcactacctgtgctggttgatttgcactgcttcagtagacacagcctgtgcctcttctgctgaaagggaactgcaggtggtttggcatttgattggaatgattgggctgccccaggtgtgcctctgagggtgtttctggagattggcatgatatt

SEQ ID NO: 471890 - DNA, 684 bp, Homo sapiens
gcactgcctacgtgagcagccctaggccacaagacctaggggttgcctggcaggtagagtgaccaagtacctgggactaccaggggacttcctggggcaggggactatgagtgctaaaaccaggacagtcctgggcacactggggtggttggacaccctatcggcagagacaaaagcccaggtcaggtgtcatgtcagtcaagagcggcgtgctgagtcagccgatgcaagccaagctcgaggggggatgtcacaacatgaatttgatgatacaaaggcagatttcctgggctgttaccatgtgccagataagcctgacccacaaaaggagctgaacacctggctggagtgggggagtggggacctggaaggactcagaggccaggaagttgcaatattgattgaatgccaaaaagagccaggcattgggactacagcaggaaaccagacaaacggatcctggcagggggactcagacactgtcttgttaattacagtgaaatgaattaccccagcaggcagccagggaggagatggataacttggtttgatctggtcccagggctcagttgaaatgtgccttcttccaggaagccttccctgaatcccccagacccatttggaaggatagaggtgtgttattcacagacttaacccttgcccttttctttgacattcaaggag

SEQ ID NO: 471891 - DNA, 2248 bp, Homo sapiens
gcctttaggatctggcatataagatgttctctcaccactgtggggagggctcacatccccaaccaccatgggcgcttaaaatggggcctgcaaagtgctagggcgttggtccgccagcctggcggggccatgcaatgcacgtggtagtggagagagcatcttcgctaaatggtgtatccacgcacccactgggtcctgcagcttcctcctccccgctgccacacagctgtcctgaacacctccagctccatgaccacgcggctctccctcctcagtacctgggcctctgcaggacccctcagccctcagtgtcctcccccttctctgtctggctcagccagttacctcttcctcaccctgggccatgatatctccatcttcgccatgggtgagacattcctgggccaaagcacctaccatggctgggagctgagcagctcttccatttccacagtccctgtgggtcccagctctgagctcagcagcctcacaggaggagtggaatcattacctaagagccttcagttaacaccgaccccagtaacaacactggcttgcctcatgtggagactcaaagggaaagccgtgctggtgatgcagggcaggcaagctctaaagtggggcttagccgctgggttcttggctttgcccaggaaagaattcaagggcaagccagaggtagaagggaacagctttgttaaggaggcagtgtcacagctctgtgactgctgctgcagagcagggctaccccataggcagagagtagcagctcagggcagttttgcagtcacatttatacccacttttaatgacatgcagattaaggggaggtttatgcagaaagatctagggaaggggtagtaacttttgggtcattatgtcattaacatggaaaggggcggtaactcccgggtgttaccatggcaatggtaaactgacatggcacacaggtgggcttagctgattgaaagccgcttccaccctggctctgctttagctagtcctcagtttggtttggtgtctgagccctgcctctggagttgagtcccatctcctgcctccttcccatttctcctgctccttaatcttaagggggctgcagaagggtggaagtccattttctgcacctgtttcccgctgagtttatgggcataggccctgcctagcactggaggagtaaaaatcgctggatacctgatctaaggtgtctagaggcaggatgctttcattctctgggttagtaggtgagatgagttggaagcctggtgccagctttgcctttacctgaaactgttgtaatctagaagactcaaactttattaagaggttaaacaatcaagggccaaagattagcagcaagacatctattaaaggtcctaggagaggtaaaaaccaggtgagacttcagaaggcacttttgatagttgaccagatatagctggggtctgtgccctaattatatctatgtaacaaggtagcttgctcatagacgttttgaatgttaatcccagcttgtctagagttgttaatatgtgtgcagcaggttttattaataacttcacagactctaccttgttcagctagtaaacaatccaacgacagtctgttatggaaaactacatttgccaaagagtttaagactcttaaattccctttaatgcctgacctgtgttggtggctaagggtttgatcaagttccttagggttgactcatggtaagcaaagccaccccagggtgctgctagtcccatcactatcccgattcctgccagcattaattctactactcacttactcctggtattcttgggtcttatgggattagacacagtggcccctggagggtcaagaatggccaacgtacattcatctcttttccaagttttcaatatacaagggaaaactgcccctaaaaaacaagtgactccctagggagttgggagcagttatggggtgtgattttttcctgtttatggccacaaacaaaaatgagcccagttgggccacaaatagaggctctacagggtgtgatattttatactttgctgccaagttgggtctgcagagatattctctccccttgccacaccctggttctagtgagggtggttggacaatccttgttttccagagcggagcggggagtactcccaccttcccagactaggcagttgtttttccgttgtatgttctgatccatgagaaggcatcgtatatgctctccttgcttacacgtggaatcccattt

SEQ ID NO: 471892 - DNA, 809 bp, Homo sapiens
cagtttcccatctgcccagtgaggactcctggctggccaaggacatgtgggtgctgtgtccttgtgacaccagtgaaaatggacagggatggccctccccgctcccaggcccagtgccgggtgcttcacccctccccccactcactcctcatgagagcccattttgcagtccagagatgaccactgttgaaactcatggtgcattcatgaattcgcccatctttactgggtacccgctctgtgctgacactgtgccaagcgctggggatacaacacttggtgcccagtgtggagcaaaggaagaagatggcatgagagatggcaaggcggtcggtgaggcagcagccagcaggatgatgaaccgagaggtggtgaagcagagctgcagcacctgagcgccaacattagccaaagctcttttcacagccaccattttccctggtaggcagcagagccgagcagatggcccttttctctcctgactccattgtactgttccaccagtcattttattttcagtccttaaacatgtgcaatattatgtttgcttttaattttctgctaattgtgtgtgggcagttgtttaaggcaggccacatggttgtgagaggtcccctgttgtgttgactctggggcaccagagtcatgttgttatgtgaccccaacgtggtcttgggttcactgctagctgcctcctgggtgccccaggattttcagccttggtgaggggaccctcattggctgaaactcaaacattccaagttttcagcattggtattctggccacccctggatgctctggggtcttt

SEQ ID NO: 471893 - DNA, 649 bp, Homo sapiens
aatcttgctaatttgatgaggaactgctgtttcatttgcacatcacaactggagccagcaggagcatccctcacagaagttctgctggctaaaagagggagtcattctgaccgcatctccccccagccccagggtatttggaacaaatttggtcctgggccttacatgtccaagacctgcatctctgctcagggccccaagtgggaggttcctctgaacatgcctgatttcacgctaaacagtcctcgagcttttgttggcattggccccattttcatggacagggtttttgggggcctagggccttatggcagaaggaagcatgaaacagaagtgcagagaatccaagatgaaacccataagcgggtggacaggcagggttgcctgggtccctgtttcacgctgcgtcagacccaggtcccttaagttccttaggacaccctctagagctagtaccctcccatatctcatttttgtttgcttaaactagactgaatgttttcctgttatttacaaggaactctaattccatgcccccccccaaaaaaacaaaaaaaaaacccctgttcattaaaaaataaaatctgcattaaaaaagctccatttctaatactgaatgtctttttctcggagagccctcataaataac

SEQ ID NO: 471894 - DNA, 2594 bp, Homo sapiens
ttcttgctccccagaacccacatgtcagtttcttttcattttggtgtttttcctatggctgtagcatggcccagtctcagtcagagtcacataagaatataccccgagtctgtacccagcttctgttggaggcctgtgtccaagctacagtgccaatcttcatctacaccagtaccctagaggtagccaggcccaattcctacaaggaaatcattcagaacggtcatgaagaagagcctctggaaaacacatggtacgctccatacccacacagcaaaaagcttgctgagaaggctgtgctggcggctaatgggctgactctgaaaaacggtggcaccttgtacacttgtgccgtaagaccaatgtttatctatggggaaggaagcccaatcctttctgccggtataaatgaggccctaaacaaccatggaatcctgtcaagtttcagcaagttctccagagtcaacccagtctatgttggcaacatagcctgggcccacattctggccttgagggccctgcgggagcccaagaaggccccaagtgtccgaggacagttctactatatctcagatgacacgcctcaccaaagctatgataaccttagttacaccttgagcaaagagttcggcctctgccttgattccagttggagcctgcctttatccctgacgtactggattggcttcctgctggaaatagtgagcttcctgccgaggccagtttacacctgtcgaccgcccttcaaccaccacagagtgacattgtcaaatagcgtgttcaccttctcttacaagaaggctcagcaagatctggcatataagtcactttacagctgggaggaagccaagcagaaaaccatggagtgggttggttcccttgtggactggcacaaggagaccctgaagtccaagactcagtgatcgaaggatgacagagatgtgcatgtgggtattgttaggagatgtcgtcaagctccatcctcctggcttcatacaggtgacaagggcaaaagtccaggtcctgctgcctccctttcacataatagccaacttattgtcttcctcatgtcatcaaaacctgcccagtccctggcccaaccagaagctttttgtcctaatcatataccagaggaaagacaatgtgatttgctttttccatatctcagtggctgattccgaacaattgtagtctcttctaacttgaggtcatttttaactactagagctccatttctactcttaaatgagaaaggatttcttttcttttaaatctcctatttcttcacgcagtccaatgtaaagagcaataaatgttttaatccttaacctggagggaggtgtagtttctgttaatacctagttccctccttttcttttcatttccaggtatcaccatcttttacctaggagagtagcatggagctggggaaggggggttggcagagtagtgggaggatcaggaagggcgatgaagactgaataagctctactatgtttcaggcatctacaacatgacctacatgtgacatatattccctcactcaatacttatcagaaacctatcacgtgggggtgactattcccattttacccttaaggaaacttgttcaccatcacactaatgattagtggctaggcctgctaccaggaagttggtcttgaaagactttatctttccctagaatcatgcagcctgaactggtcttatcagtggtacagcagagcactggagcatgggatgctgatacttgggagagccccagctttttggggttacctctttcttgcccaatctggtacaggggaatctctagaaccaaggataatccctgaggggcatctgaaagggtttgcatgcctttcctaatgggcctgagcagggcagagagaaacaaaaatgcatcaggcctccacccgcttcagtgtcaatttatttgaaggtctctagaacactcctggctatatgtgtgttggccattctgatcatacataaccctgcatttcaccctttcaaatcacacaatgagccacaccatgggttcctggacaagtacaaaaaacaagtgtgaacttcctccaaaatataccttctactcagcccaaaattagaagtctactatcccacatccccagatttaactgtctctctcttctttctccttctcttctttaaatcaaatcctttcttcctttattcttccatatccatagcctctttcttctctccatctcctctttaatcaatggttctctcattcttctcaatttccctgaagagaggaggccaatcaagacaagtttggggacttcagtgatgacatagtcattaaccaatcaatgaaaacacactcaaaagaaacactgtcaggggcatcagggacagagttgaactgaagcaggtgaggaggttgctatgggtccagagtgtggggtggaagctgtctccctctggacctttgtgtatcacagccatgatgagagtcacacccaacatcaagatggcttttttcttacacaggaaattaacagatcattactcagttgaatttgattaccacaatggagttagtttcagtgttcattctgaagaga

SEQ ID NO: 471895 - DNA, 3759 bp, Homo sapiens
gggctgacaggtcggactctccaagacaaagtctcctctttctgtctccacacagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggtgagctgagtctgagagtttgggataggaagggcctggccatgtttctcaataccatacttggcagtggaatttaataaagctaagctagatgggcgcttcatgaacattctcacatccctattaactaaactgggtaaaatgaggcccacaaactgggaaagagaaaataaactacattcgctgaatccttgtgaggggtcattatcttttggagtcagcctggcctgttttgtgctttgcatatgttttgcatttctacactttctcccatgtaaaaacacaattgagttttgtttattgattttgcatccagaaatcttgcttttattaatctatataatttatctatttggattttgtttgttttctatgtagacaaatgacagtttttgttatttcctttccagttctttacatctctcttcccttccctttccttactgtactagctaagactgttagtatagtgttgcatagaaatggtgatagcaaggaacccgtgacttattctggattttaaaggaaatgtggtcatcgtttcaccttaagtatgacacttgctatgttatttatatagatgccctttatcaggtaaaggaaactcccttctcttcctggtttgctaattatttataattattattataattattacaattacaatatttacaattattataattattattattgcacagtgcatttaatcacatgtgttttttccatttctgagataatagtatgatttttatcttcgaatttattaacgttaatttaaggagttagtgtttttttttttaaatattaagttttttaaaatgttaagttcttgccttgctggaacaaacccaatttggtaatgctatatctttttcgtattttgtgaattcaatttcatgttttgtttcgggttttcaatggatgaattaactggcctgaaatgatttgttctataatacccttgtgagattttggtatcagggttttgctagcttcatagaatgaattgtggattatctttttgttttctattttctgggataatgtatttaagattggaattatttgttctttggacattttgatagaatggctggttaaaaaaagtatggactgatgttctctttagggaaggtgtttccttccctactgattcaatttatcttgtggctataggtttattcagtgttgtttttctcttgaatcaattttggtaagttatacttttctagatatctatttgtttcatctgagttttcaaatttattggcatgttggcatacagtatttcacaatagcctcttatctttaaggactgcgcacttgtaattatacattccaaattttagctagttatacctcctctcttttccttaatcaatcttgtcagacaattgtcagttttttcaaagaaccgatttttggtttgttcatcctctccactatatgtttgttgtcaatgtcaccttccgttcagtttatgctactatttataaagtcttaaaaattaagattagttcattagttttctgccttttttcctttctaataaagtcatttaaagctataaaagaaccttttaattatcgcttttgctgcattcatagacttaacatacagtcttatcattcaatctcaatattttatcatttttaattacaatttttctttgacctatctgttatttaaaagtcccttccctccccttctcttccctccccctccgtttgacatttctaacacattctctactgcctattctgttcttactcacctttattttttatattcacactaagttgtttactctcatcttgttctttcctcttccatcagttgttcatattatttttcttttccatttaaatctcgcttcatcttattatattttcacccacttagattccactttttataatcccatttctctttgcacactgcccactgctcgtatccgttctgtattgtttcttatcttcctcctatctctaattttttccttacaatccgattgatctctcttgcacattttttttcggtattcccagccttctcttcctctacacttattgttttttattataggctattgtatctaataagccacgagtatcttatcccgtcaagtcagtgctcttgaccatcaaagattttatttccccacctctcctctctctctttttcagttgtagtgtgtgtatttcacatccagactgtgcgcatccatctagaaaaagagcgcgcacgtcattaactcaaatcgcaacataccatagcaa

SEQ ID NO: 471896 - DNA, 1122 bp, Homo sapiens
gcttgggcctttaggtttaggggggttgggaggtcagaataggagtaggggtggggctcaccttgagggtctccagcacacctgcagcccttccatgggacactgtggggatggcagagggaaaaatagggctgtcgttgtctctgacaacatcctcatagaacccttctagcaacaccatccctaacgggtcccagtggagctgtccggggtcctgtcctcagcctgagcactccaacgttgcccagactttcatcggttctggttcaatagctttgtctctaacaggtactatcctgcctgccccatggggctgtggggcgatgcttctgagaagatgctcgaggccaggtgccgtggctcacacctgcaatcccagcactttgtgaggccaagaggacttcctgctgcctcacgggggccagcgttttcagcttctcctcacctgcctccaaggtttgctgtgccccacatactgcctggcacagagatggggcttggcatgtgggctgggagctgggcagggccatgctggactccggccacccggccccctgcccaaggcccttggctgtgcaggtgaagcctggctttgggaagcatcagcctgtgtgtcccagaccccagccagtgctcctttgtcatccctcggctctcccaagcgggctcctctgcccccctggagctcacaggttgacaaatattgtaacagcttcctgctggtgggggaggcaatggctgtccttcggtctgctgtttctcagtgagaacaccgcagcaagtccagcctcccgctcctggctggtcgtcaggggaggccacctccatgctcccaccagcgttgccgcctgtcactgtgcctttgaagtggtgcctgattttccagtctgtctgaagttgctcgctgtttatgcagcagctggtccggcaagtccccccgccgggcctttccatgacggtgccagccgctggggactcggggagacagccaccgggcctccggggggataatgggaagaagccgagatgccatttctgtcttcagggtcttctagactgagtttgcttattttttgcttaaaaggacaaaaaaaaaaaaaaagagtttctatgaaccccaac

SEQ ID NO: 471897 - DNA, 832 bp, Homo sapiens
gccaggcaccgcattattctggaagcctcacgacccagccatcctcggagggtaggcacgtgggacaggctgtccatccactgggtcactaggccagccagggatgctccagcccccagtgcccacagcagcgttctctgtggctgatgagggaccggaggccccgtctggcccctccccagaatgtgacgctgctctcccagaacttcagcgtgtacctgacatggctcccagggcttggcaacccccaggatgtgacctattttgtggcctatcagaggtgccagaaaacacctaatatttactgtgtggctggcactgtgtcaacacatgtaatgaacttaatctcacagcagctctctgaggacaagttcaatttaacagatacctttccagctgtccattacgacaagatgttccaggtccctctgactcttggacttaagttagtggtttgctgggggctctcggatctttggtcacagactgaaggctgcactttcagcttccctggttttgagggtttcagattcggactgagtcactatggcttctttctttcccaccttgctgacggcctatcgtgggacttcgccttgtgatcgtgtgagccaattctccttaataaactccctttcatatatacgtataacctattagttctgttcctctggagaaccctgactaataaagggttgttgctttttctttaaaatctagtaattttatttgactgtgtgttggtattgctcattcattctgagttgatatttttaggcactcaatattctcacttaatacatggttccaaggcatttttattttaggaagg

SEQ ID NO: 471898 - DNA, 828 bp, Homo sapiens
tgctgtgagacacatatggctatggctaggaccccacaaatcatccagtttccaaaactttcaaagtacattccatcctcttgttcacaaattctgtacttgctaaaagttatttgcaacttcaaaatcaatactgctagtgcttttgtaatcattcgcggacatcgcagagtagcgaaaaatttgagtcgctctaccagtaccttccggctaaggtccagcaaggaccttctttcccatctcatgcaaagctggccagaggacagggacggtagggggcagcgcagggtagtgcaagaaggtcctgctctggggaccatttggcggggtttgaatcccaactctggcatctctgaccttaaaatcaggagattatcctggatcatctctctgggtgggcccaatgtcatcgccagcatccttataaggaagcaggaggcagaagaagagtgagtgtcagagcgttgcaatgtgggaaagactttgccatcattgccggctttggaaagggaagagggtcatgatccaaggaatgcgggcaacttctagatgctgatgaatgcaaagaaacagtctcccctccagcctccagaaaggaatgcatctttgctgagaccttgattttagctcagtaagactgatttcagcctgctgacctttagaactgtatgagaataaacatgtgttgtgttaagccactaaattcatagtaatttcttacagcatcaataggaaactctttctatattcgtgtggcattttagtgttttcagatgctttcatctatgtgaccctgcatgatctttataattctgggtgagggagaga

SEQ ID NO: 471899 - DNA, 612 bp, Homo sapiens
gggcgggaaaaacaccactctggaaagtttgagattctgtgtcaacagatatcaacgtgacggctgatcaacatgatgatcctgttagaaaataccatgagtccagagacacttttgagttatccagaggaaggcattgtcatcataggagatgacagctccatgcgtgttattgcccctgaagaccttccgctgggacaagatgtggaggtggaagacagcgatacggatagtcctgtccctgtcacagagcccgagttggggaataaacagcaactactgaagtgtccattgttcccccacttcaagtcctgcataaatgtaatgatggtagttcccaaacaaaatacttcctcactgaccagacacaatctatgtagggtcaaagggccctctgaaggtttgctgaaaaatcaactcttgaaaggcagactgataggagaaaaggtcttatggctggctttggggcaaaggggttttgtcctggagacccgctagaaaagagggattccagtttctatgctagccttaggagagaataagagtgagacaggagggcaggagaaggtcagagaaaaacgtctgctttctgaggctgttgctgaggctgtc

SEQ ID NO: 471900 - DNA, 888 bp, Homo sapiens
gatttctctggatcaggaaggcactatgtacgaggaacaggccctctgcagacatcgaatctgctggcactttgctcttgatgtagacttcccatggacagttctggtggaggctcagaataagagagttgtagaagagacttcagtccccttagaaattacccaagtggtcataaacaatatggaccctaaaggccattctgatgaggtctcagacagaaataaagaccatgttactgaaaactggaggaaaggtgatccttggtataaagtggcaatgaacttggctaaattttgtccatgtcttagtgctttgtggaagtcacagagcacactggttgtgggcgtgtggctgtgggctttgcttagtaaagtcatggaggtggggccacttggagccatcaagatttcaaagaatgacccagagagcttgatggtacaggcagagaactgccacaggagtgtggccaccacagacagccttcaccaggctccaatgcctagtggagccatgaggagtaagagaagaatgatcatccgtggcaatggcagtttcagtgagaggtaaccaatttcctaaaatagtgaatatcactttcaggttttaaaaaaagaaaaaaaccatacttctatgtcacacacattttgctctgtggcttatgcaagtttctcaagaggtctgtggttgggaggactccggccaggtcggctgtgcatatgcttctagaacaatcagattttccttctttgcttgctatggagtctttgcaagtcttcagatgtccagtacttggcacctgtaaggctacaaagaggcagtagataaatatattttggggtgtcacttccatgaaatatagtttaaagttttgtcagcactgctatgcc

SEQ ID NO: 471901 - DNA, 1291 bp, Homo sapiens
accaccgctttttgttttatatctaggaaatctttgctcatttcaagacactgatatagcagaatgaagagaaagaacttcacagaagtgtcagaattcattttcttgggattttctagctttggaaagcatcagataaccctctttgtggttttcctaactgtctacattttaactctggttgctaacatcatcattgtgactatcatctgcattgaccatcatctccacactcccatgtatttcttcctaagcatgctggctagttcagagacggtgtacacactggtcattgtgccacgaatgcttttgagcctcatttttcataaccaacctatctccttggcaggctgtgctacacaaatgttcttttttgttatcttggccactaataattgcttcctgcttactgcaatggggtatgaccgctatgtggccatctgcagacccctgagatacactgtcatcatgagcaagggactatgtgcccagctggtgtgtgggtcctttggcattggtctgactatggcagttctccatgtgacagccatgttcaatttgccgttctgtggcacagtggtagaccacttcttttgtgacatttacccagtcatgaaactttcttgcattgataccactatcaatgagataataaattatggtgtaagttcatttgtgatttttgtgcccataggcctgatatttatctcctatgtccttgtcatctcttccatccttcaaattgcctcagctgagggccggaagaagacctttgccacctgtgtctcccacctcactgtggttattgtccactgtggctgtgcctccattgcctacctcaagccgaagtcagaaagttcaatagaaaaagaccttgttctctcagtgacgtacaccatcatcactcccttgctgaaccctgttgtttacagtctgagaaacaaggagtatttcaatactattcctgctcctccaacactttgtagatgagtgaataccccactagtgtttgttgttttacatactttgcatggatttagactcactagagaaagcagcatctacaggcaaagtgcaatagcataagatatgtaattacaaaatgctcaacattggggaaaaaaacaacattgtggcccctatcaagagaaaatgagtcaacacgtcaaccctaagatgactccattcagtagtcaggaactttaaagtagctagtgtatataggctcaagaacttatagaaaattttcttataataagtaaacatatgtagaatctcagtcaagaaatct

SEQ ID NO: 471902 - DNA, 1086 bp, Homo sapiens
gaggagctcctccctgccccgttcagctgaggacaggacctatgtgtataataccagggctcgggttaccacgggtgagaaatcgtggtaagtcagaccgcccattttctccacctgaagggaattcagaaattttaaagagaaaagaaaaacaggaacaagaacaacagggaggagctcctccccccacttcactcccttctgtggggcataaagaaaaaactttttctagtgatgaggatggactggagcttttttctccccagaacttgaaagctttgatgaatgttgtgaagggtgtggaagtgattagagaaatggaggctaccgaggaagagggaggaaaagggagcccatgtctttgctgctacacaaacacagcaagagccatgggccacagcaagagccacgggcacaagagcaactgggagtgtgtgcctaagaagttacatggcatgaaaaatgaaaacagagaaaaggcaaattgcccccgaggcactagcaaagctgtgcctgttgtggcattcaaggccctgcttaacctaccaggggacaagaacccaggacctgctgagctgcaggtggcaggaacaagctgtaacatacccgtatttgctgagctgtgggcactgggaccaagtgagagctgtgacacacccccattcactgaactgcaggcagcaagactaaataagagctgtgacatgcccccatttgctgagctgcaggcagtgggactgaacaagagctgtgaggtgccctcatttgctgagctgcaggtggcaggaacaagctgtaacatacccgtatttgctgagctgtgggcactgggaccaagtgagagctgtgacacacccccattcactgaactgcaggcagcaagactaaataagagctgtgacatgcccccatttgctgagctgcaggcagtgggactgaacaagagctgtgaggtgccctcatttgctgagctgcaggtggcaggaacgagagagagagctgtaacatttcttggggtctcaggccttgggattccccaagcaaagctgtaacaccccttagggctccgcagttgctggcatctcc

SEQ ID NO: 471903 - DNA, 650 bp, Homo sapiens
ctgagaaacagagacagctggggaaatgggggctgtgtgctccatgaagtcatctaatgaccctctgagatactcatgggccatttatgcagtccagagcagcgattcctgcaccgtcacaccaaagaggtgggctgacctgaatgtggtgggcatcatccaattcattgagggcctgactagaacaaaaaggcagaaagaggaatttgtcccttttgcttcccgcctgcctgttgagcccttgtactgggatttacaccatcagctcccctggttctcaggccttcaaactcgaactggaattacaccactggctttcctggatctccagcttgcagacagcaggagatttcttgccactggcccaggtcaacaaacagactcatcaggggcctgccgtaagcatgattctgctcttcttatcctgagttatacactgaggctccacaggccctgatatttctgacgcaagacaggttcatttatttttgctctgattttagttatttcttttcttctgctagcttcatcaaaaaaggttatcattgcatggttatatgtagctaaaggaacatgaagacaaatatgaattagaaccacaaggatttcactcattacttgtacgaccttggataagtcatggtgttggc

SEQ ID NO: 471904 - DNA, 495 bp, Homo sapiens
ctccagcaggcctgcagcagaggggcctgactggagataaatccatgaaggtggggaaaaaacagtgcaaaaaggctaaaaattccaaaaaccagaatgcctcttcacctccaaaggaacacagctcctcatcagcaagggcacaaaactggaaggagaatgagtgtgatgaattgacagaaataggcttcagcaggtgggtaataacaaactcctccaagctaaaggagtatattctaacccaatgcaaggaagctaagaagcttgaaaaaagattaaaggaattgctaactagaataaccagtttagagaagagcaaaaatgacctaatggagctgaaaaacacagcacaagaacttcgaaccactaaacatggaaaagaacaaccggtaccacccactgcaaaaacataccaaattgtaaagaccatcgacactatgaagaaactgcatcaactaacgggcaaaataaccagctagcatcataatgacagga

SEQ ID NO: 471905 - DNA, 796 bp, Homo sapiens
ggtgtttggctttctgttcctgcattagtttgctgagaataatggcttctggcttcatccatcagacaggaccctcttttgcaagactgctgcagtttgctgggggcccactccagatcctattcacctgggtccctccccaccctggtggtgtcaccagtggaggctgcagaaccgcaaagatggctgcctgcttcttcctctgggagctccagtccgcagccccagtacccacagggactcaatcccagggagatcagggttctgtccataaacccttggctggagttgctgaaattcccacagggaggtcccattcagtgaggagggatgagtctgggtccagcctaaagatgcagtctggccacagtctgccacagctgctgtgctgcaccatggggaattcctcctggttccaaaccaccagtccctctggcactggcaggggaaagcagcagacagaagctgcagtgatggctgctgccccttcccccaagaactcagtagtcttagacggtctccagccaagtggcagctgagaatctgcacagctctgtgcttgggatccaaggcccttgtggtgttggctcacgaggggatctcctggtccatgggttgcacagatccatggaaaaagcatggtttcctgggtggggtagcacaatcactcaccacttcccttggctggggaatctgcttagttctacctctctcctctctttcctaagacactgctctctttatactttgccaattttcaaaaatacttcatgttttttaataccttccaaactaa

SEQ ID NO: 471906 - DNA, 1140 bp, Homo sapiens
ggcttcgccctgacctgtttctgacctgtgttccctccgctgtgccagaacaggccccatgctgctctggacggctgtgctgctctttggtaagtcaacgagcatgggcatcccctcttggagcactaaggaccgaaaaccagactctgtccatgggagcagcaacagtgcagagccgtggccagtacagctgctctgggcaggtgatgtatattccacagacattcacacaaacttcagagactgccatggttcaagtccaagaggacttcgaaggccccctctgcctctgacttccaagattccagaagggcctggctatgtgggagtcatttcagagtttgtgggtgaggagctgtttccacctcctgtgctgagtgccatcccctctcctgagccccgagagggtagcctggtgaccctgagatgtcagacaaagctgcaccccctgaggtcagccttgaggctccttttctccttccacaaggacggccacaccttgcaggacaggggccctcacccagaactctgcatcccgggagccaaggagggagactctgggctttactggtgtgaggtggcccctgagggtggccaggtccagaagcagagcccccagctggaggtcagagtgcaggctcctgtatcccgtcctgtgctcactctgcaccacgggcctgctgaccctgctgtgggggacatggtgcagctcctctgtgaggcacagaggggctcccctccgatcctgtattccttctaccttgatgagaagattgtggggaaccactcagctccctgtggtggaaccacctccctcctcttcccagtgaagtcagaacaggatgctgggaactactcctgcgaggctgagaacagtgtctccagagagaggagtgagcccaagaagctgtctctgaaggtccatctgtccactgagcctggcagagaaatattgaagtccatggagagtggggagcctcacggggggagcagtcacgtggtcactcgtggtgtcaccatcatccttgctgccatcccctgagccatccttcatgcccatctatgaggctcccccaggccagacggttcccctaatatcagtcattctgcctgttctgtgccaggctagaatgcatttcc

SEQ ID NO: 471907 - DNA, 1942 bp, Homo sapiens
atcaagatttactacaagtgaatatgactcgagtggaagaaattttccatcaaaattcaggaccctcagctgcacgtctgttggagtttgatggaggtccactccagaccctgtttgcctgggtatcaccagcggaggctgcagaacagcaaatattgcagaacggcaaatgttgctgcctgatccttcctctggaagcttcatatcagaggggcacccagctgtatgaggtgtcagtcagcccctactgggaggtctatgccctgccccccagaaatgaagtctacagaggcaggcaggcctccttgagcggcagtgggctccaacgatttcgagctttccagctgctttgtttacctactcaagcctcagcaatggtggatgcccctcccccagccttgctgccaccttgcagttcaatctcagactgctgtgctagcagtaagcgaggctccatgggcatgggaccctctgagccaggatataatctcctgaaatccccacatataagaagattaaatcatcatcatgcagcaaactacaacaatgttagttggggacatctggacaattattctgctcctccagaaaaggacgtgccttgtcattgctgaatttaagtcagaaccagaaaaaatcattattaaagaaaaaaaaaaagaaagaaacagggaaagaaagaaggaaaggagggagggagggagggaggaaggaaggaaggaaggaaggaaggaaggaaggaaggaaggaaggaaggggggaaggaaggaaggaaaagaaagcaaaagaaaaagaaagaaaacagaagaaagaaggaaagaaggaaggaaggagagaagaaagaaagaatagaaggaaggaaagaaagaaagaaagagagaaagaaagaaagaaagaaagagaaagaaagcttaaatgagagctgacagtttatttatataaaatgtttagaatttttatgaagtaccctcataaactggaactccagacctgctaagataatcatgtgaatggacagtgttgccagcatctgcctaccccttttcaaggtttctgtggtgctgagatagatgcaactgctcctgcttattgtagccagtttatcattgctaaaattacatacccttggttaattaaattgggaacatactataaccgttctgtgtatgtgtgtatgtgcatgtgaatgtagtctttttctgtaaataccaaacagagatgttcctgactcagggatatatttttcaaccacagtaaaattcattttggatccaatatttcaaaggttttgattattaaatatgaaaataatggttttttaccatatccctcatacctaataatgaaaaatagcaagtgctttataaacatttgttattgcttctctacacttaaactgaagaaagataaatatatgaaaataatacatgaatattcttctctagattttactagaaaatttagagcatttcatttttaatattacatggaacagataatctataaatatggcatatggtgtattgctagacaagtatatttaccttcctttaaaaaatatttttacttctcaaactacccccacgaatgctctctaaggtataatgcttcatatacttcactttacaacctcacactatacttacaaacattaaaacatatgtaactcttttaataggctatgcatatttttttcatttcagagctactgacatgtttctgcaaatttataggaaaaaatgataaagataaattaatatgtctaatcaagttatggatcagtgatgcctccagtgtgtactctaaaaaatatttttaattagtattctaatatctaatactcctacaatatatttttctgttctttagtcaatccttctgtatactttagaaactacagaaagggcttattgttattaatgaaaatgattaaatgcatact

SEQ ID NO: 471908 - DNA, 720 bp, Homo sapiens
aagttgagaaactttcctgtgtgtctgaagacagcacatatgaatatgcccgacaccagaagtctatgtgtagtgaaggagaaacaagattaaaaagtataaagactatgatcagctgttatagcaaggatctggcccagcttgagccaatctggggagaaacaaggtctttggctgacatcagcattcttgtcattcaaagtctttccaagtgcacttactttgcagaccttggcttgacagtcactttaactgctccaacttctttctatcccaacaataatgcaatgcatccctttgtacatgtgtctttatgggtgattgtgaagacatctcggggtatagcttttgagctgtattccttttccaaaaagtttatgtatcctaaatacgattttataccaactaattgctctctggaatgtctacatcagtctatattacaatacagtatacaaaggctcttatatccttatatctcactattgttttaaaatttgtatatctctagttactaatctagtgttgctgaaataaaatgattctgctcatgtagctggacatgcttagaatataggacacgttttgttacatttttatttctgtagatagaatctattttagcttgaatcaagggtcacagaataaaactaatcaagaaaatagaggaacacgtgtctctctgctctggtgggagaagttgaattcccgtcggttttg

SEQ ID NO: 471909 - DNA, 646 bp, Homo sapiens
cagccaaaatcttggtaccagcatgaacaacttttgttcatccaccctcaaaagaactaatggggatccctgctactcagacgcacctgagggagaggagggctccagatcagccctgtgggagttggctccagatcagccctgtgggagttggccccaaatcagccctgcaggggttggccccagatcagccctgcaggagttgactccagatcagccctgcaggagttgggacacagacaaaaagttaagaggtcttggagaaggcagctcagacattgacaaggtcagcagtcctcgagcagcagtggcagtgggagttttaatgatttctgagaatcaaggaggggacttgaacaatgggaaagaaatgaaaagaatgctgtggtgtggagactactggcatctagcaagggaaagcttcctggaggattgatgaggctgccttatctcttttatgagtattccaagataaaaatacaagagctaattagtaaaccaaatgctctagttgtatactaaactgtgttgtctacaactctgattgttgtttggaggggagcaaaaacagtttgagcaggccaggggtggggaaaagttattgcacagaaagtgggactgtcgaggtatgaggccctgtggttgc

SEQ ID NO: 471910 - DNA, 914 bp, Homo sapiens
gttggtgaggactgtgcttctggtcatcccatcagctcctcgacttccttggtctcctttgaggcagacatgtgagagagctcactgaggcagtggcttgagaagcatgcagcctggggcacttggtccttctgttcccggcagtatggctgtttccatcgcgatggaatgggatcctctcaagacatctcagaggacaggcggaaggcagcgaacatggcagtgccgaaggacacagctgtgtttagcaggggcgacaggaaagcacgcaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagagtgagtcacggcatcggaacaaggggactctggggaccatggcctcgtgtgtgctcaggagaccctgatgggggtggctggggctgcagtgtaacaggaggccccttcggttggtgcctcactggtcttctgcactggagcgtggcgggtcaacatc

SEQ ID NO: 471911 - DNA, 529 bp, Homo sapiens
agaagctgagtgccagctggtaggtcatgccttcctgcaggtacctgtgggcctgcagcaggtagaacaggatacccagatgctggtgatgaaggtgaagaaatccagcatggacgggttggagccggtaaagaggatggtgcttattagggctatgcaaaggcagaagctggtgatgctggagaagaggaggaaggcccaggaaaggtccagcaaggtcttggatactgacctggtgattgtgaataattggcaaggggtcttggatactgaccaggcgattgctgctggctggtggaggctgttggatactgaccccgtgactgttcctggctggtggagggtcttggatactgacccgggaattgtaggttttgattgtgattttggagttggtatgcagggaacattgaattctgtgctccctgctgtcctaaggaagggacttgaattagtcaggagtttttgggtcacaagtgacacaaactctttttttttaaattttttttattttttacttttttaaatt

SEQ ID NO: 471912 - DNA, 2023 bp, Homo sapiens
ccgcggagccggcgcgggtgagggatagtgcccgcagtatggacgataggatattcagtaggaagaaaactcaaaagtcctggtctgaggatagcgacatcgcatgggtttatgtgaagtttcaatggggacgtccacacaacacgttggacacacaagagcccggcaaatgggatctcattgctcattctgcaatgattagagctggccagaaaatagacactggcaatacagcaaataaagtcgaagggaaaatgcaatcagagagatctaggaggacgacaatattttttactgagcacttccgatatgccagacacatttttattatgacattttattttgaaacagttcaaaactcacaaaaattgcaaactagtgcaataatgcccatgtacccttcatccagattctcccaatggtaacattttttataaggatagtacactgtcaaaactaggaaaacatcgttgataccatgctgttaactcacatagagaccttatttggatttcatcattttttacatctctctctctgtctctctctccaccccatccccaccatctgtttgtctctgtttctctctgtctctcttttcatgtatctagttcttatagctctatagataaagtcaactctgcttcatcgaacaactcatactcaatacatacatgaataagcatggctgtgttccaataaaactttatctacaaaagcaaaacaaaacaaaacaaaagaccacctttgagttggtcacaaactttgtgaaacatcattgagtcagttgctgctcagagcatgaaccttttctgctgactttggaaacttatctgcaaacagctcgaaggacacgtggcctaagggctctccatcaacggcgatgtcaaagaacacggtggggttgaccgtggctgatagtacaggactcgcagcggcagtgtctgcaaagcctattttaattttttaaaaccgatctgatgggtgggtggtagcgtctaattgtggcttgaattggatttcctctcatgacgaaagaagttgagcattgtttcgtgtgctttatggccctttgtatgtctgctgttgtcaagtggacctgtgtacaccgagagctgacccactcgtgtatcagttctgtggggctgctgtaacgaactagcacaaactgggtggctttaaacaaaagaaatgtattctctcagagctctggagactgtaagtctgaaatcaaggtccccatggtgtcggcaaggccacacgccctcaggctctgcgtagagtctttcctggcttctgttgacggctgctgaccactggccttccctggctggcagctgcaatactccaatctctgcctctctcttcacatggccctctccctttgtgtctgtcttcatattttcttccctgtttttataaggacaccagtcatactggattaagagtccaccatactctaatctctctctgggtctctttctcttcatctctcctcctccctccctcctttccttcctcaatcctcttgctctccctatgtccttcttccatcactttctctatgatcagtgtttcagtctcttctctctctctgtttctctctctctctttgaatgtcaccaaagctagctcttcccctctttctgaatctttctctaccctccccacccccagtctctttaaacttgagtctttctgttgaggtgtcctacaaaatgtgcagtgtggttcttatgtatgagtgaatgtgtgactttaatttacttaactggcattaggtgatattcttactctatcctaagccactttgcaaatagcactatgtttttaaggcccacccgtgttgttacgtgttcatacatataatccaggatcatctccccatctcaagacccttaatcacatcagcaaagcccccttgctatagaaggtaacatattcacaggctccagaaattaagatggcgtttcgaggtgggagggaggcattatgctgcctcccatgccctccttgatcatcc

SEQ ID NO: 471913 - DNA, 598 bp, Homo sapiens
tttcattagctagtttattcaagggatgtctaggcccaggcgtctgagctggaagctctccctgacccccaagcctggtcaagcatcccttctgggctcccccatcccagccctgcccactctgtatcatcactatctgtgtccccccctgaactttgagtcccagcagaacggggccagaactgtcttgttcgccactgggtccctggtatcacccatcgcaggacccaacactgggctcagaatacatgactgtcccttgaaggaaatgtctagttggagacagccgagtgcaggggtagccagggtgtctgataggagatgcagacaaggatcagaaacatctgagttcagatttcttgcttatgcctggggtttgggccacagcaagcctcattacccttatctgcttccaaatcaggaaaatgggaatctcagtgcagatgtcacttccttccagtggctgaactgttcactctgtcactcataggatgcttttgctttctcccaacgcttagttccagctgacagcccaagtttattgtcttaaacaaaagaagagagaaagaacaaaaaattttaaagcacaaataaataa

SEQ ID NO: 471914 - DNA, 521 bp, Homo sapiens
tgaactcagtaagtccagtcagaatgaaggtaaggatttctgcaactgcgtcggtgaacttggggccagcaccggagcagctctgtgggggcaaaaggcaccagcttcccctgcaggtcaagcgtggaattgaggttgaagccatcctgggccgcatgcagcccacgggccgcaagttggagaagcttgatctagggaaagggtgtggggaaagacgaagagatggcccaagcccatgcctctggcagtcccagcgtgtcagtgtcagacagcagacaaagaatccaggagacagcagaagagggctggggggaagcccaagagaactggagcccagaggcaggggtgaggagctggggagctgggggcctggagggaaagcagtgcccagaacttgcagggcctctgaagctgggctggagtttggctctgggcacgagagccaacagggcctgtcatgggcacagtctccaccccatgatttgagggctgaataatggtcctcaaatacaaccacctcc

SEQ ID NO: 471915 - DNA, 554 bp, Homo sapiens
aagtacagagaggttaagttacatgctcagagtcacacagccagcaaatggcagaacgggacttgagcaccagctgactggctgcagagtctgtgccctgagccagtttgcagtagcattgagcactttatgtgtcaggcagtttacaggcactttgggtcctcgcaacagccccattttacagatgaggaaactgaggcacagaagcagcaatatacctgaggacacacaactaggaaggaggatagagcatattcggtgggagataataaaacctttgatgccaaatgctaaaataatatttggggaaaagcttttgaccccttttagcaaacaaaaattttatgatggcaagaatttatcctgctgctctccgtttgtcacacaaaaggggccgattctgtttgtttctatttgtctgtctgagtttgagctcgggtaagtcattctttcctgttcaataatggaggaggatctgtgtttccctgcatcctagaatggtaaccccctggctagacaccccatagcttatttggcagagtctcagaggaaac

SEQ ID NO: 471916 - DNA, 931 bp, Homo sapiens
gatgtaggttagcgttaaacttcgctcagaggttcccagcagctaaggcaataagggaaatgattggccgctttgaatgatgtcagagactcaagaatgcgcggctggtcttcagtggtccagtacctggccctgagtgattcaggcagattgatgtgtgagggtcagatagaggaggtggctgggaaagatccacctatgacctcaggtcctcagactgaccagcccaaggaacatctcatcaattttaaatcagcctgtgttctcaaaaacttaaaacctcttcaactcacacctgacctaaaacctaaaccccttgttttcttctgcaacaccacttggccccaataccaacttgacaatggctctaaatggccagaaaacagcactttcgatttttccatcctacaagatctaaataattcttgccgtaaaatgggcaaacggtctgaggtgcctgatgtccaggcattcttttacacatcggtccctccctagtctctgttcccaatgcaactcgtcctaaatcttccttctttccctgctgcctgtccctcagtcccaaccccaagcattgctgagtctttcctctttccaatcttccttttctacagacccatctgacctctccccttctccccaaggctgctcctcaccaggctgagctaggtcccaattcttcctcagcctctgctcccctaccctacaatccttttatcacctcccctcctcacacctggtccggcttacagttttgttctgtgactagccctcccccacctgcccagcaatttcctcttaaaaaggtggctggagctaaaggcatagtccaggttaatgttcctttttctttatcccaaattggatagcgtttaggctctttttcatgaaatataaaaacccagcccagttcatggctcgtttgacagca

SEQ ID NO: 471917 - DNA, 1066 bp, Homo sapiens
tttcctttcacatggcccatcagctgattgtcccctggctccctctgccatggcccagggtggctacctctgctgcaggcagccatggaagcttctcagaggctgcctgctgggtgctggcctggaccccttccattgaggctcctcagctggctggaaccctggcctcctgcaggctggaccctgttgggaagagagatggccagagtgtccctggccactgggcaccagcaggggcaaaggatcccagtttgagccaggcaggacaaacgtttgtgtgtggttggctcaggcgggctccacccccaaaccctgctgcatggcagggcatgcatcttctcggtgaccttggtgacctcaggatggggacagtgcctggaggtctctcacccaaaccaggctgcaggcactatggcttctccaccctgtctagcctggaggtgtttgcacgggcagagccttgagcttcccaggctcatccttcagaaacctccccagacctggtcccgatctgcccacaccttcctagctcacagtacagcccagcatggagcatcccgcttgacaataatgtgtttattgggtgattacttgacaagactgtgggcttttcaagaacagtcttctctgatttggtcagcttagcacccagcttggcttgccacatgtgctcattaaaaaccactgattccattaatgattatgagaagaatgtgcacacgtgcttaagtgtagtgtgtgcatgactgtgagagcgtgtgatcgagtgcacacatacatgaatgtgtgagcacgtgtgcacatttgtgtgcagttgtgcatatgggtatatgtgtgtgcacatggtggtctggggcactctgtaggggcaagcgggatcctggtcgtttattgctttggctgttacaaggctctttctggaaggccacatctgttctcggatgttcacccagcagcccaaacagacaggtcagatcccagccctgcaatgtgacttattcaggaacctttaaagtggctttgaaagtcatttggtgccagatgtaccaaatgtcttggatgggct

SEQ ID NO: 471918 - DNA, 997 bp, Homo sapiens
tggtgactccaagctgtggatttggtctgcgcccctccgagtgggtttccagcatgcgtctgattctctccttcatgtcaccaatcaagggcaggagagaacgtcagcgccgcctgaatacctactacgcgccgggccctgtgccaagcgaggactcggccctcctctcaatgtttccccaagtgggctcccagcaccccagcagcctcaacttgctggaggatggccgcagtgctctagacctggacttggcctggcccggaggacacctgcagcctgggcaggaacacctacccatccaggtgccctgggatgcttgttctgcagaaccacagggaccagggaggcagccgtcccccgggaccactagctgcaggcctggaggcatcctgctcatgcccctgcagggcgagccccatcagctgtcttcctgcttctccttctggttcatcattcttactactcatgagcaccgactctgagcctggcactggactggtgctttccagaccgtgctgccctgagaattgagtgtgacatcatgaacgcctgttcacaggttaggaagctgaaactccaagattctacagcatttgtccaagcttccccagggagtcaatggccctggtcgcctggctccctggctcttgcccttaagttctgtgccttgctaggcaagaacatccaccttttatagaccaggactccggccttccagtgctatcagcacacccaggacaaacatggggctccttccctctttcccttgcgtgtcttgttggattaagatttatttttaacccagagcaaatctggggagctggccaccctgtcagatgccattggctggatgcttctctttttgcaagagaaatggctgactgaggacctgcagccagacctgggacatgttgtccaggacctggacttcatgttaatggcatcttctgaaatgacagagcagcatcattactcccagtcctattctaaaaatgga

SEQ ID NO: 471919 - DNA, 2160 bp, Homo sapiens
gactgtgggctctctggcatacctctctgcaccctggacgctaccatacactccagcggaacgatgatcttgtcaggcttggttcgctgtgcacaccgagcccctcactcagtgcctggcatacagtaggagcttactaaacagctgtcaggaccttgagcccagtccagagcctggtccagagaaggtgctcagtaaacatctggagactgaaagccaagtcaccctgtggagagcagcggttttttctgagtggacttcagtggccttggctgactcccttgtgggtgtctgcagacccggccctcagagcctctgcgtgttgaaggcacacagcacctgcagggaaacaggcccttgcctctgtcggctcctcctgctactgagagaccagctcagaggccaggacagcagctcagaaggggaggaaaggaacggagacctgtgggctggtcctcagtgaggcctggcccaggagggagaccctccccagcagatcatgagagctgtgcaccttgccaggatggtggcgctcagcaaacgcctacctgaggtcatctgcagagccccctctcagggcagcgaggcagcctgccaggattcccctgcatcaggagctctgttttaaaacatctgttgatccacgtaagaatgatacagggaagaggctctccgagcgcaccgatgcttcaaaaggcctcaaaaattagaattgctgtcacggcctctgcacttcccagtccaggccttttgtttgggtctccctatgtggccaccaggggggctaatgccctccagccacatgctcagctttgctggccagacaatggcctctgaataggcccatccagagtgcccttttgagtgatagaacccagtgcaacagcggagactctaggaaactaagcctgcgggctccagggcctggggcaggcgttgctcattgaccaggtttgggtggtgtggggcacacaaagacacaggctctacagtgctcctaccgccagcccgcactggggatggtggcctctcccccttgggaaaatctcagtgtctgtcctgtcgacacagcttggtacagaaggtcagctctcggcaggtcctgggaagcgcatggccttatggccacaaagtgcaaacacagctgaggagcactacagccaggccaaccgaagatggctgttctcccattgagtggaaaaacaccttgccacttggggattcgggctctgcgcagtgatagctcatcaaaagcgaggaagatgcatatttatatttctgcaatttagttggaatacccttctgagaacctgcagcaggggcgccttcagtgcacagcttctgagttgttaaaattttcattctaggtccccaggaaacagtgcattaaaacacatcactgcttcctcgcctcatcaaaactcccccgcttgctactctcctgccccaataacgggctgggaaatgaaagcaagggagcctggggccatggtctgtgaaggagaagggccagtcatgcaggcaccagggcagatggactcaggtccagccacgatgcgcctcagccacccgctctgcaaaagatgccctcagctgtgcccctcttctttaaaagttttccccagcaactcaagccaggaggacttgcccctgactttcctcgcctggttgggctcaggtttctccagggtcaagctcctctttctcaaccctgtttccatagcgtaccactgggaaggtggtcactgggtgcagcccacacttaagagctgggatgatcatccgcctcctcgagggaggggcatctacgtcaattacgtggaattcttctgcacgggatacctcagcagctggcatgtacctgcactttcccaaggccagaggcagaggttctatgcctctgtccctgagaacttctccaggatcttggaaattcctggccttcaaagccagaagggccaggtggatgaaccgatgagaggtgccaggggattctggcatctgagcttgcacctgcccagagtctccgtgagcccccagaaaggctccatcagtcagagggacgcgcccgtgtcccatgaagggcggcagtcgacagtcgactgatagatctaggtgcgcccatatggagctccgtgctggaggtgcccctgccctgcc

SEQ ID NO: 471920 - DNA, 2548 bp, Homo sapiens
atcactgggcaagcccagcaagggctgtggccacaggcagggtggaaactaagctatgaggatgcaaaggcataagaatgacacaatggacttcagggactcaggggaaaaggatgggaagggggaaggcctaaggctggcagggcagacctggccgctgcagctctccaccccgcagcggacccaggagacgcactcccagcagcaccctggacacctccgcctgagtccccaatcacacagggccacacagcacaggagggtacagtgtgtacaagatccagcgggaccaaggctgggatctgctgtggcccagggccctcagcctcagtgcaaaagaggaaggggacccaaggtgcaggggttggagctgtcagggctgaaccctggctgtggtgagtcttgccgcaggccaggctggcctcgacactgtgcacccgcggggacggtgagcagcaggggaccgtcctgggcatgaggactctcacgctcagggtcagatgcgcggtgataaagggaagctccactccacctcatttcggcgtggttctgggtagaccccgctgaacaagagctctccctcccccgagccagccgcctaacccatgaagtttctgtgttttgtgtgcctctgttcaaaccggaaatattaccttggcttttatttacattttctgatgatgaaaccggctttaaaatgccccacgccctagtggagggggctctggtacaactcgcgcgcagttggggtggatgaagggccccacttcacctcatctctcctttctgcttaaatattatgccatatcctgattaataccagaccaataaaatcatctccgcaatctggttagaggcttttgtcttcccagatggcctgcaatgttaatgtgtgacaatttcaacaatgaactaggactgttttatggaaccaacatttgttccactgctttttttttagactcagaattttgacacagatggtacaaattactcaaaaaacagaaatgttcatttagaaggcttaaatatgtggttttactcaggccatcagaatattttacatttgcaattcagtaaatttactaacaaccctgctataattaaggcacacagtgggcaccaagcgctaatgagaactattgcaaaatggaagacacaagtcatggcttcctccaagcgcttagagccccagtgcaggtccaaataagtgccctctgaacctgcaggttgcttttcaggggtcaaggtcagggatgcctgaggagaggcatgaaatctcttacgtggggtttggaacatgagatgcttagtaaatgtctgctgtttattttactttcatgattatgattcttttgaaaaatctaattaaatctgtaactttcctgttctggggttggggggcagtttccaagccttgttttgggggcttctgagtgtgctccaggcaatccctcaggaccctccagttgagctcacccctcctggctgcatttgtcattgtactgatgtcaacccaaggaaaaatgcgcccaccacacagaacctcaacaggacagggagtcctcgccatttccctctgcccaacaacctgaaggaggatctgtttaaatattgtttctgatattatttttccgataataatggcaaggacagaaaacaacaccagggtcctgctcgtggcttcacttgaccacagttttgttggtgtgtgctttgtgtatcaggtgatagccagttctgcttctgccttggttcccgtggtcccattatgtaaacaaataatttatttcaacttttgagttaaaaaaatttaatgcatcaaccattgttgtcctttgctaattgttgcagtaagtaccatgcatttatgtgtgaagcttcaattcattagaggattctattagcactgccaacagaaagtgcattctgagtttttaaatgttgtttccattaaaatcaatcactcctcacaattaagccaatagtctcaccatttttgctgctatgagctaaagcatcctaaatatattgacagctgtcttcaataggatgacacaaacgggggaaggggggcaggcctaagactaaatgtcaccaaagggagcaagtgagctcctcttgctgaaatgcacctcattttcataccccagaaggcatttagtacacttttttttttgcagtggcaacatacagtaatcaatgttttgcatattacaatcaataacacacttaaatgtttaagttttgcattcttttgcaataaatattgatatattacaaactctggaaaaactgttcattggactttttgtttgcactgtgtactgtatcattcagcaaataagtgagctaaatattgtttgttacaaaacagatgtcaaataaaattatgccatatgtgctattaaacacttttcttattttttttttcagcaaaacccaagacttagtttcagaagtgaatgtatttggcttttcaaggatttgaagcataaaagcaacatctttgaaatatttttaaacctgctggctttgtgtaatccag

SEQ ID NO: 471921 - DNA, 829 bp, Homo sapiens
ttctcatcatcaaatttctccccatagatgtacttgccaccactgccattatggtgtgtgaagtcaccaccgtgacacataaaccccggaataattctgtgaaagcaggaacccttataaccaaatcctttctctccaatgctcagagcacaaacattttctgctgtctttggaaacttgtctgcaaacagctggatggagatgcggccccagggctcattgaagaacttggttcttggtgccttgaacaaggaattggacaaaacacacaaagcaaggaaggaatgaagggatttattgaaaatgaaagtacactccacagtgcaggagcgggctcgagcataggggctcaagggcccggatacagaatcttcttgggtccaaatactccctacaggtttcccattggccacttggtggtcaactcgtgtaaaccaagtggtggcccgaaatctgtctgattggttgtggaaagcaaccaatgggaagttgaggcaatccagtcaggagtcaatctgggtttggcttttgttattgccatggtttccgtcagtgtaacactaggttcaaattcctctagaattaccttgtgcttcagatgggggttgagttgcttcagtgtctttctttctccctccctccctccatcccttctttccttcctcctgttatatgtaaagtttcagtgccgcaaaaccaattgcactcaaatataaaattttcttttaattctcagcaaggcaaggtacttccatagaagggtgcgcccttacagatagagcaatggtgagcgcacacttggacaagggaggggaaggggttcttatcc

SEQ ID NO: 471922 - DNA, 779 bp, Homo sapiens
ttgcctatttttatgttatttcttgattatatgctaaacaagggcctgcaaattaaagtttctgcatctttttacctgagggcattctgcaaagctccagtgtgcaactgtgcctacctcatggtcatcaggaaatgccaggggattaacaccttctgggatggcccctaccaagtggcactggtggatcaataccccaactccttcacctcagatgggatcatggaatgggtgttttatgcagtctcccagagtaccagggaggccttggacctccagaatgctgagaagatggctgctgcgtcacttccgcctcccaaatctcagggaatgtctcttgtggcccaacccatgcgaactgggaactgcatagggaaggacatgctgggaaatgcagctgcagctcatctgcgggcacattcactgattcacttactcattctccgagcccctgcatcgagctggcctttgcgctgagcctgggactcaggggcgaattcatcagagcttatagtcaaggaggcagacacatgtttgtgtttataacacagcatagaaagtggtggcaaatccaggctcctggtgtctgggtccttggtggaggggcacctggcctagcctgcagccctgcttcccctgccttcctgggtcctccacaatgcttctgcgggctcctgccctgagccttggtgtgaatacactcttcacacccacagctgcctagagccggagcccctgctccagggagacttctctgcccatcctgcccacctgcacac

SEQ ID NO: 471923 - DNA, 1197 bp, Homo sapiens
gggaacggagcccaatttcctgtccccgggcctgatagccagggagccaaaaccacagagagaaattgtatcgtgccaagagatagagcaggaacacgaaagagcatgggcacttcggaagagcgaggccctccaccctccacccagctgtccccacgcacagccagccccgctgggaagtggatggacagctgggagaccagtgcgtgctgcctccagggcgtttcttggagcgccattcagatccatagttggaaggaaggacagaagaggagactgaggtccaagtgggccctggaccaccagcaggacaaggctaggaggaacatcctccctctaggaggtggcggagctggcactgagcagtcatggatcgcagccttgaaggctcagcttgaagtccccctccacccgctggtgacaagcagtgtgtacacaggagatggtgtttcccagcatcccaatggccccactgaccctcctggttattactctgcctgtgggatctcagaccttgtgttttctgctctctgtggtatagaggcctggctgccccttcaggacttgtaaacccaaacgtatattcatctggaggtgcaaaagggggtaaagtgccccaagggggaaaccagagggagtgtggggaccatagtggaggggagaacacaaggcccctctaaagaggacccgcattctcaaatcttctgatttaagagaagctgaagatcctgatttttatgtgaactctccccatatgaaatgttcacagcaatgcattttaaaaatgtttaaacactttgaaagcaaacagacattattcgggtcttgtggggttcagggttacttaccaggcggtgacttctgttgaatgctcataaaagctgtccttgctgatgagggcaacggtagtgggtgggcgccatgaagtggtagtggggagggggctccccaaggccacagctggtggccctctcacttgcctgtcccctctccctccccctccgtcaccccctttcccttcccttctcagctgggagaggaccgtctccagcactgggcccacctcacagcctcgcccatagccccctgccaagagagcaggcacctcttctagctccagccccacagccctacagcccatcagccctccccccgctgctcccctctcacctggtcctggcccagcaggcctgcccc

SEQ ID NO: 471924 - DNA, 639 bp, Homo sapiens
cagagacaacatgttgagcccaagaagccagacacacttatttgaaggacgacacggtctcctggttcccttccctctttcctggctgctccccttcatgccttggctcctcctcctctgtgtaaatgatgggattcttcagaacgtccctgggagcttgggagcagtgagctccataggctccctccccaggaggccctgctgtctcccacccacgcctctgccctgcccacttggcagctctgctcacttgcctgtttcccaagcgttgctaattgatgtaggctatccaaagtcacagcgtggggccaccttgcaggatgtgactgtggcgaggcagctgtctgcagtggaggcaggcccagaagggctacagctggaggctatggcagtgggcttcctgcaggtgggccctgggggtcatatctgtgtctaccacccttcattaactcagacatgaccaacgtgtaaacctgcagtttgggtcatgctaaagtcacatcttcctgttccttaagcaagaacagccaaaggttgcagaccatagccagctcaaatgccacctcctccagggagctgtcctccctcctctcttctggatgccatggcgtatatccaccctccctcagacactgactt

SEQ ID NO: 471925 - DNA, 755 bp, Homo sapiens
ggaagcaaaatgaaagcactgttattgtcaagtgatgatcatcgacatagaaaacaagaatcaacagaaaaattaacctaatgagagagttgcacaaagctccggaagggttgatcagatattaggtagttgaccatgacaagagcaggacctctgagcaacgacgctgtcaacaagttggcctccggaaggatcgccatggctgcaaactgcctagcctctcatcgcccctcacccgctgtcactcacacacctgggcctcctaccgtgctggccaggaaagagctgcaagtcctcgggcccgaggctcggcaggcagccgacctaccttgcagtcctcaggagaagctgtccaggaaccccaccctcctgagctcccggggctttggtggggaagggagcctcccagggtcccggagcactaaacaaaaaggagctgaaggtcaccacactttggccatttgcagggagcccttccccacacaggggcggcatgttcccttgtggctgccagggagcccccaacacccctgggaagatggcaggtcgaggggaggggacatggcctgaaaacaaggaagcagtctgcaatggggagatgtggggcatggggctgttttagacagaggaggcggcagtagacacaattgagactggctgctgggttcccctggaggcagtgtggtaccagtcttcctgcctctgatgacagattcaggccttgacaacaggggtgaacatgtgacccagtctgg

SEQ ID NO: 471926 - DNA, 562 bp, Homo sapiens
gaaggcacccgcgggcggggagcaggggctgcactgcccccgcttgggcgcctactgtatgcacattgcaccatgtaaattaggctgctggcatctcctggcagtggcaaaccagcaccgcagtttcaggcagcttcgacttcaggggctggcagggagtgagctggccaacgtgacccttctgctgagtgctggcagtgtcctctcaggccatgcgggcatgcagcccaccaggtttcctgaggccagcagtgctacacagaatgccaagttcccttttccagggggaggacagagaggggctcctgcatgggcggttgtgaggcaagaaaatggattcacgaagtcttggatggtaatggccaaaatgcagggaattccctgggcagctcaggatttctcgcaaggacagtgtaagcctggagctgctggggctacaactggaagaacacttgcaggataacgaagccaatataatgaaaagcaaagcccaggaagaggtggggtgtggctcagatcctcccttcattctgaagagccgaggacatattcaaggaaacct

SEQ ID NO: 471927 - DNA, 1110 bp, Homo sapiens
cacctccgtctctcattgactctcctctctgttttcctcttgatatatcctccccacttctctgctgcagaagaggcgagtcgcctttggcgccactggggagagcctgcctgtgaaagaattccactccgaggacagctgagcctctcatgacaatctgggtcctgatgccgctgtttgagcccctgggtgcagggctgctggaaacttccggaaggagattgctcttctctctgggagacgtccccggggaagcttcagaccctgccatctcgtccatccccaccatgcccaccaccgctctggctgaggcagctccctgcggagtcctgctccgggctcagtctcccagagaggcagagtcgggcaccaaatggcccataaatggcacagcaggcttcagggagctgaacttgtacttcccgctgggactgacttactcctactttttggaatcaggtgcacctgcagccgttcaggagctggctggccgactgtcccagtacctccttggtcaccttcatacggagctttggtccttcaactttggaaagggttttgattaccgaatgccaggctctctttcacatgttccccgctggtggggagaaagggccttgcttggtctcatggaccagccaggcaggcaaggaggccgcaaacacaggactaatagcaccctcgtggcctgcccccagccctcatttcagaacgtggcccttcctgaagccgctttagctggctgggggaggggtggggttggaggggtggagacgccaaggcagaagagccagaggatggctgctgctcctggcctgcgcactgcggctcctggaagccaagacgggcaggcttgtgtggccgcggaccccctcccagctcctgagcctgtcaaccctggctatgcacagccctcgcctgagaagcgtcttcaaaattctagtgccttctcctcccttcaattccaggataatggcacacacagcaccagtcaggccctggcctgtgttgcaggcacacctccgatacattttgacctgcatgccaactgcagaacctaaacccaggcaggggtcactccccagcagggtgctgaggttcaaagagctc

SEQ ID NO: 471928 - DNA, 750 bp, Homo sapiens
cctgcaccggggctgcagcccttgggtggtcggatgggactgggcgccgtggagcagggggtggcgctcgtcgaggaggctcgggcggtacaggagcccacggagggggtgggaggctcaggcatggcgggctgcaggtcccgagccctgccccacggaaaggcagctaaggcccggcgagaaattgagcgcagcgccggtgggctggcgctgctgggggacccagtataccctctgcagctgctggcccgggtgctaagcccctcattgcccggggccggtggggcgggccagccggctgctccaagtgcagggcccgccaagcccacgcccacccggaactccagccggcccgcaagcgccgcacgcagccccggttcccgctcgcgcctctccctgcaagctgagggagtgggctccggccttggccagcctagaaaggggctcccacagtgcagcggtgggctgaagggctccccaagtgccgccaaagtggaagcccaggcagaggaggcgctgagagcgagggagggctaattgtacattttaaacaattttatgctatgtgaatttcacctcccttcctttcctccctctctccctccctcccttcctccttccttccctccctcccttccttgcttacctccctcccttccttccttcctgtctttctttctctctctctctctctctttctctttctttctctctctctctctctctttctctctttcttctttctttctt

SEQ ID NO: 471929 - DNA, 3879 bp, Homo sapiens
ggacccgggttcccctggcgtaggtcggccctcggccgcagggtggggctgggcatgcagccgggaccccgggcgtcctgtcccgttcctgcgcggcgactgcggccccggcgccctctctgggcagctccgcgcccgcagcctcgcgtctcccgagattgtgcggctgtaagcaacacaggttcgcggcccgactcactgcaccgagacgctgagggctgcagcagaaacagtttaatagccagagaggggaggacaccccagatccgcctccctgagggatttggggtctggacgggggcggctgggtgtagggtcgttggttggtggggaagtgaggggtgaatcctgggacaggaggtgaagaaaccgcattctgctgaatgggctccctcgttgggacttcaacctgattggcgccagcctttgctgggattcaggatctgagaactccggcgactcttgagcagttctcagagatcttatccccaggcacaatggggaagccggcggtcagcgtctgctgtgacctgactctcagggaggcggccccttgaggcagcggggctgagggcacctggttaatatctaactgcaatctcgcctccagcctggctcgcagttcctgtgaacccggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctcacatattgcttttgtttaatgtgttaacacttaccaaaaccctgggtcttctctcttgataacccaagtatagtgattataacgatgatgattctgtggtgcccagtgttttgatgtgttgagatgactagatgtatggcattgtgggtaagtagtgagacatcaggttaacttgaatcttgacaggccatcaggactatcatctatgttggaagaaccaacttgtgattatagatgtggactcatttgaggaggctatgtaatactaatgttaggatctgtttggcttgagggctgaagatctgtaaccattgaatgttccatcttctttgcagatgcttagttataggaagctagttcttcttttcctttgcttcattaaaaaaaaaatcttgcagtgtttataggcatgttgttatttctcgggtggagtgaaagctttgttccattgtaggatctttgaggatcgtacctctttttcacctttgcctactgaaaaactgtggcaaacttttcaagtgtccaaatcaatggctctgtgtcctctaagttttctagctcatcatcatctgtagtggatttcagcagactttgaagttcctagctggtaagggtttctctttgcttttcggtgtgttccttaacgtcatcctcagtcgtttcagacagcgttctccatcaacttttttagcaacattttacatattcttaataactgcattaatagtggggaagcccttgaaatcattgactcccttaccccatgatggcttgtaacatgcattggctgtcctgggctttagggcatctgtagccttcccaataagcacaattgtatttgtaattgtgaagctcttcaataaaa

SEQ ID NO: 471930 - DNA, 686 bp, Homo sapiens
gctttcccacactgcttgcattcatagagtttcttctctccagtgtgagttctttcatgactttgcagtgtactggaacaatcaaagcctttcccacatatcttacatttatgaggtccatctctagtgtgccttatcatgtgtctttggaagcttcccagatgatcaaatgctttcccacattgcttacattcatggggtttctctgcactgtttcccaaagaattgaaggacttcctacattccttacaatcatatggtttgtgtcctgtgtgagaaattttgtgggtttgaaacgagtggcaataactgaaggttttccaaaattgtttacgtgtattacgcttctctccatattcctgatactcatgtggtttgtgcccagcatcaactctgatgtggcaatgaagggatgaaagacccgtgacgacttctccactcattgttttcacgtggacctactccaggaggcatgtgcttgttcacaacagtatctccaatctggctagatgtttctccacaatgactactgtctttactttcaccgaagcgctctaccatatcgcatctgtaaaaaatgggaagtatattactaaaggtttgtttataaatgattttatatgtattaatagagacccttgagatgtcatatgtaaaaaaataaaaaatgttaaaaaatggctcct

SEQ ID NO: 471931 - DNA, 1342 bp, Homo sapiens
tgcgctgaacattcggctccttttcccaaatctgcctgttggcttcatgcagttttactatttgcaagtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagttcctcctgagcacctactgtgtgccagatgtctttatttaggggatcaacctagaacaataaccaagatagataagatctctgtcctcatgtggcccacaaaattcatctatttgtagttcttctgtccatgacacactattttaagacttatagctttacagtatgttcttttcaatgattttcaccagcctacatcatgctttgaacagtatgtgttgttaattcatgcacaagtctcccctttcccataatgacatttatcatgtgtctactatgtgcaagaaacaaacagatctggcaccggcgactagtggtgaacaaaactcataaagtcccggcccaaatggagctgacattctcctgggaaagacaggcagttaggaagtaaacactgattacataaaaatgccagagtttcgcacttgttgcccagactggagtacagtggaatcccatgcaagcgatgctctatccccctgggtgcattgtatcaggaggaacatgatgtccactcgtccattactgtgatgcccagtttaattgtttggtaaagatgttgctaaatctttggattaattgtttggcaaagatgatgctacaggatgta

SEQ ID NO: 471932 - DNA, 563 bp, Homo sapiens
atccctggagctggggtaccctcggcggatgcggagagtcgggcgttggggggcgcaggttggggcttctgcctctgcctacagtattcagtacagttgcatgctgcatgtttgtagcctaggaacaataggctacaccatacagcctagctgtgtgctaggctataccatctgggtttgtacagcttacgacgttcacgcaacaaggaaaaaatcacctgaagatacatctctcagacagatctccgttgttaaatattttcataggacccttccttacttccttcagatctctgctcaatgcaatctcaccagagaagcctttactgacctgtataaaacaataccctctgaccccatcctctttcctttgtttttcttcaagaggtatgctgtcagtaccagagccactcgctacaaggttccatggagccctggaaatgtggctggtctgaattgagatgtcccgtgaatgtaaaatactgtatatgtggggttttaaagacagccccaaaagtgtaaattatctcttagtttttatactgataatgtgttgaaatatt

SEQ ID NO: 471933 - DNA, 1191 bp, Homo sapiens
gtccccctcctcacccacctcgcaatccctcttggccccttccctcaccctgtcactggtctgctcccggggcccgtctctgctcgccgtccgtgtcagtctgtccgcttgagccggagttcccccgcccactcctcatcgcccccaccccaggtgttctaccagcgcgcagacatggccatcggctccctcaccatcaacgaggagcgctccgagatcgtggacttctccgtccccttcgtggagaccggcatcagcgtcatggtggcgcgcagcaatggcacggtgtccccctcggccttcctcgagccctacagccccgccgtgtgggtgatgatgttcgtcatgtgcctcactgtggtcgccgtcactgttttcatcttcgagtacctcagtcctgttggttacaaccgcagcctggccacgggcaagcgccctggcggttcaaccttcaccattgggaaatccatctggctgctctgggccctggtgttcaataattcggtgcccgtggagaacccccggggaaccaccagcaaaatcatggtgctggtgtgggccttcttcgccgtcatcttcctcgccagctacacagccaacctggccgccttcatgatccaggaggagtacgtggatactgtgtctgggctcagtgaccgcaagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggtcagcgcagactcgggccgggggtgggggttgggccgctggggacctgaggatgctcaaagatggcaaggggtccaggttcattcattcagtcccagaggtcagccctgggtgggtcagcttggagggcggaggtcactgagggtggaagtggactcctcctcccaggagcaggctccttgggatattttctgggatgcagtatttctggattctggggtgagactgatggggctcaaatctttgctcttccccttcttggctttgtgaccttgggcaagttactcagcctctctgaacctctgtttcctcctctgtaaaatgaggataacaagagtatccccactgtaatgatcataaggttgtt

SEQ ID NO: 471934 - DNA, 631 bp, Homo sapiens
agtgacgcaatttttgtccatctgctccttgtttagggtcaaatcctatacaagggacaggaagaaaaactaaagattcctctacaccctttcctgtctcttcaaacctccaacacctcctccctcctcctctctcttagctaatggccttgcttgctcttgtcacagaaaatagatgcattccaaagctaacttccacacactcatacattctctccaatcccgaccctacatccggtcctgtgtgccctgccttccctcccaacactctagatggtccgtcctgctgccacctgagttggagggctagagggctcttcaaatctcttctcttctgtctcggatggatggatggatggacggatggatggatggatgaatggatggctggatggatagatataagcagcagctttgggtcatccttgacttctctctttttcccatatcctgcatccaatctgttagaaaaccgtacagggtttaccttcaaaacagatccagaatctgaccacttctgttatcattccagtctgaagcatcatcatcttgagcctggtttatccagcagcctcctaactgatcttaggaggtcagttgcctgttgccagccctatccctgacagtctac

SEQ ID NO: 471935 - DNA, 920 bp, Homo sapiens
cctccagcaaactccaacagacctgccgaagaggggcctgactgttagaaggaaaactaacaaacagaaagcaataacatcaacatcaacaaaaaggacgcccatgcaaaaatctcatccaaaggtcatcaacatcaaagatcaaagttaggtaaatccatgaagatgagggaaaaccagtgcaaaaatgctgaaaattccaaaaaccagaacacctcttctcctgcaaaggagcacaactcctcaccagcaaggcaacaaaattagatggagaatgagtttgacaaattgacagaagtaggcttcaggatgtgggtaataataaactcctctgagctaaaggagcatgttctaacccaatgcaaggaagctaagaaccttaataaaaggttataggaactgctaactagaataaccagtttagagaagaacataaatgatgtgatggggctgagaaacacagcacgagaactttgtgaagcatacacaagtatcaatagccgaatcaatcaagtggaagataggatatcagagattgaagatcaacttaatgaaataaagcatgaagacaatattagagaaaaaagaatgaaaaggaatgaacaaatcctccaagaaatatgggactatgtgaaaagatcaaacctacgattgactggtgtacctgaaagtgatggggagaatggaaccaagttggaaaacacacctcaggatattatccaggagaacttccccaacctagcaagacaggtcaacattcaaattcaggaaatacagagaacaccactaagatactccttgagaagagtaacctcaagatacataatcatcagattcaccaaggctgaaatgaaggaaaaaatgttaagggaagccagagagtaaggtcaggtcacccacaaagggaagcccatcagact

SEQ ID NO: 471936 - DNA, 889 bp, Homo sapiens
tgcttccttaggcaacttcatggcatggagggaggtttgcatttgggagggtgtgaaggatttcattccaaagctgttggcaccttttgccacacccctcttctgcattatgaggaaaagaccactggacttgaaatcacaggtctggagatgaattctgactccaccacttaccagctgtgtgaccttgggaggtcacttgacctctctgagcacagggttctcacgattacaattaaagaaacattctcacctccaataactattatgcatattaaatgtgaaagtgctggacacataataggaaggcaaagtgttaaacctgaaatgaatgcaagtgtttaccacatatgtattttgccaaggagtaaaataataaaaatggtgactatttattgagggcctgctatgtgccgcaacttagggaacctggggcctactgctggccccatcaacaacttgctgtgggctttgaccaagtcatgttttcttctttctaggctttgttttccctatctagtaataaaagctgccatttactaaagactttctacttgccaggaactgtgaaaatgacttatgtctctctccctcttttgcttcctacctccctccctctttccttccttcttctttctctcccctcccctcccctcccctctcctccctccttccttccttccttcctccctccctcccttcctcccctacctctctttctttctaacatattgagtaccttctgcttgccaagcactgttctagtcactgggatacagcaatgaacaaaatggacaaaatttgatgcccctgcatttatatctagcaaggggtactggagataaacaaaataaataagtaatttttatagtacattagaagattctcc

SEQ ID NO: 471937 - DNA, 587 bp, Homo sapiens
aactgggccttgccatggcagcctccaacaggactagcttctggcgggcccacgtggacatgggacttccagatcctatcctgggagtcaccaaagcctttaagagagacattgatagcaaaaaggtgaatctggtaattggtgccaaccaggacaacaacagaaagctttatctgctgtctaacatctgcaaggcagaggcccagactgccacaaaaaatttggacaaggaatacctgctcattggggtactggctgaattttgcaagacatctgcaggactagccctgggtaagaacagcgaagtgttgaaaagcgactggtttgtcactgtgcaggctatttctcgaactggggccttaaggatcagaaccagttttctagcagtggaaggaaatagcaatggggtgaagaaaaagaatctctacattatttgacatggcctatcaaggctttgccagaggtgacggtaacaaggatgccggggctgtgtaccacttcatcaaacagggcattaacatttgtctctgccaatcatatgccaaaacatgggcttatggagagcgtgtgggagactttactataat

SEQ ID NO: 471938 - DNA, 1045 bp, Homo sapiens
gcttgccctccactctgttctgcagctactcaactgccctcctcccgtccaccatggccctgccgcactcaggctacatcacctcctggatcaccgctgccttccaactgggccttgccatggcagcctccaacaggactagcttctggcgggcccacgtggacatgggacttccagatcctatcctgggagtcaccaaagcctttaagagagacattgatagcaaaaaggtgaatctggtaattggtgccaaccaggacaacaacagaaagctttatctgctgtctaacatctgcaaggcagaggcccagactgccacaaaaaatttggacaaggaatacctgctcattggggtactggctgaattttgcaagacatctgcaggactagccctgggctttgccagaggtgacggtaacaaggatgccggggctgtgtaccacttcatcaaacagggcattaacatttgtctctgccaatcatatgccaaaacatgggcttatggagagcgtgtgggagactttactataatctgcaaagatgtggctgaaatgacaaaggatggccacatctctgtggcaggggtcacttctggcaacgtgggctaccttgcctatgctatttaccaggcaatggacgagctaagtgtaactgtccttcaattaaagcaagaaaaccctactctggacactgggttaaagtgaatcctctgctgttcaaattacaggaaaagaagagatgatgtggtgtgaaaaggggaaaggctaaaaattcttgcttctttcagttgcttttcctccttgctttttgattctttgctgttaatatatggttgcccccaaagctggtgctatcttaggttgtactaaaagaagtatagtgcctgaattagaggagaggaacattctcctcaggtcagagcacctctgaatcaaggattcagctctgaggccatgaagcatgagggagccagatgaatgagtatgcattagagaagaatcttccatggaactggtcttgttgacaaggaaagtggaagtaaaac

SEQ ID NO: 471939 - DNA, 785 bp, Homo sapiens
tgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaa

SEQ ID NO: 471940 - DNA, 821 bp, Homo sapiens
gaacatgtgattgatgacccccatccttccctctggtagcccgtgcctgccccagtgggtccagggaagagcagagcaaagcccttcctgcctgctcatcagagctgccccaggcttgaacactgggaagggagcctggttaatgtgtgacactctcctttggtgctgtttggagccccagcactctttggagtctggggaaattcggcctttaaaaatcaaattgccatggagactgccttacgtgaaattttggttcacagccttcattggattatctattggtgcaaacaaagtaaaaacaacgagcttgtattactgtctcatggctaaggttccaagctattggatctttgtttgtgtgtgtatctacatgtctttgtattgctgtgagaaatgggaaagttcttcttcaaagattataaaaagtcataatttcttcttataacactgttaaccactattagtgtgtacatatgtgtgtgtgtatatatatacacatatatatatttgatatatatacatatatatttgatatatatatacacatatatatttgatatatatacacatatatatttgatatatatatgtgtgtatatatatacacatatatatatttgatatatatatgtatatatatatatatattccaaatcagctgtcctagcttgctccggcatacctggacagaactaggcaagccccagcccatagtgcatgccattccttatttggagattcttccttaactatccctagataacttccttttctttctttgttctgttccccttacctaattaagaaagttttaagct

SEQ ID NO: 471941 - DNA, 842 bp, Homo sapiens
agcaggagtgaggccaggtaggatgccgacaaaaatccaggaatgataggacagaatagcaagtgaaagtggtccaattattactcactgctttggaggtcccttcatggttgccaaaatgttattggggggtcgttgctcccagagctcccaagatggtggcgggcctcttccaagatggtggcaagcctcttgttctctgacctggggttcttggcctcacggattccaagagatggaatcttgggccatgcggaacaatggcaagccttcagcccaatcaggagtggtaatggatcagaagcacagcagacaccctgccggattcagagggatagaagtcagtggagggtctgtgacagcggcaaacagcagtggtggagttaataatactttccttctggttattaatagaactagaagtaatgtcagtgaaaggctgactcctgtgattggagcctcctttggagagctgccagagcacaacatgttaaaaggagattaagtcaatctttgaaacagaacaagaacaagaagcacatgttttcagcatctttttttattttaagtggccagttttttttttttttgcagtaattgcatttggaagttaaaatacaagacaactggtcagcagggttaaccaaattgtgagtttgagaaatgccccaactagggcattatccctttactattagtgctaatactttattgagcccttttataaagttggaattgaggagagtattattttgatgattaacataacttgcctcaaataagcctgactagtgtctaaaagtcttttcaaatctttcaaagcatgacattactgactcatc

SEQ ID NO: 471942 - DNA, 751 bp, Homo sapiens
ctggggcagccatgctcacagtaggtgctttaagaagacctctgccatggtctgctcagtggatgcctcagaagtggcccacgacagtggcgatgagtccttggactccacccatacctcagtaccccaggccttgccacctgaaggggcaatacaccacactttttcctgccccatcctgccctgccactggtatcccaccccgccctgcccacagccaggcagccaggcagagctccagagaggaggccgggcccacactggatgtccgctcccttcaggatctccaatgtgcgctccgggaccaagcccctactgtgtgcccccaggaccgagcccctactgtgtgccaggcattgggattgggatggcttctctacagacattgactcatctgtttgattcccacaggcagagtgtccactactcttccctagtcccattccaccccactggccaagtcagagatgaagaaattgaggctcagagaggctacaccacttgtgtaaggtcacacggttcccaaggtaaacagctggactggcagctgctccctggccatacaaaatccagagcactggcctggggtgggggctggctgcactcactcaggaagctcagaacatgctgggtttggcagaggtcgaagagccagtgggcccagcagttcatggagagtcatcccgaggtgtgaagccaaggaagctttggcccatgggagccaaggtgctctggttggggaaaacatgcc

SEQ ID NO: 471943 - DNA, 1991 bp, Homo sapiens
caggcacacagctggcaggggagctgcatgtgcgaaggcacagaggcctgcccgtggaactatgcggagctttatgaaaatcggaatgggtcaggggtacaagcaaagccccagcgtttccagcgttcttcccaaccctgtcgcctgtcgctcgacgcggacctcctgcaaacgaagcgcggcggctgccactatcgcctggcccttggttctccagcaaaggtggtggcagagccccaacagaagatagccatgggtgccaaagcccggatgggctcagaatgggcaggcttcataggcgatgagaaatggggaggggcggcgtggaccgtcttcaaagcagctctctctgcccacactcagcctacccacccaggattgttgctgctgctgaggtggccgggctggagcgggtcctggtaccagcacagctgataggaccaggggagtcacttgaccaaagccaagacaattcagttgtcccttctagaaattctttctttctcctttctcccttcctccttccttccctctcttcctcctcccctccctctcttcctttttccctcccttccttcttccctccctccttccttcttccctctcttccttctcccctccctctgttccccctcccctctttctcttcctcctctcctctttcttttcctcttcccctctttctcttcctccttacttctctctcttcctccttccctgtctcccttcctccttccttctctccctccctccttccctgtcttcctccttccctctctttgtccttccttccctctcttcctccttccctccctggtttctttcttctctctctctcttcctccttccctccctgttttctttcttctctctctctcttcctccttcccttttcccttcatccatccctctctctcttcctccttccctccctctcttcctccttctctccttcttttccttctcctctccctctcttcctcctcccctccctctctttctcttcctccttccttccctcttttcctccttccctccctttctttctgcctccctctttttcttgctttatccctctctcattttctttcagcaggaagagaagatggaatcaaatagctgtgaggttgagctagagtagtggacagtagtttttgaaggccacatttttgaatagacacagaatgtcccatagagtggagctgcctgagtttgcatcaccatttcaggttatgcttggacatcacctcattgaacacttggccttgctggctgcccctgggtccccatgactttcctttcctttcccttttctttccccttttctttccccattctttcccctttcctttcccctttcctttcccttttcctttcctttcctttcctttcctttcctttcctttcctttcctttcccctttcctttcctttcccctttcctttcctttccgctttcctttcctttcctttcctttcctttcctttcctttcctttcctttcctttcctttcctttcctttcctttcctttcctttcctttcctttcctttcctttcctttcctttcccctctttcctttctttggaactccctccctccctcctcagttcagctcccctccccgctccccagttgctctcctcaccacacatctgcagcctcacccagtcactgtggctcaggcactggcacggggatgggatggcctggtggtcagcactggctgctacctgtctgtttcctcgcaggaggagctgactgagcctcagtgtccccagataaggaggggaactaacacaaacaggatgaggacacagcatgtcagggcccaaaacgtggtgcaagctggggcacacaagtgactcagaagagggactgatgtaaaagcagcagcatgaaagtgctagcaaaaaccatggaggagttttcataaccagacactttaacagatattataaattaaattatcaacacattcaagttcccttt

SEQ ID NO: 471944 - DNA, 642 bp, Homo sapiens
gtgctgagagcctctcacccgctgtcgcatttgatccccacaacagcccctggcagaggtgacagtgctgtcaccttgttacagatgagggatctgagacccttagaagcaaagcgccagaccacatgggtagcaaagccaggacttgagcccagcctgtctgactccaggttcatcctcagaaccatgcaccatgctgccctgctgtgtgccaggccttgtgctgggaacacagatggaggatgcactgtccaagtggggcccatggtacctctctgcaaggctgcagctggaccaagtacaccgcaagcagcttccatggcggccactggagaacacagtggcacccagaagcttggagactccaggaactgcagggccccaaagagggagtcacagcccaggcttggggagctcccagcgcagtggctataaacacagaccctggaacttggcagcttggattcacatcctgtcctacaggatcctggaggggctaaaagcagagagggcagaagggagagagaagatgcagaccttgggctccagctcctgcgggggtccctacctccagtcaggcccgagctggagcagagacattgtggcttaaccagactggaccggtcaatgctgacaggtgga

SEQ ID NO: 471945 - DNA, 1506 bp, Homo sapiens
tctctggctttgcaaatgtcagtaggctgcccatgagctgaaggaatggttgctgatgtctgccctgttgtgggccagagctgtgttttgaaggataaagaactggtgcagaattgtaacaccaccaccaccaccgccaccaccaccatcactaccactgtcaccaccaccatcaccaccatcaccaccaccatcaccaccaccaccaccatcaccatcaccatcaccaccaccaccaccatcaccaccaccaccaccgtcaccaccaccatcaccaccaccaccaccaccatcaccaccaccgtcaccaccaccaccgtcaccaccaccaccaccaccaccgtcaccaccaccaccaccactgtcaccaccaccgtcaccaccaccaccaccaccaccgtcaccaccaccaccaccaccaccaccaccaccaccatcaccaccgtcaccaccaccaccaccaccaccgtcaccaccgtcaccaccaccacagtcaccactgtcaccaccaccaccaccaccaccatcaccaccaccaccaccaccaccatcaccaccaccaccaccacagtcaccactgtcaccaccaccaccaccaccaccaccatcaccaccaccaccaccaccaccaccaccaccaccaccaccatcaccaccaccaccaccaccaccatcaccaccaccatcaccaccaccactaccacaagcatcactaccaccaccaccaccatcaccaccaccacttactgagggcttctgctgtgccaggcactgcctgtgccatctcacttcatcctgaggcagatttcccatttcaccaatgaggactctggagtcagagaggttgaacacagtagggagctgcagaatttgaacctggctctgtgtaactccagagtcaagctctgaagcccttggtgggagaacaccctggataaacacctagtgcaaaggcaggatctgacattgtccccatttctacagaaaagaacactgagactctgagtcagaaagtgacctgcccagaaaataacacagcaaagaattgcagctggcataatgatgaccatttggtttctcacgacgagtttttagaaggaaaatgacagagcacaaagccttgtttttcagtgtttgggaaagggagggaggtgctttgctgtcaaagccggcaagaacagaggaggctcaagggagcaggtgggtccttacagacttgaggtgtgtgaaagcaggagggagctctgggaggatgatggcaccctcatccctgctgaagccagggtgaggggtgtgggccgggagctgcctctatattttctctgatccctgcacctctgtgtccacctgccagagcctaaccctgtgtgtggacttggcacttttcagttcccaaagtgcttcatttatttgttcattcattaattaattcacagattcattcgtattattcacgtgttgattagggctcaccatggatcattatctgtatagggctctggggtt

SEQ ID NO: 471946 - DNA, 800 bp, Homo sapiens
ggtttctccccagacagcagccctccctgccagggactcggcctgcacactaagcttaccatgaggctgaaggtgggagaggcaaagggagtgggggtgtgtgtgcatccgtggccctgggatgctccctgcctcaaccctgtggagggagatggtgacagtggagttgaccagactggagaccatgagatctacaaatccagtctggtgccaccaccctcactttcccgggagatgagcatggattctgcctccagcgctgaccagccccctaccccaagccctcgccctgccctccccacagatgccctgaagctgacaggcatagacactgccctctctggctccttggccaacatggatcactccagatccctgcagttctgtgctctggctgaaaatgcacttgggctgctatgttcattacaaactcagggcttttggggctgggggtgctgcagagactgtgtatatggagaaactgaggcctgagagcaggtgcttggtctcattctatggagctgggcccagggtccttgttcttagacctggtctttgtactgcaccacagagtcactcccttgcattaactccccacaactggagacccaccccttcctctccctaagcctcctcctagtctccttcaccctcagacctggcagctggccaacttcttccaccctgcctgcaccatccttggcatcttctcctatccccaccttgaggttcagtcatgcctagctctagaaagttggtggtgatcatgcataatgtttactgagaacatggaccgctcc

SEQ ID NO: 471947 - DNA, 3960 bp, Homo sapiens
ggtactaggccagagcaatgtggccagacagccaagagatttcaatttagggctcccagaactttcagtatatgagtcatcacagctaccatcgcctgagggcctactccacttgggcctccctgctgacccttgagcatgccagggtcactctcacctctgggaatctgcacgtgtggcttccgctgcctgggctgaccacccaagatgtcctcatggctcccagccttcgggctgttcccaaccattccagcagcagtgcgtccacagcagctttccccacagcagctccccccacagcagctccctcacagcagcagctcccccaacagcagctcccccatggcagtttcccccacagaagctcccctcacagcagctccccaacaacagctcccccacagcagctcccccgacagcagctccccaacagtagttttccccatggcagctcccgcagttccccctacagcagctccatgcacagcgtctccctcagagcagctcccctctcttcctccctggactggctccaaatcaggatgcatcctggctcctgggacctggatgcacatgccctgggctctcgtgcagggccagctttgattcaggggggctgggtgggccctgagatgctgcagtctaccaagctcccagggatgctgctgctgttgctggcacgcgacccacagcaggaagcaggaaagctgacttccctgaaagaggtaacctgcctggggctgtcaggaggaaggcccatgggaatgctcccagcatcaggggactttgtggttttctaccagaagaaggcactgtactggtgtcttccagagaaggtagtggattttgtctatgaaccttgagtgtagctgagatgggtggagatggaaactcccattaaacagtcattctctagtctctgggaactaccattctactttttctgtttctatgaattcacctactttcaatacctcattggccatcctaatgagtgtgaggtattatctcattgtggttttgatttttctttgctaatgattagtgacactgaacatcgtttcatatgctgttggccatttgtatatcttccttgcagaaatgtctattcaagtcctttgaccattttctaattgtttaaaatttttttttttttactgttagagagttttaaaaaatattctggatcttaaccttttatcagatatatgatttgcaaatggtttctcccattctataggttgcctttttactctattgatcattttctttggtgtacagaagttttaaactttgatatagtcctattcatctatttttgcttctgttgtttgtgctttttgtgtcatatccaataagtcattgccaaaaccaatgccatgaggtttccccccgttttcttctaggaacgttatagtttttaggtcttatgtttagctctttaatccatttagagttaatttttgcatgtggtatatggtaaaggtccaactttattcttttgcatgatgttatacagctttcccagcaccattttttgaaaagattgttcttttcttattgagtggacttggaatcttattgaagatcatttgattatatatgtaagggtttatttctgtgttttctattctgttccattggtctatttgtctgtgtttatgccagtagtacactcttttgattattgtaactttgtaatattttctaaaattaggaaacataaggcctccaacttttcaagatggttttggctattcaggatttcttgggtttccatattaatcttaagaatttttttcaatttctgcaaaaaaaatgccattgaaattttgatagatctcaatgccttaaatctgtaggttgcattgggtagtatgaaaaattaaacactgttaactttttcaatccattaacatgggatatctttaaatttatttgtgtttttaatttcttacaacaatgttttgtagtgttcagtgtgcaagtcttttgccttctttgttaagtttattcctaagtgttttatccttttcaatgttcttgtaaatgggattattgtcttaattttcttttcagattgatcgttgttgttgtatagatatgcaactgctttttgcatgttgagtttgtatccagcaactttgctgaattcatttattagttctaactgtgtgtgtgtgtgtgtgagccctttagagttttctacacatgaaatcatatcatcttgattggagttaattttacttcttcctttctaatttggatgtattttaattctttttcttatctaattactttggctaagacttccaggacgaagttgttagaagtggtgagagtgggcatccttgccttgttcctgatcttagaggaaaatgttcagcatttcactattgaatatgtgttatctgcgtgcttttcatatacagactttattatgttgagatagtttccttctattcctagtttgttgagtgtttttaacatgaaaagttgttaaatttttgttaaatgctttttatgctgtgattgagatgattatgtggtttttgtctctttatgtggtgcactactttgattgatttttggatgttgaaacatccttgcattccaggaataatctccacttagtcatggtgtataatccttttaatgtgctattgaatttgatatgcaagtattttgttgaggattttttcatcaatatacatcagaaatattggtttgtagttttcttttcttatagtgtatttttctgactttggtatcagggtaatactggccttatagaattagttaggaaatattccctcctcttcagtattttggaagagattgaggagggttggtgttaattcttctttaaatatttggtagaattctcctgtgaagcctggtctggtcctggtcctggacttctttttgttgaggggttgttgattactgattcagtctctttagtataggttataggtctgttaggttttttatttcttcatgacttagttttcatatgttgcatgtttctagggattatccatttcttttaggttatccaatttattgacatataattgtcatagtattctcttataatcctttgaattcctgttgcattagttgcaatggcctctcatttctaacgttagttatttgattttttatattttttcttagttaatccagctaagaacttgcaaatttgtttatcttttcaaaaaacgaactcttagttgcattgattttttctattgtttttctattctctatttcatttatttctgctctaatctttattctttccttccttccctaactttgggttttgtttgttcttatttttttccttgaggtgtaaagttgggttgttgatttgagatctttcttcttttaatgtaagcatttacagctataaacttctccattagttctgtttttgttgcttcccataagttttggtatgctgtgttttcatttttattcatctggagatattaactaatttttcttgttagttattctttgacccatggttgtttaaaaatgtgttgtttaatttccacatatttgtggctattctagtttttcttctagtactgatttctagttttattctattgtggctggaaaagatattttgtatgatttcaatcttcctaaatctattaagatttgttttgtgctctaacatgtggcgtatcctggagaatgtttcatatttattgtgttgttgttgggttgagtattctgtctatgtctgttggtccaattggtttataatgtttttcaagtcccccggttccctactggttttctgtctggttgttcaatctgttattgaaagtggaagtattgaaatcttctactgttattgtgttgctatctatttctctcttctattctgtcaatgtttgcttcatgtatttaggaactcacctgctgcagtcacactggcct

SEQ ID NO: 471948 - DNA, 657 bp, Homo sapiens
tgcctgcctgctcttgagggtctggctccatcatgggaccctgagggtggaggtgggtgaggggacaatgcagaaattaacaatccaaggacacttccacgggcctgtgaaagcaaaatgtctagagcaactggccctaaggatcacgggggcttcctagagcagaagacttctgagcttaacagacaaatgccagggcagagcatgtcaaagggatgcatttccaaggatggggacgaggatgtcagctttgctgagccaggagcctccttctacagctgctaccacctgagccgagcctactcagcttcctgctcccgatgtgcaaacgtgggactcagaataggaggacttgggggccagctgaaagggcaccccttgtgggtggccaagaaggaccatgttacctcgtgcaccgagcataaggcctggagcatggcaggaggtctgctgcagatcccagttcagccattccagtcctcagtgccccaggtcacggctggtcagtggcagatttcagatgggatttcagtgcaggcctgttgagctccgaagtccagtcttctcttttggactcattgtctgtacattgtaaagtgttggggacatgcatagagttaatgtgattatccttttattgcagtatcctgtagccca

SEQ ID NO: 471949 - DNA, 1699 bp, Homo sapiens
cctcccctcccctccccttctcaccctaattggctgggcttccctgcgagtttgagcagagttaggaggtgtgagcatgtgttttctctattccgctgacatatgatgcaatgaatccccgtctcagatggagcttgtgttctggtgggggatgcagatagtacacaagcaatcatgctgggaagtgagaagttccgtgggggaattggacagggtgaggagacggaagtgaggagggtgggcagtgtgtcagtggggatgtggcaagggacagatgagatggcacagtcaagtcaggcaatttttggagagtgtaaaaaagagaccaagaaggcgaaggcatgggcagggcataaggaaatcctggagatggtgctgtttcctggcatccggcaacagagggctccattaccacccttggaggatgaggagccccttgatgtagccgataagggctgccacccagaagcacagagtagaggggacaagggtgaagcgagggtgggaagggacacccctgtgcagggggaaggtatcttcttcatcatcatcattttttccatcatcatcgtcatcatcctctctgtcatcatcacctccatcatcatcctttccatcatcattatctccatcatcatgttcatcatcattctctccttcatcatcattctctccatcatcatcctctttatcatcatcttctccaccatcatcatcaccattatccccatccttgtcatcattctctccatcaccaccatcatcatcatcatcctctccatcattatcgtcatcattatcctgttcatcatcaccatcctcctcatcttttccatcatcatcatctttcccatcagcatcctctccatcatcatcatcatcatagtactgtcaccaaaggaagcgctggcagcccttcttccaggagtgaaggctcacacgtgcaaatcccagcccctaagaactcacctgccctacagtcctgtccacccttctctgctaagtcctgtccacccttctgatcgcatcccatggccacctcctccaaagccctccttgaccccccaggccaggtcagacccccccatcatcatggactcttctaaagaggagacttctgagcaaggatctgaggctgcagtaactctcaaaggcactgatgacgagggacggtgcaggaccccaggattaacagcagcagggagtccttcagtgccaaggtctgaggaggggcagtcagagccagctagagagctgcatgtggagctccgccgagaagggctgtggcctttgggggaggaatgcagccaatccggagacacagcaggggaggtgcagggagatgaacgcctgttctctcatctcctgctagtggccccagtggccaagcccaccctgaagccagagggcctgcctgcacagggcctctgggaccacagagcaggatggcagggacctcatcagaatggccttcactatacgttttcctacagcattctggtcatgaccacttaagtaatttctaagaagactgagactttctctacagctcttgttttctgagccctcaccagaatcacccttacttaataccctgttcatagcaatgcaggctttttctagattcgcttcaaaattgttccagtctgtaccccatcacctgcttccaaaactgtctccacatttttaagtatttgtt

SEQ ID NO: 471950 - DNA, 1522 bp, Homo sapiens
ctctgcaatctcacatgtccccgacacccctccctcaggcccccaaggctctagtttctctccccaagtccccctgtgtggtggttaatactgagtgtcaacttgattggatcgaagatgcaaagtattgatcctggctgccagcgaatatacagcaggaagaaaaacgtgaaaagggtaactgtgcattgggcaaagggaaatgatcagacatttcagggactactggacactggctctgagctgacattgattccaggggacccaaaacatcattgcagtcctccagttagagtaggggcttatggaggtcagctagttaatggagttttagctcaggtccgacttagagtgggtccagtgggtcccctgactcatcttgcagtcatttccccagtgtcagaatgcataattggcatagacatacttagcagctggcagaacccccacattggctccctgactggtagggtgagggctattatggtgggaaaggccaaatggaagccattcgaactgcctctacctagaaaaatagtaaatcaaaaacaatatcgcatccctggagggaatgtggatatgagtgccaccatcaaagacttgaaagacgcgggggtggtaattcccaccacatccccattcaactctcccatttggcctgtgcagaagacagatggatcttggagaaaaacagtggattattataagcttaaccaagtggtgactccaattgcagctgctgtactagatgtggattcattgcttgagcaaattaacacaactcctggtccctgttatgcaaccattgacttggtaaatgcctttttctccattcctgtccataaggcccaccagaagcaatttgccttcagctggacatccccgaagtacaatggtgaagggacatcttcccagtgggcagaactttgcctctttcccaagccatccctgtcatcacccaatgggcccatgaacgaagtgaccacggtggcagggatagaagttactaatgagctcagcaacatggacttccactcgccaaggctggcctggctatggccactgccagctacctggtggcaggttgattatattggacctcttgcatcacggaaaggacagaggtttgtcctcattggaatagacacttactccagatatgggtttgcctctcctgcacacaatgcttctgccaagactaccatccatgtactcacagactaccttatccaccgtcatggcattccaaacagcatagtagtagaagaaggtagtcatcgataccagctatgaccacgtgatcagctgcagaaatgaagactgtaaccgtcatgggtatttcctccttctttggttaaaaacatgtctgtgcatgtatacactcgtactaagaaaatatattcattttatttccttttcctttatcacgtgacataaaatttattgacttcatatcagcattaaagtattgttaactttatgaatagtatttgagttggggaattggtgggtttctggttgt

SEQ ID NO: 471951 - DNA, 1163 bp, Homo sapiens
gagctgggctctaacttctatgccaaaaggatgggaaaaccttgcgtgccgacctgagtgcttctctggaattgtctgctcagggagaagccagctgtcacgtcctgaagcagccctttggagagatcgtgagggcaatttcataacacatatcaaagccttaaaaatgcccatatcctttgacctgatgagaccagaaatctatcataaggaaataatcagagatgaagacaaggatctatgtgtagagttgaacaaaaatgaaatgggtgcctgggatattgacaaaattgtgcatgaagctaccatagaagtcctgaaattcttaaatccagaattttcttacatgagggaaaaacaaatctttcttgaagccgctgtctttcagattccaattaatagctgatttatttcctaacaaatacactgagccagggtcaaagattatatatatatataatatataaaacatatataacatactatatttatttattttattatattaaattttatttatatatttttaaatatatgtaacacatttatgttttatatatgaatatataacatatttatatatttaatatataaacatatatgaaacatgaatatatatttatatataaaacatacatgtgaatatatatttatatataaaacatacatgtgaatatatatttatatataaaacatacatatgaatatatatctatatataaaacatgtgaatatatattcatatataaaacatacatgtgaatatacacatataaaacatattcatatataaaacatgtgaatatatattcatatataaaacatatgtgaatattcatatataaaacatatatgtgtatatatataaaacatatgtgaatatatatttatatataaaacatatatgtgaatatatatttatatataacatatatgtgaatatatataacatatatgtgaatatatatttatatgtaacatgtatgtgaatatatatttatatgtaacatgtatgtgaatatatatttatatgtaacatgtatgtgaatatatatttatatgtaacatgtatgtgaatatatatttatatgtaacatgtatgtgaatatatatttatatgtaacatatgtgaatatatttatatataacatatgtgaagatat

SEQ ID NO: 471952 - DNA, 1594 bp, Homo sapiens
gatgaagcagcttgggaatggtcccagaagttagagatgcatcctgtggccagagaatagcagacacacaggggataaataaggcagtaagctgggagacatgcagggaggagagcagctgcccaagccgggccctggggggcttcggggatggagcagctctgagctaagccctggctggggcccttggtggagcagagagggctggtggtagctgaggacaggatgggattggggatcccagcaggggccctgggccagggcagccaggaagaagccagagaggcaggactcggcaccctgggctgggagtcagggcctggtgggaagagcagccaggagcacaggggcggggcctggctgctgacctgggtagggcctggccctgctccacccttctctgcccccaacctcctggtgactggccaggccctggcgtccccgactcttgagaatccaggtgattggaggtgcccagcaaagccggcccttcctctgggaacatcctgctcctatgccaggcagcgggtcgcagaaggaggtccagccctgctggctccttttgtctccaggaacccagctcttagcccggacagagaagggccatttgtcaggcttcgacagtgggagtttagcctcaactaagtctcgggaaaaggattttctgtgtccgtgaaaactgacaattcaccccaagaatcaaaaaagacagttttcctttccacttagtgacaggagcacagaccttttggggtctgctttgtactattatacacaattcaaaccacatcacctgccccactctaccctcaccagccaggggctcatcagtgacaatgtaggaaaatgcaatcggtactttcaagacatactatgtaaaaagtaatttccaccgtacagtttttacctttccttcttttctttaaatgacagtatttcttgtttgctctcctctctcaggacagatccacaaaggaggatgaatctacaaaattcacaagtttctgagaagttgtggctcttaaagatgtactaaccttaacctgcaacatgaaataccactgagtgtgagcatgtaaaacccagcaacttcgcggtacaggtaatctgtctccctgcagctcatggggcctcctctcaatcttccagaatgcacaagcctcttggctctgcttgcctctgttcatgccctcctcaggcagactttctcctccccatggggaagatgcactgccccaggctccaaggtccttgcagcttgtcatcccagaggagagaccttctccctccaagtgtccacctgtcaaatctctgggaagactaggaatgcaccctcagctccaccacatggaactggctcctcaccacaaaggtaattctggaagaggtaagagggcttccagacaaacaccccagaggtcctctacgtgacctgtgcaccttttggtttgtaggatcctgggaaagcaagggtttccctgacatgactgtatccatccccctaagcccacagaaggtgagagtggcatccctgtgctggttgtttaggtcaaagggctcaagggtaagactcgtggaaaaagacttttccaag

SEQ ID NO: 471953 - DNA, 598 bp, Homo sapiens
ctcctccccaaagctctgcagggcagtctggggtgggcaggagcatggaccttagtgacagaggcttgggtttgagccatctctgccatcttgagctgtgtgaccttgggcacagtgccaagtcatccataaacattgacagtacagagtttcatccaacacaacagccttacaagctgacaatttcattacttgatttttcatttaccccagaaaagccaagaggtctcgaacctaaagaaccaggtcgatgttccacttcaggactggagcagggagagctgcttttggacgggcctgccctccatctcctgtctctggacttgggaggcctgtccccttcaccctgtttcagaccctgcaggccaggccacagagccttggcctgggtcaaactcacccctcactgtggccaattagttttaacttgtcataaattttttaacgaattgctgatcgataagaacttggcagctactactgagcctcaaagtcaaggggtaaaaagaatctaaatgatgtctgccaggttgttgtattaacctggctccatgcttattgcctgttgttttgagttaattacctggtgcctaagtgt

SEQ ID NO: 471954 - DNA, 758 bp, Homo sapiens
gaacgtcaccgtcaggcacctcaaggccaactctgcagtggtgagctgggatgttctggaggatgaggttgtcatcggatttgccatctcccagcaggagcggggctggtcaccgagtgttgacagcagtgaccggcgcttgtctgcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaaggcaggcccgggtcactgttaagaggaatggggtgggatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagtgcttgccctcagcagctaagaagacagacagtagagaatgtgagaggatctcatggttctgatgatgattatccaacaaacatctggccctctctacatctcttccctccatctccttgtaccctctggcttactgtcctctctctggc

SEQ ID NO: 471955 - DNA, 739 bp, Homo sapiens
agctctcaggaggtcaactcccaggcgagccgaccacagacgcagcagccaggaatggctggaggctgaagagggaatatgatggcccagagtgacaagcccaggaatgctggcattctagttggctctggtcccacctgctgccagacacacccatctgtgtttgtgggtcccggggcttacgtcagggtgtctgcgggcttctggcagcaagtcccggaagtggctggaaaggcaggttttacagaaaatggaccagaggggttgtttttgccaactttccccaaaagacaaaaggccatgccaggatttgaacctggatctgtcaccccgggaaatctgtactctcatattgaggaaccagctaagatgcagcactttctctatctcttgggctccctgacagtggacttggcatggaactgggtgcttttacccaggagtcagggctcttcttggggacccattggagccatctccatcttgcagagctcagcagcctcaggggctctcccagcaggatcttcaagcctagacttctgtttggagaaggaccacctcaagcagccccagccttcctgatctcccaacaccaggggttgcctaggagccacgtggagccctatgctggggacttcccctcccctggaacttgctcgcccttccatggaccctgccactgcctggctctctcaattacctgcctctgcttctaccccacccctgcctctccctcctt

SEQ ID NO: 471956 - DNA, 583 bp, Homo sapiens
tttatgaagacatcgggctggcatcggaatgttgatgtcctcagacaatcttttaaaaaatcaagggccacgtttgggtatgttctcgagctcctttaggtatgcaaggaagagccaggctcagaggactttcagtgatggtggctacaataaggacacagaggaagtgaggttattggggaagccctctcagcagcgtccagcaagtccccggagaacaggaactgggatagacttgtgctctggccccatgccctctgggcatgttcccagcatcgatgtctcccataccagacagtctcacacaggcattggcctccatcacatccagcttgtccaaggcagcaaatggctcgggcccaaatcctgtgtccagtcagctacagtgaggttggcagggctggcctcattggacttacgtgacctagatcacagtgatttcatgaagccagaaggaggcaatacaggaggagccaagctggctgagagtcgaggcgaaagtgaggtttggctcaaaaggaccttggaggtagaattatgaatggttcatgagcggagccatggaggagggctccggaccaaa

SEQ ID NO: 471957 - DNA, 547 bp, Homo sapiens
gaggttcccagcagagaaaacatggagcaagaccaaagtgtggcacttttgaaaatgatttgtctaattggagaagaattgttgaatgggatgagggcagaacactggggaacccaaactctaaggattgagcaaagatgtctgagaaggagcactacagaggttggaaaaggaagacttcaaaaagacagcaatcagcatcctgcactgcaagaaggcaggtcaactaacaaggacctgaagtgcttcattaatgatcttggtgagagtgaggagtgggcacagaagcttgaccaaaatccattcccccagcctccaccaattgggaggggagccagaggggagggtgtccatggatttgccttgggaggaagagctatgaggaagtcttcatgaatttgtccctgaatggcagccaaagcaggaagcctcctaagtttggaatggggtctgcacctgcatcttacatcccacaacgaagtggagcctctgtagcagtggcagactacaggtctgtatttacatgggtccgtatttcatctgcatc

SEQ ID NO: 471958 - DNA, 600 bp, Homo sapiens
agagagtgggcacccatcccagcacctggagctgcctgtgccatggcagcagctgtcgtgtctgactgtgtgcagtggctggaccccacactcgttcacacaccccttgctgttccatgcctgactcccactcagagtcgtggggtccaggctggtggcgtgagccgagcgtggcctgccaggccaagtgagtggaacaagctcagtgggcccgagcaacactcagggaaaggtgccaccagccacagaggtttctggccagaaaagcaacaccccaaagatcctcaagacaccttttctcctcctgcccttggacaccagactctccgttcttcagcctttggacctgagacttgcactaacaacctcttggagcctcctggaggctctcaagcttttggtctcagactggggcctgcactgctggcttccctggatttggagccaataaatgaaaactctgacaacaagggcttaaacaatggggcttatttttctcatgcattaaaaatctggatgtaccagcttgaggctggtgcaggctcctaaggtgatcaacaaagacccagtctccttggatttatctgttcttccattatg

SEQ ID NO: 471959 - DNA, 886 bp, Homo sapiens
tacaagcatgacactagcagctgcttctggtaaatcctcaggatgctattatggcagaaggtgaagagagagcagaacgactctttcagctttatccatccttcaaatttcaatgcaagcaccaatctcttcaagaaccattccagacaccttctccctgcactgttccgcagggaaatgtcaatgtttttactcttacacagacaaatgagaataagaatatcctttatatacagggagttcttacaaatcagcaagaaagagataagcacaacaatagaaaaacagatcatgagagtggaggccccatgaatcggattagtgccactacagaagaggccctggagggctccctcgccccttccaccatggtaagggtccaatttcattcttatgcatgtggatatccagttttcccagcaccacttgttgaaaaaaactgtccttatctccaatgagtattctggcacccttgttgaaaatcatttgatcacatatgtgaaggtttattttcttcatgttcttaacttgcttaaaattatttattgaatttccctaataccaaggaacaaagagtatttttaaaaattgttcaagtttgttcaatggatgccttttttcttcagcagattttttttctttttatgtcacacaaatataagactcatcaagatgaataacaccatttaaaaattcattcaggtacagatgtaattatctttaaccagactcaacgaaaatttggatttccacaaatggcaaatcagaaatgatcatttatcttactgaatcacctaaatttccttttaaatatcaaaagtataaaaaggaagaaaaattattgagtttatattgtattcaaggtactgttatctcatttaatctt

SEQ ID NO: 471960 - DNA, 472 bp, Homo sapiens
cacttcctggatatagcagccatgaaacgagaatgtgactccttcatcattttggtaaacttctcagtcatagcaggcataaggcagagcccaggcccagacttggcaaatgccaccggggaaggaaacagctggtggtcatcagctcacctagaatgggctcttctctccacagaatcatctaatccaggatcccccactgcatttggtggctgtgtcttcttcgttccctccaatccaggacccttcctccatctgttcttgtctttcatgaccataacacctctggcaagcactggagattttgaaaatgttcagcctttccagatggcattaggtgctaagtgtcagaaaagactgctaaaagtgtggtgtagagaaaaggctgggtgtgtgattgacaacacatctttttctaaaaccacagaaatatcaagagatcacacaagaggccccatcaagagatgaaggg

SEQ ID NO: 471961 - DNA, 548 bp, Homo sapiens
ctgtgcccaatgcaactcgtcccaaatcttccttctttccctcccgcctgtcccctcagtcccaaccccaagcaagtgtttaggctctttttcatcaaatataaaaacccagcccagttcatggcttgtttggcagcaaccctgagacgctttacagccctggaccctaaaaggtcaaaaggccacaaaccccagccacatctccagcacacaagaacttccaaacgcctgaactgcagcagccaggtgttcctccagaacctcctcccacaggagcttgctacaagtgacggaaatctggccaccaggccaaggaatgcccgcagcccgggattcctcctaagccgcgtctcatctctgcgggactccactgaaaatcggactgttcaactcacctggcagccactcccagagcccctggaactctggcccaaggctctctgactgactccttcccagatcttctcagcttagcagctgaagactgacactgcccgatcgcctcggaagccccctaaaccatcacggacgctgagcttcgggtaact

SEQ ID NO: 471962 - DNA, 566 bp, Homo sapiens
ttcctggaatctaggtttataaactaaacataggtaggaaagatgaggatatcatgttcgaacatttccctggctcaaaatgttaccggaaaggggtctcaatcaggacctcaagagagggttcttggatcccacacaagaaagaatttgagtgaagaccaccagaggtcgcgaagtgaagacgaccagagcagtgaagacgaccagaggtcacgttcatcatcttgcaataggcgcactgtcccctctggaagactaggtgggaccaaggagatctgcagcaggtgcggaaggactagagatcaccttacaaagatcaagagtttatgcagatcaaagctggtaggacccagaggacagcaccaggacgtgaaccctgctgtacacagatgccgtcctaggagacaggcaatacacaacagaactgatagagaatctgaactttaagtttaaagcttggatggaagaaaaactcaatttagagaaactggttgttttaccaaggctttgactagaagggtatgcttccctttaaggagtcaagctcaacttgcagagccaataaa

SEQ ID NO: 471963 - DNA, 888 bp, Homo sapiens
ccctcctctcagcagctgctggccaggttcggtcttcattccctctcacatggactctgcctctagtgtcccctcccagcaagggctgaagaagaggagactggggtgggagaaggtggaatgggggctgcctttgtcgctagcctccgcagtaacctttcttctgccacttcaaggtcagagatgaacagcagtgttggggacctgggtgttggcggctgcagcctctgggatgaccctgctcgcttcatcgtggtgcccgcggcctatgccttggcactgggcctggggctgccagccaacgtggcggccctggcaatgttcatccgcagcggcgggcgcctgggccaggccctgcttctctacctgttcaacctggctctggttgatgagttcttcacgctcacgctgcagctgtggctcacctactacctgggcctggcccggaggccgcctgccacgcggccggggccacctactacgtgtccacctatgcggcgcgtgtgccgctgcggcttcgtacgcggtcccgggcccagggcggctgcccgcctggcccggtgcctacggcgccccgcgcgcgctgcctgcgccttcgcctggctggcgggcctggcccctccctgcctggagcaccgctgggcaagctcggggctggcctccgccacggtggccttcgcggccgccttcctgctggtgctcgcggccaacgtgagcctggcgcgggcgctcaaggcgccctctggcccgggcccgggccctgcaaccgccggcgcgcaccggcgcgcggccaagaccatggtcctggggttcctgctggtcttcgccctcagtctggcgcccaaccacctgctgctggcgccctaggtggctgggggggaagacaac

SEQ ID NO: 471964 - DNA, 1016 bp, Homo sapiens
ggccacagaaatggtaaattctttggcaccagttccccttcacccctagcaccatctgcctcccccttcccctgactcccaccccggacacataccccactcactatccagcctagggaggcaccagcactgagctcttagtccaggctgccatggcattaactgtgaagccacttacaagtccactggcctttggaatctggacacttcctgctccaatattagatgagctgtcctgggctgtgatagcactgctgcactccagcctggacaacagagaaagaccctgcctcaaaaaaaaaaaagaagaagaagaagaaggagaaggaggaggagaaggaggaggagaaggaggaggagaaggaggaggagaaggaggaggaggaggaggagaaggaggagaagaaggagaagaaggagaaggaggagaaggagaagagggagaagagggagaagaagaggaagaagaagaagaggaagaagaagaggaagaagaagaggaagaagaagaagaagaagaagaggaagaagaagaagaagaagaagaagaagaagaagaagaagaagaagaagaagaagaagaagaagaagaagaaatgattgttttaaaaataattgtagcaaaacagttatttgaatattcatctatcagtggcatttgatacggttgatcattcttccctgaaatactttcttcactggtctccacactcctgattttaccctttacttctagctattcttgggtcctccctgtctccctgacctctaaagactggagactacgaggactcagtccgtggacctctgtctagttttttcttatttacactcactccctagataatctcagccaatctcagggctttacataccttttcatgctgatgactctcacattcatatttccaacctggttccccttcatcaaatttcaaaactgctgccagtatagtcctgttaatatgtaaatcagaccacagctctcctctgttcaaaagtctcttgcgtcgtag

SEQ ID NO: 471965 - DNA, 850 bp, Homo sapiens
cgtgcagcctgttttgtaggtggccggcgctcggcaagttctcccaggagaaggccatgttcagtacgagcgccaagatcgtgaagcctaatggcgagaagccggacgagttcgagtcccgcatctcccaggctcttctggagctggagatgaacttggacctcaaggctcagctcagggagctgaatattatggcagccaaggaaattgaggttggtggtggtcagaaagctatcataatctttgttcccgttcctcaactgaaatctttccagaaaatccaagtccggctaccaacttggaaaagctgtacaaaatataagcaaaagcatcccaggagccatactctgacagctgtgcacgatgccatccttgaggacttggtcttcacaagcaaaattgtgggcaagagaatccgcgtgaaactagatggcagccggctcatgaaggttcatttggacaaagcacagcagaacaatgtggaacacaaggttgaaactttttctggtgtctataagaagctcatgggcaaggatgttaattttgaattcccagagtttcaattgtaagaatcacagccaacgcttctgagcacatatgaggcagacactttttttttgtaagagctttgcaagaaagaaatcatctcaccttcatagtgccccagtgaggcaccatcattattcccattttacagtcaatgaaactagcaaagagagaagaaacagatttacaaaggctaaataacttccaaaggttgtacaatttgctaaattgagaaaaaaagatgtaatataaagttactatcataaatgtttatttattgaccaatatttttgaccagctgttt

SEQ ID NO: 471966 - DNA, 646 bp, Homo sapiens
attataatctgcatgcctctaatgcctggcctatatggctacccatgtaaccgcccaacgggctcactttgcccactgcctggacatagccgatttatcaagacagatgaattgcatagagacagagtaattcacacagagctggctgtatgggagacgggagttttattattactcatatcagtctccctgagcattcggggattggcggtttcaagaataacttggtgggtagggggcaaccagtggccaaatgtgaggaccatgacccatgacacagccccaggaggtcctgagaacatgtacccaaggtggttggtttacagcttgattgtaccatttaagagaaccgaagttacaggcaaacatcaatcagtacatataaggtgtacattggctcgaaatgggaagggggaagtagaggaaacataccagatctggactgtctatttccaggtttaagtgatctcaagatgaaacctggaagcaaattacagaaaccttttcttcccttagttttaacacatagcgttgaaatttactttgaaattcccctctcttcccttttctaccatacactcttttaccccatgcacatttatctaactgtatgcttgttaaactcataccatgcacatttatctaa

SEQ ID NO: 471967 - DNA, 692 bp, Homo sapiens
accatatgagatccttgcttctaggcccggcatgttcactagatgaggcaacagctgcaacactgccagaaaccacgggaagggcgaaatatttgctggttgctgctatttgaagccttgccagaatcaacaatgatgcctgtttgtgaagatgcccacaaaccctatagagattctgccagccagcttaggccgcaggtctccatcctgcctttgcgaatgttctctcccccatggctggaaccagggctttccttcaggactgaggactccctggtgcagctgcagtccaggtgtgggagcagcaggctgactcggtgcattcaggggccacattcaccccagaacatcattatccttccccagtgccattgcaagtcatttcctacaatactgtcacatctttcctctcctgatgttgaatccctgctttatgatcaagttgagatgaggaaaaaaggaccccagtattttcagccttccctgatttggggagagcctccatttcctgaggactggctagatagaggaaggagcaggggaattgactgggaagaggcacaagaagactttctggtgtcacggaaatattctatatattgaaaggagtgtgaattacatgggtatataatttgtcaaaaatgattgaaccatagacttaagatctgtgtctttcactgtttgtaaattat

SEQ ID NO: 471968 - DNA, 2063 bp, Homo sapiens
gctgggggagttagaaatcccagaggcacagaaggatttgaaggaaatggttaaaagtaaggccgaatgtgataatgtgggttctgtggagaatggcaaaaccaattctgttgttacatgttcaggtgctggcaatgggagaaatgttagctccctaaatgaggaagtcacagaattggacatggagaccaatatattttgccctcctcctttgtattacactaacttgacccaagaaaaaccgccccctgcacaggctaaaatcaccattgagcctcaaatgaatgcacctgaggaaatggatgatgcttctcctgaaaaaaagcgtgtaaatcccccagcacacaggagttgtctaaagcatccaagttctgcagcacacgaacatcctccaatgcttgtaaatcctccacatattcagaatataggagcaactaatcaaacatgtcaaactgaacaaaatcgaattaatacaataaggcagttgcctttgttaaatgctttgttagttgagttgtccttgttatatgaccaacctgtgacaagtcctgctcatatacatcctcacctagcctggttatataggactgaggataagaagtcacccgaatcttctgccaaatccacatgccggtctgaagccaagaaggataagcgttctgtggggggatgtgaaaagtcagtgagtcttcagtataaaaagaaccaaattgaaaactataaggaagataaatattctgaaaagagcagtggtgccctccataaaagagttccaaaagggaggctactttatggcttaacaaatacactaagactacgtttaaagctgacaaatcctgatatgttggtggtacatgaaaaaagagaactatatagaaaaagacaatcacaaatgttgggtacaaaattcagaattccgtcatccaaagttaaactattaagctctgcagaacaaagtcagaagccacaactgcctgaagataagtatttagattcagatgcatctttcactgaaaatagtgatacctcaagacaaatcagtggagtttttgatgagcccagcacaagtaaagaaactaaactgaaatatgcaactgaaaaaaagacagttgattgtagtaaaaatagaatcaataatgtttcattggaagaagttgtgagtcctgcaaattccattattccagaaaggcttacccctacaaatattctgggaggaaatgtggaaatgaaaatccaaagtccatgtgttttccaacaggatgctgttgttgacagaattgtagataaggaaatagatattagacaggtcaaaaccacagataatgacattcttatggctgatataagtgacaagagaacaggtaaaaatagttgctatgaaaacatctcagaactgaagtattcagatgatttgtctagcccttgctattctgaagatttctgtaccagtgaggacaccagcagaagtttcaaagctcatgatagcagttcaaggacagaaaatccaaaacatagtcaatatacaagcaagtctagtgacacaggagtgtccaaaaagaaaaatagtagtgacaggagttctatccttagcccacctttttcagccgggtcacctgtacactcatacagaaaatttcatatttcaaagactcaggataaaagtttggaggaagcatctagtatctctgctagtgatttatcttcaacacattggactgaacaaaaagaaaaccagatagatcaaaatagtatgcacaattctgaaattacaaagagagctcaagacatctctgttaaaacaagaagtagttggaaatctttagaaaaaagccagtcaccacaaacatcccaggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacaggtaccctaaaacttaaagt

SEQ ID NO: 471969 - DNA, 1197 bp, Homo sapiens
agcagcaacaacagcagccttaagagagagacagcttcccataaagtactcagaagaagcttcagaaagcccccagaggaagcttatcatatgtgcttggcattgcatttggtctcttacagactgtgtttaatcttcatagcaactccaggaaattattggcatactcataaggaaaccaatgaaactaacttggagagcttaaataatgtattcaaagttacacagcaagaaagtggacttgaagtcagtggaaagagatgcttgaattatgataagggggattgtgaagatgaaggttcttgttatgtagatgaagactccagatccagcaatggcctagttgcattaatggagattgcctacagacacaaatttcccccagcaaagacagctttcggggccatttcaaaggatggcaaagaaatatattttggggatggctacaagcgaaaaaaacggaagataagaactgtttccaagcatgtggggaaattggaagcctgctgtaccactggtggaattataaaacagtgaaactgctgtggaaatgagtttggtggtgacatgcatggaattgtgtccccaaaaattcatacattaaagccctaacacctaatatgactgtaccatatttagctatgaagccttccaaagataacaggacattttccatgattttagattttagatgacaacagattgatgtataaaaccttattgcctaaaaatcactaatttaatgaattcgtactaagcagggtagggagagagataatttgggattttatgttctttaattttatcagcttaactaataatttcaatgctggatacctaattgaataaaaaccatgtagccttggtccctttatattgtggcttctctgaattccataagcatgctctaaaaatttattgtatattcatgtactggactgtcccagagacttttcacaaagcagtagctctctattaggtttttatatttaaatgataatcagtgcaaaaatcacttaacttggcactcactacaaattaaagaaaacaagcattaagtatattgaaaatgtacccagacaaaatgtaaaaatgtatcatggacatatttataaaacttgagaattgcagacactcataaagattttaacattttagcattgaattgttctccagttcctggtttcttttgtacca

SEQ ID NO: 471970 - DNA, 979 bp, Homo sapiens
gagcagaggcctgaatgaaatgagtgcatggactctgctgtcatctggaggaaggacattccaggcagaggaagagcacgtgcaaaggccctgaggacgtgagaaggccaggttgaatttcctgtgtgaaatggtgtgtgggctttctgagcaaaacaagggtcaggctgtggtcctaaaggagccgatgccaaggtcacctggaatccagtctccggcagtgcagccctccgggatgcccaggccactcctgccctccctggggatgagttttccagacgtgtgctggggagagagctgggacgggcacagaatgttctaccacacaccacagtcgcgccccatttatccaggtcctcaccgcagggccagaggtcccccacccccctcccagcccctaagtccaggccctgctccacctcctcctgctgtgggtattagctggggcaagtcactgtgcctctccatcaaaagcacatgtctgatcagctcctgccctgctcagcaaaattcctggttccccggtgcccaagacacggagatccagtccttcagcctcagcttccttcagggcaatggttctcaaccctaggtgattttgtctcttaggggaacatttgtcaatgtctggagacattttcggttgtcacaactcggggcgtgcaatggcacctggtgggtagtagccaggaatgctgctaacatccaacagtgcccagggcaacctcctacaacaaaaaattgtctggtcctaaacgtcagtagtggtgaagctcagaaactgttctacgctgaccagttgtcccagttagcctgggactgaagggtttcctgggacatgggaccttcagtactaaaactgggacagtccagggcaacaaggatcgttggtcacgctagcttcttcctctgtaaaatgagaccatcgttaccttccccacagcactgtcacaggctgcgtgagagtctgtgtgctgac

SEQ ID NO: 471971 - DNA, 687 bp, Homo sapiens
tccatagagatgaaaagtagggcaagtctcagccggatccttcctgctgccactcctgccccgccccgccccgcccctccccgccccgccccaccccaccccaccccacccagggatccaggccttggccccagcaggcatcacagcagggcagcctgaaccaagtcacagaggggaaccaaatggctgtgggtacgggatggaggaggtggtaaatcggacgtgtttagcagcattcctcccatgggcgtcgaaagtgggccagccccgcacaatggcaaacccctcgcaggagcccagcgccagtggccctcagccacctctaggaaatgccgcatccaaagagcccagtcacctttccaaggtcccccggagcagcacgctgttccgaagcacagagaactgggaagcaccctcaccctgtggctttgtggactggcatcctgtttgcaagccaggaaaggcctctgcctcacaggaaacaggggttctcaggcccccggcgaggccgcgcatcagaactggcttctggagggcagctcaacaggagctgccaccactgctccgggtgctgctgtggcctgtccagcctactttggggacttccatgggcgtggccatgtcccaagaagagtaaataaagtcgttttcagttcttgatttaaaaagtaagaaagggccaggggc

SEQ ID NO: 471972 - DNA, 493 bp, Homo sapiens
gggagatcagcaaagacagctggagtgagagacggtattggcctcggtctctgatcagaaacgcagccaatcaggccaacatgaggagggtcgcagtgtggatgctcaccaggcaaaaactcttaaatggacaagatggctgctgcttggaagaacagctgcttcctggagaagaagaacagcttcttcttctccctgctcctcctgcattgccctgggatactggggacctggagcaaagccatgaggcagggcatttttctttgatttctttgccttaccagcccctggggtcactctcttccagcttgtcatgccagcagtctttattagatacaatattcctgtggcttcagtcccatggcagatgccatattagaggctacaagggattcttgtctcaggtcctggccctcagcttggccagttctgtttcgtcttccattgaggggaaggaaattgggcatgtccattctcagacacctttgtagca

SEQ ID NO: 471973 - DNA, 729 bp, Homo sapiens
gaaactgcaacaataggattttcctttcaaagagtctagcgaaatgaaaagggggcagatggaatggaaagaaaccctaggccaaagactatggctggaagcatcctgatagccaagtcgaaaagagaaaggcgagatgcacatatctcacacagcttattgggagcaacaattgtcctctggattctcagctccaaaaagacctctactcaacatctgctcatgagcacactgagaaacagaatgggcacaaagtcacaaaccacagaccaaggagatgatggagctggcccactagaagcaggtcatcaaccccagttagccaatgatctcctcacaagcagatccgctcttccccaattgcacacaaagacctctgaaatgagtggatgtcatgaaaattgtgttaacacattattgaccatgaagatccctttcctgccagaaggagttgcccaaactggaagagaaaatgcccttgcttctctggcaggttctcttttctgtggtagttggtgaatagaaatccattatcccctgcccatctccttcgcagatgaaaggcaagtgaaaacactttaagcatattaagtagcaagtttgatttataaattattaggaagattacctcctcttgggggttttctgaagtctttaatcgtgtggaaaggctttccagttgccacgggccactaagttaattaagaggcctcaatatgtcttctgggg

SEQ ID NO: 471974 - DNA, 896 bp, Homo sapiens
tcctacctccatgcttagatgtcacaaccccctaattcaaccacatccacacatccatgtcacgggaaaatcactaataaccttaccaaccagagggaacctgctatggtttggatgtttgtcccttccaaacctcatgctgaaatttgatcctgaatgtggcaatgttgggaggtgggacctggtaggaggtgtttgggtcttggggacagatcccttatacatttcctccaggatgcagatgtccggtcctgaactttccatccaccagaaccatgagccaaatacgtctcttttctttataaactacctgctctcagagtggaaagatagcatggtggttagagccttgggcttcagaccccaatggacgtggtgggtgaggtgtatggtagctgctcagttatggagaaggcatgggcatgggtggaatagtggaaagtattgtgacatgggtgaaaaactggtgtagatgccaaagaagagaataaatgagtgcttctcggaataaaaagcattaaccgtggggtcttctagaaaccactacttcaaatttttaatttaacattttaatatttttatagaagagagaggtcataatgaaatttctttagtgtgcaatcgacactaaagtcttccacatacaggaatgtaagccaatggaaataaatttcagaactatcagagaagcttaaatgagagaattgaagaataatttctttttttaaaaaaaaataaaacttcattttttgcagcccatgtgagtgtgacctacctgcataagatttgtctgactgttccaatgattgctcaccctctaaaagccttttatgcttattgtttatgctgtctacttggcatgggggcatatgttagcttcaaaatgttatttatct

SEQ ID NO: 471975 - DNA, 665 bp, Homo sapiens
tctaacgttggcggcggtggcggtggcggcggcggcggcaccgacagtaaagcggggagcaagagaatttgaaaagagacatccgctccctctcacacgctgagggggaggcattcgctgactctctctgaccatgctcgctaaaatacatgcaatgccagtattaaccaagcaactaaagtataccaaatcccccggggggcagtctgatgacatcaggcaacagcaaagtgatgctggagtttgtgtgctttccctcctgactcacacagttgtgtctggcgccaaagtgtttgacagctgggctgcagccatggagaagacaggagcattcttgactcttacttcccctcttcaccaaaaatggagctggctttgtctcccagaatggagtgatgtgtgctgcagtgtgggcacaagaaaggaggctgacctagttcatctgcgattgattcgtacagataatgagaactatcagtattcaaaggaaggagaatttgagttgagccatgagggatgcggtgggatttgtttggatagaaagaatgagggaaagggttctagctgacagaaataataactgcagcactgttgggaagtttggaaacttcgaggcttgcttgattccttggggtttaccctgggctacctttcttttctgcatt

SEQ ID NO: 471976 - DNA, 591 bp, Homo sapiens
gaggcttagagagaaacttaagaaagttgcttaagttcacacagctattaagtggtaaaaccagagtttgaactcaggggatctgactcttaacccttatgttatgttgtgtccatgcatcctaccttgacccactcgacaccatccatttctgtcttcctcttccaaaaatgctcaatctgtttctgcagttgcctcagactgtgggctgcctctcgaagtttgatgtaagcacatgctgtcagaatctgcccatctcccctcgtcagcaccaattcggtgtgtgccagaatgacctccaacctccagcacctgtatttcatggcttgagaacattctctgactgccaaagcccagagacaggctccctggggatgaggcaaggagtgttaattccctggcagttccagactctgatcttcaaacatgataaaattccaataattaaaacagatgatactggcacacaaattggacagcagatcaatgcaatagaatagatagctcagaaataaacctttttatatattagaacttagtatatgaaaaaaagcatcagacactaattgcatggaggatggaatattttat

SEQ ID NO: 471977 - DNA, 2558 bp, Homo sapiens
acacctttcattgaatattcccacacccgctggatttttcccttaaaatttttttttactagggccaggtgttagatgcttagctcatgtttaacacctaatgcctggtgcctcgcatgcttgatgctcaggacatcgcctttgcagtctgggtcccacccacctctgcctccgccatggctgcaagaaccgttatcattgaccacgggtctggctttttgaaggctggcacggccggctggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatgtgcctgggaagtggttgcacgtgctctccatgtttgaggaaaatgaggccactgcggctcagaggagggaggtgacgtccgagtcatcctcaggtctgtcccgccagatccgctgcctcctgcacacttctgcccacttctcaccacctctcccgcagcaccgcatctccctgcagcagcatcgactccagcctcggtcagagcgctgcttttgcatctgtgtcctgtgtgagtccagagctgctctgttgctcctgcccatgctgggtttgatactgcggttccatggagcaacttgccaggacggacagccaggctcagatgggcaggttcccttcccattcacgggagctggcaaagacccaggcctagcacctgctgaaaggcccctcaagtggctggcaccaaatctttgagcggagctcaagggagccccattggcagcccagggcctggagaaacttcaaaacacaacaagaggcctagaaaactcttcagagcagagattccaaataagagagtggggaagggagggagagtagattttgctccctaggggacagttggcagtgcctggaaccatttttggttgttacaattaggggtgggggtgctactgaaatctgaatgtagcaaatctctctgcttttcagtgcagaagcccagaatttaacccccattcccgaggggcagcagcctgctcaagttctgtttgcaaagcgctttgggattcattggctggtttcagacatctcaggcccacacatgtgttcatccatccaatcatgttaccatctatctacccagacacccttccatcctaacccacccacccactcatccatctacccacccaccctcccacctatatccacctgtcattgtctgccttcccacattttcagtctactactatccatatgtctactcattcatccttccagatgatcatgttaacacccatccatgcatccatttatgtatggcctagtggagagtttgaaaaccatactctttgattatgtgaccataacgttgttggcacatgtttaataacagtctctctgggacattaataaaaacaggacctggtttgtagcatttgccagtttctgtgatgaatgctagggaggggtttagggggaatcagaggctgaatcagttcataccacagatgccttccagtgttgagctctgaggagtctaatggttatgttcaggccacctgattcttatattaaaaaaattgtagtaatgcaagagaaaacaaaaaagagcaagagtcactattcttgtatcag

SEQ ID NO: 471978 - DNA, 600 bp, Homo sapiens
tgggtgtcctggggggtgtcagttatggtccctgcctcctgtcctcctttgtcatagaccctgcatctcccacggcatataggctgcctcttcctgcttccctgagttcagatgaaacaccatgccctgtcctgttctcattcccagccttggaggtggcttgtccctgctgagcctctgccatttgtttgccaaagggctccttacatgggcagaagccgctgtttctccttctgagggaggcatctcctgtcccatgcgctttctcctgcagattctctctgcccagctctgggaaggccgtctgcccctgtcacacttcaagctgctgcgtggatccctgcgcctggtgtgggagaacttggattctgcagctgggaaacttggtatgaaatcctggtttctagatctactcaggtctatccctgtccaggaggagccagggagaggcggtggcattttccaggcaccagcctccaggtctctcctgagaacacacccacccagtgaagctgttgctggctggatcccgctacccctggaagaagacattgcaacagcctgtgcgtgctgagtcctgaagtgagggatttggcttgc

SEQ ID NO: 471979 - DNA, 554 bp, Homo sapiens
acacctgctgtttgcatggccccgtgtcagattatgtacccatgtggtcaacctcctgtgaagcaggcaagtggaaactttcatgcacacagcacaggacccacaggatggcaccgtctgcatgcccactcattcaaccagcaagtcacaggcccactctctctgcaccagtgctgctttgaacactggggacgtggctgccctcttggagctcatgacctagttaggggagacggacaatcagcaagagtgcaaataatcacaacaatttcaagtaccaacatggactgtgtgctctgcagggtgtcggcagtggccgtcttagccaccactgcatctccctcactgagaacagtgcctggcatacactagtgctcagtaaatattgatgggtggtcctgggtttgtctaatcccgccccttcggaagaactgctctatggctccccagcgatatgatcagttttgtggactgaatgtgtgtgtctcccctcctgaattcttatgttgaagtcctaacccacatatgatggcatttgaaggtggggccttttc

SEQ ID NO: 471980 - DNA, 942 bp, Homo sapiens
gacaggccatcatgtgggccaagtgcctcggacagttcaaagaggggaagaagagaaaagacccactgggtttggcaacagtggagtttccttgtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtgagggtctcctactttggggagcaggaagaccaagctctgggccgcagcgtgctttacctcactggcgtcgatatttcccttgaggttgacacaggccgcacaggcaaggtgaagaggagccaaggggacaagaaaacctggcgctggggccctgagggctatggggctatcttgctggtgaactgtgaccgggacaatcacaggtccgcagagcctgacctcacccacagctggctgatgtcgctggctgacctgcaggacatgtccccaatgctgctgagctgcaatggccccgacaagctcttcgacagccacaagcttgtcttgaacgtgcccttttctgattccaaaagatcctcaaggaggaggttcaacaacaacgagttccattttatggagaggaaaaccgaggctcagatgcaggaattcactgtggcacaaccatctggggtggagcaggcattccaacccaggtgtcttgggtgcaccaaagctcctccttttaccattgccccacacccgttccctcctctggtcaatcagcgtggactgaactgcatgccaagcactgtccaggcagggagggcgtgagaaccagtgaggctgaggcctgggccctgcctctggccccagaacctgtctttctcatcagagtttttattaa

SEQ ID NO: 471981 - DNA, 579 bp, Homo sapiens
acacataactcatgtctttcccacatcaacacaatgggacaggtactactgttacagctgccaacttacacatgaggcagctgagtcacagagaggcacgttggaaaggatgctggcaggagatagcagagaaggtggagttggctgtggagtctggaaggaaggaactagggtctagtcaggtcctccttggggccccagctcctgggcactgggctcaggacattggcttcaatcccctgggtccacctggttctaaattctgtgagcctaaccctgtgactgcccaggctctgagactcttctatgttgctggactctgtggaccccacaagggcaaagccaaggatgatttgtctctgctttcctggtgcccagcatgggacctgatgtacagtagctacccaggaaggccgactggattcaatcatgactcagccacctccccgctgggcagtcctgagaaagccactccaccatcctgagtcgctgtgtccttgtccagaacgcgttgattgtgcccctggttcatgccaggcactaagctggatgcagagatgacagcagcgatgcagacag

SEQ ID NO: 471982 - DNA, 671 bp, Homo sapiens
gttgggcgtcttttgccctatgctatgtttgtgagatttatccacttgttgcatggtgacatctctctggattgcgacctgaactgtgagggaaggcaggacaggaactttgtagacaagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgcttacactccgggagatgccctggtgggtggcgggtcgcagtaagaacagtcagaagtgggggctttggaactgatgaactggtgcccccagcacaacacctggcctgaggtcattttatttgatgaatgaccttttcaaatacattttaagcatgtgtagaaattcttatcaaaaatttcaaacatacacaaaaagcagtgctgtgaatccccatgtgcctgtcactcagattaaacaattatcactgttttgtctgtctcgctgaagttttgtaaaaccaaccccaaacaccatagatttcaccc

SEQ ID NO: 471983 - DNA, 604 bp, Homo sapiens
tcagctcagtgtggtccggcaggggtgagtaacggtaagaagctgctttgaggaggagttgagatacaaaagatgcgcagcagtcaactgacaaagcgggggtggggagagtgtttcagtggaggcagcagccatgtgttgtatccagggctaagcaaaagtgagctgggtttcactgacctggaggaggcggctgcctgcctgctacgcctgttgcggatgattgtgatgggcaagaacctggggatccccaagccttttgggccccaaatcaaggggacctgctgcctggaagaaaagatttgctgcttgctggagcccctgggcttcaagtgcaccttcatcaatgactttgactgttacctgacagagacaaagatgtgctccaacaggccccagtccccatccctccccactgtgttcccctgcaaaggtcagtggtcatttggcgccatgcttgcactactgctgtagggaaggagaggaaatgctccctgtactggccaaaggcaagaaaacaagtctggagagtgggctccattgctattgtctggtgtgaacaccagctaagctggatcctgagaccctccagcttgaccatccc

SEQ ID NO: 471984 - DNA, 1666 bp, Homo sapiens
ccagcacttcacaggaactgggattcttgaggaatagagaaatggccgagaagtgccagtgaagaaccaagaagggtacccaccttcctgtaagtccagcagtacatggcagagcctgctacgacagatggacagacagtcgaggacccagcagaggctggagggagccctttaatatgcccccaggggcctccaaggaggggctgctgcagaactgcagagtccatcgggagggctgctggggctctaacccagagcaagaggccgaggacccagggcagtgcctaaccaggggcagccacggccgcagctgcagccatctgctggcacaagacaactccagtacctttgagttggtgctggggcccgaccagcacgcctataccttggccctcctcgggaaccacttgaaggagactttctacgttgaagctatagcattcccatctgccgaattctcaggcctcatctcctactctgtgtccctggtggaggagtctcaagacccgagcttgaggtttgctgggggagagctgcagaaggcaagtggggcccagctgggggccggactgaacggccggaaccctggggtgcctctggaggtttacctgtgcagggagctgcagctgcagggttttgtggacacagtgacgaagctgagtgagaagagcaacagccaggtggcatctgtctatgaggaccccaaccgcctgggcaggtggctccaggatgagatggccttctgctacacccaggctccccacaagacaacgtccttgatcctcgacacacctcaggccgccgatctcgatgagttccccatgaagtactcactggtgtggaacttgagccctggtattggctacatgatccaggacactgaggaccataaagtggccagcatggattccattgggaacctgatggtgtccccacctgtcaaggtccaagggaaagagtacccgctgggcagagtcctcattggcagcagcttttaccccagcgcagagggccgggccatgagtaagaccctccgagacttcctctatgcccagcaggtccaagcgccggtggagctctactcagattggctaatgactggccacgtggatgagttcatgtgcttcatccccacagatgacaagaatgagggcaaaaaggtctgctttgggggcttcctgctgctcctggccagccccagtgcctgctataaactgttccgagagaaacagaaggaaggctatggcgacgctcttctgtttgatgagcttagagcagatcagctcctgtctaatggaagggaagccaaaaccatcgaccaacttctggctgatgaaagcctgaagaagcagaatgaatacgtggagaagtgcattcacctgaaccgtgacatcctgaagacggagctgggcctgggggaacaggacatcatcttttttccccagctgttctgcttgcagaagctgactaacatcccctctgaccagcagcccaagagtcctttgcgaggccatacttccctgacctgggacgccccacccagagagcaagtgtacagggcctgaaggcttggaggttccccaggcagttactatgggccaggccctgggccagggtccagggcagcagtgtctgatacatagaggtacatcagcccttaaaataa

SEQ ID NO: 471985 - DNA, 1235 bp, Homo sapiens
cgggtaacactgtcactacctccacctgcaggagacacacaccctagaactgagaccccagagcctgggcatgctgccacacattgccatcctgaccgctaccatcaactcctcccaactgccctctgcagctgaaggccacagatgcctaagcaaccggcctcagactcccctggcctgcagctctgcaggcacgaggtgtgccccccagaagtgccagtgcttcaccatccatggctctgggagggtcttgatcgatgtggccaacacggtgatttctgagaaggaggacgccaccatctggtggcccctgtctgatcccacgtacgccacagtgaagatgacatcgcccagcccttccgtggatgcggataaggtctcggtcacatactatgggcccaacgaggatgcccccgtgggcacagctgtgctgtacctcactggcattgaggtctctctagaggtagacatctaccgcaatgggcaagttgagatgtcaagtgacaaacaggctaagaaaaaatggatctggggtcccagcggttggggtgccatcctgcttgtgaattgcaaccctgctgatgtgggccagcaacttgaggacaagaaaaccaagaaagtgatcttttcagaggcaaatggattccagactaactttctccaccccacccccgacaccctcttccccagtccccatgcctgggctgatcaaaccttttgtcctgagttgtagatgtataattggagtgctggcctccagacattccttaacctttgctttgtcttttgcccagaaataacgaatctgtcccagatgactctgaatgtccaaggccccagctgtatcttaaagaaatatcggctagtcctccatacctccaaggaagagtcgaagaaggcgagagtctactggccccaaagtgagtgttcttgtgccagctccagctttgcctgctctcgacgtgccaggcaagttgtgcccacacctcctcccagcaaggtccccagcagaagcctgctggagacctagagctgcagatgagaggctgttgtggctgtacttgtgtttccaggattctctggctgccaccttccccataggctaaatctgtacacatgggtgagttattgcacctctaagccactttctccacttgtaaaatgggggtagctgtgccttccctgcaggctagaagagaagagagacatatccactgaaacagtagctattgcct

SEQ ID NO: 471986 - DNA, 4487 bp, Homo sapiens
atgcacacaggcacacgtagtgtaatgcacgccccactttcacacacagtgagactctgtctcaaaaagaagaagaagaagaaaaaggagaaggaagagggacaagaagaagaagaggaggaagaggaagaggaggaagaggaagaggaagaagaagaagaacaagaagaagaggaagaagaagaagaagaagaagaagaagaagaagaagaagaagaagaagaagaagaagaagaagaagaagaagaagaagacggaggaggaggaggagaaagaagaagaagaagaagaaaaaattttcccctgtgctgtctctctctcctgctgacttgtgaagaagatgctgacttcttcttccaccatgattgcaagtttcttgagacctccacagccatgcagaactcagcaggcatgaagaagccttctggggtgttggaaatgttctgtatcttgatctgagtggtgattacactgctgtaattatatgtaaacatacattgggctatacacttaaaatttatgtactttgtgtataggaacttcaataagcaattaaacatttttttccgtacagtgaaaacacgcccaaaccaggatagaaaccagaaaagccattgtcaggagatgggtgtcccctctcttggggtcccccaagggctagtaggtctgagatggtaccagtctcctccagaaacagaggtggcttcttccgtttcctgtggtggcttctctccgtttcctgagtgtaacacaaggttacgctcttgtgtgcctgtcttgttaagttcctttatttaagacttctctttttcccattgaaccttgccaaaagttcatccatttaattaatcttttccaagaaccaacttttggatttttgttttagtcctatttttttcaccaattcccacttttacatttatctttccttttggggggttaatttcattatttttctaaattctccagtttggcgcttagttcattcactttctgccattcttcgtccctactgtaaacattcaagactatacatttctttctaagcacaattttagttgagtccatgagttttcatatgtgacctttctactgctcagttcggaattgccattgcaatgtctcctttgatcaatgagttatttaaatgactggtttttaaaatttccagatgaatagggttttcttattatccttgctgagttctaagttaattgctttagagttagaggatgtggtctggatgatacactttatttcaattttgttgagacttgcttttgccaatacccacctaagtcagttttcatgtatgttttatgtgcttgagaaaaatgtgtcatggcccatgcagggtcacctatacgttgattggatggagctttatttgtgttcatgagatctcctattgactactaatttttttgtcagctttatcaattattgagacatgttaaaatctcccactatattagtaaatttgtccagttcttgcagttcaataaattttagcttcatatcttttgatgtcagggtattactagtttgataaaataaattgagaaatgacctctcctcttctgttttctggaaagattgtgcagaattggtgtacattctttaaacatttggtaggactctctagtgaaacaatctgggccaggagatttcttttcaggagtttttaaattactaattcatctgagtagatacccagtatcggaattgctggatcaaatggtaattctactttcagtcctttaaggaatctccacactgttttccacagtggttgtactagtttacattcccaccagcagtgtgaaagtgttcccttttcaccacatctctactaacatcttttttttttttatggccattctttcaggagtaaggtgatatcacattgtggttttgatttgcatttccctgatcattagtgatgttgagatttttttcacatgtttgttggccatttgtaaatcttcttttaagaattatctattcatgtcctcagcccatttttgatgagattgtttgtttttttcttgctaatttgtttgagttcattgtagattctggatattagtcctttgttggatgtatagattgtgaagattttctcccattctgtggattgtctgtttactctgctgattgtttcttttgctatgcagaaactttttagtttaattaaatctcacctgtatatcattgtttttgttgcatttgcttttgggttgttggtcatgaagtctttgcctaagtcagtgtctagaaaggtttttctgatgttatcttctggaatttttgtggtttcaggtcttagatttaattccctgagaaaaagatacttgtacactcatgtttatagcagcacaatttacagttgcaaaaatttggacccagcctgaatgcccatcaatccatgagtggataaagaaattgtgatatatgtaaatatatatacaccatggaatgctattcagccataaagatgaatgaaataatggcattcacagcaacctggatggaattggagaccattattctaagcgaagtaactcaggaatggaaaaccaaacatatatgttctcactcataagtgagagccaagctataaagatgcaaaggcataagaatgatacaatggactttggggacttaagggagagggtgggagtggggtgagggataaaagactacaaattgggtacagtgcatactgctaaggtgatgggtgcaccgaaatctcactaaccaccactaaagaacttatttatgtaaccaaactccacctgttcccccaaaaacctacggaaataaaaaaaataataaaatagaggaaaacatgaaaaaagtaaaattactagttcaatttctttaatagctatatggctattcaaattacttatttcatattgggtgagttttggctgtactttttgagaatgtagtccgttttatctaagttgtcaaatttatgcttgttaagttgttttaagtattccattattattgttttgatgtctgcacagtctgtcttgatattcccattttattcctgagattggtaatttgtgtcttctctctttttttctttgttgatcttgctaggcatttgtcaattgtatttatcttttcaaagaaccagattttgtttcactgatttttccctattgcttttctatttttattttcttgggtttctgctcttatcttcattattttcttccttctggctgcttttggtttcttttactcttctttttctaattacttaaggtgggagcttagagtatcaatttgaagctttttcttttttctaatgtaactgtttagtgatttagatttccttctcagaacttgctgtgttccataaatttggatatgttgtatttttattttccttgagacttcttttttgacctatgtattatttagaagtgtgctgtttagtttttaagtatttggaaattttcctgtcactgatttttattttaattccattggggtcagagatcaccctctacaatgtcaattcttttaaattttttgagatttgttatatgaccaaggatgtggtcaattttggtttatgtcccacaggtttttgaaaaagaatgtgtgttctacttgggttggatgagctgatacaaaatgttgagtagatactgttggttgacagtgtttgttgagttctgtaactttgctggtttctgtctaattgttctatcaattgttgaaagagtattaaagccttcaactataattgtaaatgtgtttatttctcttctcagttttatcggtttttacttcatatattttgtagccccattgtttggtgcatacacatttaagatttctgtattttcttggtgaattgactcttatcatatgtaatggctctctctatccctggtaatttatttgctctaaagtctatgttatctgatattaatacagccactcctgctgtttttcaattaatgttgacatggtatatctttttccatccttttgtgttaaacttacttatatcattatgtttgaagtgagtttctcgtagacagcatatagttagtgtggtaatatttatccactttaccaatttccatcttctaattagtttatatagaccatttacatttaaggtaatcatttgtatgttagagcttagacctgccattttgctttgtttctctgttttctttttcctaccttcttgtgggttactggaactattttttataatattttaatcatctatagtgttttttagtgtatctctttgtatactttttttagtggtttctctaggtattacattatatatacataactgaacataatctactggtattatcatcttaacagtttgagtgaagtatggaaaacttgtctctctttacattgttttttccccatttataattgtcttaaatattttatctacatacattcaaaatcacatcagacggtgttac

SEQ ID NO: 471987 - DNA, 694 bp, Homo sapiens
ttatgaggattagaagtcaagtgcttgtatcatgcttgtaacatagtgagccctaacgaatgagagctatcatctccactgtcttcattgtccccctcatccccaccatgatcctcaccatccccaacaccatccccaccatcctcccttccatctccatcatccctaccaccatccccaacatccccaccatcatccccattacaatccccaccactatttccaccattcccaccacagtcaccatcacccccaccatctccatcatcatccccaccattcccaccatccttaccatcaacatcaccatccccaccatccccaacaccattcccaccatccctaccatcaccatcaccatccccaccaacatccccaccacccaccatgcccaccaccatccccaccatcagtttgcctacttgcctcctccagactgtgaacccctacggcatggctgtgctttggcaatctctgatctcagtgggatgctcagaatcaggcatgtagtaggtgcttagtacaattttcttgggcaaatgaaggaagcagggccctggcttgggggctggattatgattgcttctctgactggtctctctgctttctacccttgcctccctctaatctgtggtcagcaaagcagccagagggattctgccaagttatgcctctcctttgctcaaacccttcc

SEQ ID NO: 471988 - DNA, 626 bp, Homo sapiens
ccaagctcacagcctctagttttcagatgattccatggagatgtgcctgcatccccttcgaagacatgcctgcttcccatttgccttccatcaagatgaagaagacaggaagatgagagaaaatttggaacttcctagagacttgttgaattgttgtgaccaaagtgttgatggtgttatggacaatgaagaccactctgagaaggtctcaggtggaaatgaggaacttattgggaactggagtaaaggtcactcttgctatgctttagcaaataacctggctgcattgtgcccctgctttagggatctgtggaacttcgaacttgagagtgatgatttagggtatctggtggaagaaattcctaagcatcagtgttcaggatgtgacctggctgcttctaaattcctatgtgcatatgtgtgagcaaataaatgacctgaaactggaacttatattttaaagggaagcagagtgtaaaagtttggaaaatttgcaacctggccatgtggtaggaaagaaaagcctattttcaggggagcaattcaagctggctgcagaaatgtgcataactaaaaggaaaaagagacttggattttggactttcaagttaatgctaaaataagct

SEQ ID NO: 471989 - DNA, 494 bp, Homo sapiens
atggaagatggagctccaggaacgggtgcccccagacaagagggaatgtactaccccaaaatatggtgctttggatattgaatatttgaaactgaaagaatttgagaaacggcgggtgcaggaaggactctccgagctttcctctgaagcagatcacaagaccttcagtcccgatgctagctttggtgtgaaccaaaccagaacacgtcaagtgtttagcacagcaccaggcaaacaggattcgtcctggatgggcacctccctgccaggtgcacacttcccttcttcctgggctgaggctcaacagctcattcagttggttctgcatttgcccatggatgccctgatctggtgcaaccagccagggctctggagccagcatgcctcctgaggtctttagctcatgttggctgagcacctctcctgtgtcaggccctgggctaagtattttctgtgttaccgaatttcattcccacaacaacccgttgaggggc

SEQ ID NO: 471990 - DNA, 1537 bp, Homo sapiens
gggggtggtcgcgatggtggaggccggctggagcgtcgctggattttctctgagacaagcccacccgtccagcaaaatagagtccctcagggtgacagttgacttcctgaaggtgcctcttggcctaaagaagccggtgctgaaggaggtggctgtggggccccccaagaggccccagcctgcggccctggagcgctacaaggcgcggcgttcagacgccatggacaccgagtcccagtactcgggctattcctacaagtcgggccactcccgcagctcccgcaagcacagggaccgccgggaccgacaccgctctaagagtcgagatgggggccgaggggacaagtcggtgacaatccaggctcccggggagcccctgctggacaatgagtccacacgaggggatgagcgggatgacaactggggggaaacgacgacagtagtaacgggcacctcagagcacagcatctcccatgatgacctcacacgcatcgccaaggacatggaggacagtgtccctctggactgctcccgtcacctgggtgtggcagcgggggccaccctggcactgctgtctttcctcacgcctctggccttcctgctgctgcccccactgctgtggcgggaggagctggagccttgcgggacggcctgcgagggcctcttcatctctgtcgccttcaagctgctcatcctgctactgggcagctgggctctgttcttccgccggcccaaggcctcgctgccccgcgtctttgtgctgcgtgccctgcttatggtgctggttttcctgctcgtggtctcctactggctcttctatggtgtgcgcatcctggatgctcgggagcgcagctaccagggcgtggtgcagttcgccgtgtcgctggtggacgcccttcttttcgtgcactacctggccgtggtcctgctggagctgcgccagctccagcctcagttcacgctcaaggtcgtgcgctccaccgacggcgccagccgcttctacaacgttggccatctcagcatccagcgcgtggcagtgtggatcctggagaagtattaccatgacttccctgtctacaaccctgccctcctcaacctgcccaagtccgtcctggccaagaaagtgtctggcttcaaggtgtattccctcggagaggaaaacagcaccaacaactccactggccagtctcgggctgtgattgcagcggcagctcggaggcgggacaacagtcacaatgagtactactatgaggaggctgagcatgagcgaagggtgcgcaagaggagggccagctggagataatgctgattttaaagagctcatgtgatgagatcaggccctaaaggacagtcttcttttaaggccactgacttggcacattaattacatctgcaaaatgtaccaagattgttgtctaatgaggggatgggagtctggtagaagtggagggtatctttgaattctgcctgccacagtggggtagggacccaataaagggatggtcatccaatctcctgtactgccaccaccattttt

SEQ ID NO: 471991 - DNA, 1457 bp, Homo sapiens
ctggctgcaaaaatttgcataagtaacaaggaaccaaatgttaatcccaaagacaatggaaaaatgtctctaggccatgtcagagaccttcacagcggcacctcccattacagccccagaggcccgggaggaatacgtggttttgtgggctgggcccaggatccccatgctgtgtgcagcctagggacttggtgccctgtgtcccagccactccagccatggctgaaaggggccaacatagggctcatgctgtggcttcagagggtggaagccccaagccttggcagcttccatgtggtgttgagtctgctggtgtgcagaagtcaagaattgaggtttggtaacctcatttcagatgtatccaaatgcctggatgcccaggcaaaagtttgctgtacgggcggggccctcatggagaacctctgctagggcagtgcagaagggaaatgtgggatcggagcacccatcggagctccatctagtggagctgtgagaagagggccaccatcttccagaccccagaatggtagatccaccaacagcttgcagtgtgtgcctggaaaagcagcactcaatgccagcccatgaaagcagcccagagtggggctataccctgcaaagccacaggccggagctgcccaagactatgggaatctacctcttgcatcagcatgacctggatgtgagacatggagtcaaaggagatgattttggagctttaaaatttgactgccccatctggatttcggacttgcatgggccctgtaacccttttgttttggccaatttctcccatttggaatggctgtatttacccaatacctgtaccgccatgtagctaggaaataactagcttgctttttgattttacaggctcataggcagaaaggacttgccttgtctcagatgagactttggactgtggactttcgtgttaatgctgaactgagttaagactttgggggactgttgggaaggcatgattggttttgaaatacgaggacatgagatttggaggggccagggttggaatgatatggtttggctgtgtccccaccccaatctcaacttgaattgtactcccataattcctacatgctgtgggaaggatcaggtgggaggtcttggtttatttatcttcataaattttgtttgatagctataggaatgtagaggatttgtttttatatcatcatcatcatcatcatcatttcaagcccttgctctaggtcaggcatcatgctaagtgccttccctatagcaccccattgaatcatcacaaagatcatctgggggtcaactcccaaataagctcacttgtagccaaatccttaacacaggtcttgttttagtggaaatccaacccagttgacaactgtgtacagttgttgagccagtaatcaatgggtcttattgtgataaagtctagctcatctttccctttcttgtgcatttat

SEQ ID NO: 471992 - DNA, 540 bp, Homo sapiens
ccagtaccacccagttggaccatggggccagtcctaggagccagaactgaggtcaggccccagggcaccatgagggtgcctgaggcatcagaggcccccagccaagggtctgagtcatcctatgacctgcgctgctccactttcctcattccagaaggtcctgtgttggtgtctctaaccgtggagaggtactggctacgctgggcaatattatcgggacctggggcagcatttgatgtctgcagcaaggcacatcaagatttgtcccggcgtgtctcccttcgtccctcggagcctgacagcactggctacatagtcattggggtgggctggcacttgtgcctgctggtgaggctgactgtggctgctgtgctcccaggcgtcatgtatggcctatgcttcttcatcaccctgtttggcagctatgtcagccggctgcggcgagtcatctgtgcctcctactacccatcccgggagcaggggtgttgagggggtgggggatgagggacgggggagagttggagagtggagcaggcagca

SEQ ID NO: 471993 - DNA, 1506 bp, Homo sapiens
gtaggtctaggttggagcctgagattttgcattttaagaagttctcagaagatgctgatgcagctgcaggagctgccgtcacatgacgtctatcctccagagaacgatttgtcttcattggggttggttgctgctgctgttgctgctgctaccttcgccagctacttggctccgtggcagctcgaccctgtgcctcctccatttgacaggactctttatgttggatatgacagaaaattcatctccaaatggttgcaatataaagcaaagttactggttcagagcttggtctttctggtgaccagctccaattttggagctatccaggagcccagcaagagtcacctcattataacaagaagtgggtcctatcatccaggaaatcccatgggatttaggagctctgtgccaggaacaagggacaaagacccaaaatatatttcttattatgccacataatgtccccatttctctcctctcccctctgcctttggtggtcttcatcctcatgttccacatggtggccctctgtcaactcctccctctcccctcatcaaacaaaagggttgcagcagctcctgatcaagcagcacctcaccctcctggggtagagggtcttttctggttgctctggctcaagccctgggctctggggttcacttgctcccattggcctgatttgggccctgtgcccatccgttggctagggtgatgaggtactctgattgtcttaagcctgccatggcccaccagaggtctggaagttgtattaaccccacccaagtgcatagttgggatgggagaagggcaaattcactaaagaaaactctgcatgctgttggcagagaattggggaatgggtgctctagagatagtgaataaatgtcctctacagttttctcacatcttatttccaagtacagaactgagaatgtcagttcctcttattgatgatctgaccatactcgtcgagcattttctcaattaaactgccaccaaacagggtcctatgttcccaaatttgtgaatcaagtaaacattgcattgttattattgaaaaaagtctgtaggaaatcctaagggtaaatttgttaagattcccaaattctgaagtttaggatgagttatgtatctaccttctcattccaagaggtgggaggtgaggagggtgttctaagaaagggcaattgaatcacagcttacaggcacttacagaagacctgacatttcccttgatgagtgactgggatgtgggtgccccattactgtatgcattctttcttgagaagtacttgattgcttttaagtgataccccagtgtttgaaagtaggaagcagaagaggtttggaaaagcgttttacctaggtgaagaggaaatcgccctcaggtattgcatgcgtgttttccacctttggttttccgggggggaggaatgcattttaagagaggctattaagtgtgacttgttctcagaaaaaataaagtgtaaatttcaaattcatgct

SEQ ID NO: 471994 - DNA, 599 bp, Homo sapiens
cagatgtcagtacttcatggctgaatgagattccagtcactgaccagctcggaccgcaatctcagagccagggcggggcggggatctgctactggccacctggggtccagggaggggctggctcagggggctgtggcctcaactgccagccggccctgctcgtccctcactgccctccctgtgggagagacatccatccaggcccacgagacactggccgccttcttccctgctaggaatccatggctgctccggtctgggccctcccttgggctgctgctcaggtgcctgttctgcatttgggaaactggtctagacatccagggactctcaggaaagaagtgtggacagaaggcctacacttaccagttggcattcctggtggccagccgggcaagtaaggggcaagtaatgtgtcctgggtcaaagtgcccaaactctcagtcaggctaaactcactcaccctcttacctgcttatgtattcaacacacaatttgggtgcagcgtgaagtgcagtgttttgtgtgtgtgtgtgttttccaatttataccataagctcctgtcaccaaggagcttatggtgtcaattaaaatcaggg

SEQ ID NO: 471995 - DNA, 483 bp, Homo sapiens
cagagggatggaggatgtactgcaggaagtcaggaagtcctccctgccatttggaggtccatttgtcagccacttttggctgcatcaggcctactgcctgggctgtgggcagccccaggatgagggagacatggagaacactgtgtcctgcagtacccccggctgccaaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccaggtgagcaggaagcaggagttggcacctgggaattgttggaaagtgatatgctcatatttgtcttttaagaccataagc

SEQ ID NO: 471996 - DNA, 662 bp, Homo sapiens
accatggggccagtcctaggagccagaactgaggtcaggccccagggcaccatgagggtgcctgaggcatcagaggcccccagccaagggtctgagtcatcctatgacctgcgctgctccactttcctcattccagaaggtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggggtgggctggcacttgtgcctgctggtgaggctgactgtggctgctgtgctcccaggcgtcatgtatggcctatgcttcttcatcaccctgtttggcagctatgtcagccggctgcggcgagtcatctgtgcctcctactacccatcccgggagcagcagccccagcccgctctcctctggttgaactccaaagcaaatgacctggactgcaagcctctggacccaagatggggctgggagaaatggtgcctctggggtggggcttcctgagacagcatttacatccaaagttttgttaaaatcacaggggtgttgagggggtgggggatgagggacgggggagagttggagag

SEQ ID NO: 471997 - DNA, 896 bp, Homo sapiens
ggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcaccccctcggcctgtttctgatctccccgcctgctcccaagccttctcctcttcccatcctcagtcctggtgactgcctgaatgtccccatgtcactgttactcagcagcccacaagtgtgccactctttcaactct

SEQ ID NO: 471998 - DNA, 1640 bp, Homo sapiens
taagtgttgcttagtttttcagtctgagaaagagcgacagtgaggcagcgggaaagaaatatatcctttatttgttttaattttccatggaaatgaccaagcttttcagctatattgtcattaaaaatgtttattaccctcaagtcagctttggaatctcagcaaacaccttcctccttcttttccacatcttcacttttgcttatactcacaggcttaagcccattgacatgaccattagtcacttgcccctaatccacatactgctactcttcactcaggcgatactggtgtcctccgacttatttgaatcatggaatattcagaacaatgatctaaagtgtaagatcatcacatttttaaacagggtgatgaggggagtctccatctgcaccacttgcctcctaagcgtgctccaggccatcaccatcagccccagcacctccttcttggaaaagtttaaacatatttctgcaaatcacaccttaggcttcatcctcttctcatgggtcctcaacatgttcattactaataaccttttgcttttcattgtgcctaccccgaataggattggggccagtcttttgtttgtcactgagcactgttatgttttgcccatgagctacacccacaggagcctgtttttcatactaatggttttgagggatgtcatcttcataggactcatggtcctctcaagtggctatgggtgattattttgtacaaacaaaagagactgtcccagcacctacatagcaccagcgtctccccaagagcctccccagcaaaaagggcctcccagaccatcctattgttggtgagctgttttgtcttcatatattgggtggacttcatattctcattttcagtggttgtgacatggataaacgaccctctactgtggctgtactgacttacattgccaccaacagtatataagttttcttttctccacattcttgccaacgtctcttgtgttttccttttaataacagtcattctaactggggtaagatgatatctcattctggttttgacttatatttcccttgtgactggtaatgttgagcattaaaaaaaaaaaacctgttagccatttgcatttcttcttttgagaaatgtctatgtatgtcctttgcacactttttaatgtgattgctttttactatttgagtatattttggatgttagttctttatcagatgaatagtttgcaaatattttcttccattcaacaagttgtttctttgctccattgattgtttcctttgccatgtagaagtttttttatttaataatattttcccatttgtctgcttttgtttttgttttcattttcattgtgtgtgtttttgatgtcttagccataaaatatttgcctaatgttctgaagtgttttctgtgtgtttttatctaatagttttatagtttcaggtcttatgtataagttcataattcatcttcagtttatttttgtatatggtgagaaataggggtccagtttcatacttttgcatgtagatatccagttttcccagcaccattcattgaaaataatgtccaacacccagtgtatgttcttggagcctttgtggaaaaccagttggctgtaaatacatggatttatttctctgttctat

SEQ ID NO: 471999 - DNA, 907 bp, Homo sapiens
tgagcctgggtcctcccctcctggctgacaggagcctggtgggcagtgggctgtctcagagggctgctgtcgagcacatggcagagttgcatcctcgaggcaaggatcagttggcaaagctgaaaatactgactcctggctctttagggaaacagtttccagtgcctggttaaagggctgtgtggcaggaccccaggatcttggtcagattgttcctcactcagggcctgctgtggccttcgctgctatgtctgcaaagtctgggtgctatggtgactctcatgggggcgttgagctctgtcatgctagatttcagggtgtctgcctcatggtcatctgtctcaccaacagagaccctgtggccagattcaaactagcaggaacagttggtctttggcagcagggataccttagagctgagctgccactcacccagaggtggtcccatgccacccactgtctgggtcaaggttggggcagggctggtgtcctgaactgcattctgatggggccccagtggctgctggtgctgaatgccttgcaagagaacgctgaggccaacagccgctggcagcggctcacccaggttatgtgtactgtgcccttctgtgtgcgagtgacaggtgagtgcctgcaggggtcacctgtgtgcccctgtgtggccctcctgtgtggagggggccagaggttaaatttccctgagcagctgtgtggtccaggagcagccaaggggtctctggaggtgtggctgccacaaccctaccctgaaggtcttgcttgtcattggtagagaggagaggacccccaggaggtgctgcctgaggggctccattcccgcttgtgaggggcgcctagggtcctcctggggcgagtcagagcctgagcccttggggtgaaagtcccttcc

SEQ ID NO: 472000 - DNA, 1051 bp, Homo sapiens
catcaattgggaaaccttaatgttttcttccgccatctgtgacagcttcttgatctgtccccagttgggtggctgtgttcaacaggtgttgctcgtgacaggtggggtcctcctcagcatcagtctcgacatggctgcaaccaggggggtcctcgggatcatcccggaatctcttcctctgcatctggctcatgataaagtttcaggtggaacatgtgtgacatccatttgccaaagagagttaggttccaatcctcgaggattaactcctcatgtaaaagatgaggaatgtgccatttggcaagttgggcatctctggataatagctttagcttctttccaggggatagtaaagaaacagtcttttaaatctatgactattaaaggccaattttttggaattatagcaggagaaggcaattctggctgtaatgctcccataggttgtataactgaattgatggctcttaaatcagttaacattctccatttacctgattttttcttaattacgaaaactggagaattccaaggggaaaatgttggagctatgtgcccatttttgaattgttcagtaactaatttctctaaagcctccagtttctcttagcggccattgttctgtccaaattggcttatctgttaaccattttaaaggtataggttctggaggcttaacaatggctgccatcaaaaatgacatcccaatctttggcgggaactttttaaaccttgcaaatttttttctagtcctgtaccagggacataccccatttcatgcatcatatgttgactttgagggctatataattgttctggaattataatttgtgctccccattgttgtaataaatctcttctgcataaacttataggtacagaagttataattggttgaatagtcccaggttttccatcgggcccttcacaatgcaaaatatagctactttgatatacttcaggggctttaccaactccaactatgttaaattgagcaggttgaattggccacgcggatggccagtgctgtagagaaatgattgaaatgtcc

SEQ ID NO: 472001 - DNA, 859 bp, Homo sapiens
caccttcttaatcatagctgaaagtcccacctctttactaggtagagacatttcagctcgcatggggatcaacatcctcatagccccaggacaaacacttttctccccctggtggaagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaagcccgctcttgctcgtgtgttttgtactaatatttggaccttgtatac

SEQ ID NO: 472002 - DNA, 638 bp, Homo sapiens
gcctggagcagcttgtcacagaagatagagaggaaacagtcaaagacaaatttgatttgatagagtcgtaaaatggtctcaggagccagggtgaagaggctcccgctggccagagatgtgaaaatggatggactagggcagggttcaaaggcccaggagaaagtcaaggaggctcccaggaccttgctccagagaaaccaagaggccatcaggcagagcgacggggtctgggtcaccaggaaccaggtgaagacaaatgaggaaactgagacccagaagagcaagttcttggtcataaagcccagtgatatcgcagaggggcaggagagtgctctcaactctgcaggaagttcatggctccactgctgctcggggtgtgtgaatcgggagagaaaagacttggaaacccatgtacacctgcccgatgcagaaaggacgagggtgcccttcttctacacacagattgcagatggcctattgtgggaccttgtgatcatgtgagttaatactacttaataaacttcccttcatatatatatatatatatattcccttcatatatatatatatatgttcccttcatatatatatattcccttcatatatatagatatcatatgtgtatgtatatatatata

SEQ ID NO: 472003 - DNA, 977 bp, Homo sapiens
aatagcagacaaggaggaaatgagtttgaagggtctgaacacatccgagagactggcagccgactctggaacccagattgttgcttcccggtctagtgatccttcctccatagtctggctggctttggcccaatgccaggcctatgtcctgactgatcaagcccaaagctaccaggctattgctgacaaaacagctgtctgggtggcctggtacaagtataagaacaggcaagccaaggtggataggcagaaggtacagaggcggccacgggccatagagtgggggcggaatggacagatggtctggagagacgctgtagaagactttacccagcaggaaataacagacattttacaaacctttcgacaaaagggaggggaaagtgtaattacttggttggttcgaattaatgaacagggtgccaatggcattagagtggactcagggaatgttttaaagtttgttaccctctcatgggtacccaaaattcagctggctcttcgaaattgggctactgcaccccaccctactaatgatgagggaaatgttttagatgaaatatctttgtggcaattggccatcaatgtggccagacagaaatattccacagaggatgcctggccagatgggggaaagccctggcatacacttaaggagtatgctatgcggttaaaggaggaggccatggaaacagctgtgtcctacaatccgcaataagattttaaagattgctccacctgcttatagaatggtgttaacatctttattattttcccatacagatactcccacacgggaggtactggaacaactaggtcagctacaggacttgggggatcggatgccctgtggggaggagaggattaaggagtggggcagacaaacccgggaccaatctcaggttagtcagaaggatatgtttgcagatttattgaaggcaggggttcccagagaacaaattgatggcaaggaagct

SEQ ID NO: 472004 - DNA, 668 bp, Homo sapiens
ctccttgctttgttaccctgggaagggctccaaactcaatgaaatcctcctgccacgataacaacaacaatgaccaggaatgtgcggaaacatataatcacggcagaaggtgaaggagaagcaagtatgtcttcacatggctgcaggagagagagggagagcaaagtgggaggtgctacacgctttcaaacaaccagatctcatgagaactctatcatgagacaggacatgggggatggtgataaaccgttagaaaccaccctcatgatccgatcacctccaccaccaggccccacctctgacaccggaaattataattcaacacaagatttgggtggggacacagagccaaaccatatcaaactctgtgagaaaatttcaaactgccatcttagggatattccgaaaaataatggaaaatgtctgcagcccatagccaatgactcactgacacatagagacccaagattttccacatagacaattatataatctaaataaatagttttacttcttcctttccaatttgatgcctttttattccttttccttgtcttattgcactgtctaggacttcaagtacagtgttaaataaaaatgatgctgtttatcaagttgaggaagtttccttttattcttagtttcatagctttgattttttaacttca

SEQ ID NO: 472005 - DNA, 1165 bp, Homo sapiens
ttctcacagcttggctgaggggacacaggaggaagatgcgtggtggagagaaggaggaggtaatgggtcctgtctctcctgatcttcacaaggaggaggtaataggtcctgtctctcctgatcttcacaaggaggaggtaatgggtcctgtctctcctgatcttcacaaggaggaggtaatgggtcctgtctctcctgatcttcacaaggaggaggtaatgggtcctgtctctcttgatcttcacaaggaggaggtaatgggtcctgtctctcctgatcttcacaaggaggtaatgggacctgtctctcctgatcttcacaaggaggaggtaatgggtcctgtctctcctgatcttcacgaggaggtaatgggtcctgtctctcctgatcttcacaaggaggaggtaatgggtcctgtctctcctgatcttcacaaggaggaggtaatgggtcctgtctctcctgatcttcacaaggaggaggtaatgggtcctgtctctcctgatcttcacaaggaggaggtaatgggtcctgtctctcctgatcttcacaaggaggaggtaatgggtcctgtctctcttgatcttcacaaggaggaggtaatgggtcctgtctctcctgatcttcacaaggaggtaatgggacctgtctctcctgatcttcacaaggaggaggtaatgggtcctgtctctcctgatcttcacgaggaggtaatgggtcctgtctctcctgatcttcacaaggaggaggtaatgggtcctgtctctcctgatcttcacaaggaggaggtaatgggtcctgtctctcctgatcttcacaaggaggaggtaatgggtcctgtctctcctgatcttcacaagtgaaccgagtttaccacaggaactgtgagcagttggggcctactgctctggggagagcgcctctcaccagtgtggcccttatctgtttgcaagagccgcctccttcctgggccccagccacctgtggttgactgaagctctcaaatgaagtttgacccaaccacacaacacccaacctgaacaccacaataggtcttggattttccagggcagtcctgattttgaatctttatctcactgtctaaaaatggtatgttccagttcagggcccaaaaacctgatcagctgcacactgggagtcctag

SEQ ID NO: 472006 - DNA, 2065 bp, Homo sapiens
tgagagaaactggatatttcagttgaaggtgctgacttctctcgctgctttcattcctctttgctcaaatctcatgttcagccccatcaccatcaccatagaatttcatgatcctaccaaccatggggatgaaaatacatggtatccagagaaaaatcctgataaattaacaaaaattattcaaaagctttttgtgtttgcctttacttgggcatttggaggagctttaaaccgtgaagatgaacacagagaaaatataccattttgtcccagtcttgaacctgattctcttgcaaaagtaacatacgattttgacaaacttgttcatgaattatttggaaacagttcacaagtaggtgctacgaaaacctataatgccagtaaggcagaagataaagccataaaactatcaattcagcctacgtggggtcaagttcatcaatatcactgtcttccacctccatatattgtcccactggaagttcttcagggcaataatacacacagagctgtcatctcctaggacaacaatgccttcttctggaataccacatgaaggacctgcctgaagctgttttacagttaattttatatataaatagaaggagtgcactctaaaataatgataaaaagtatattgtaaatacataaaccactccattataatcttatggtaacatcattatatatccagtccatgattgttaaaacatcattgtgtggcacattactgtatttgttaaaagttctatttaagacatctggatggcaaagattctatgttatttcctgtggaaattaacctttaatccaaaagcattgcgtgttaatttgttgttgaaatgaatgattcaactccatcctctaactcctatagataaataaattgccttaatttatttgttaggcagaaatacctagaactgtgtttgctcttcctgtaaactaaaaggcaagttaataaattattcattatatttgaatgcttatcttaaaacaatgaatatgaaattttgctttgtcatctgaaatatcagtataaaactaggttagaataggagggtaaaaagggaaggaaaggcaagtagaagcaattatagaactataaaaccaccaaagtagaaatgaggaaaaagaaaaaaagggggagagccaaaaaaaattataattacattgcaagaaaaaattgtaaaacacataaagaaaacctaatctgttaaggaaatataccaccaaaatggcccatcatatgaattcatctcagggaaaattattatgacctaacacagatttgaatgtaagtgtttagggtcctaaaaagataaatgaatggcatccatttttaataaatgatgaattacggaacaacatgtagaaattttaaaagaacatatagctatgaaaaagaatgaaatagacatctggaaatgaaaaattttgttatttacaaagaggagctggtactaagacaaagaaagtcttatcagcttaaggagtttttgggctgagacgatggggttttctaaatatacaatcatgtcatctgcaaacaggacaatttgacatcttctcttcctatcttcataccctttatttctttctcctgcctgattgccctggccagaatttccaatattatgttaaataggagtggtgaagagggcattcttgcattgtgccggttttcaaagggaatgtttccagcttttgcccagtcagtatgatattggctatgggtttgtcataaatagctcttattattttgagatgtgttcaatcaatacctagtttattgagtgttttttaacatgaaagagtgttgaatttatcgaaggccttttctgcatctattgagataatcatatgttttttgttactggttctgtttatgtgatggattacgtttattgattattgatttgtgtatggtgaaccagccttgcatcccagggatgaagccaacttgattgtcatgggtaagatttttaatgtgctgctggattcattttgccagtattttattgaggatttttcatcgatgttcatcagggatattggcctgaaa

SEQ ID NO: 472007 - DNA, 1439 bp, Homo sapiens
cagggaaagcttccctgacctgcagtggtggttccaagcagggccggcacagaaagttgacggagtcctactaagggtgtgagatctctgagcaagctgcaatgagcaaacacgcagatggcagaggaaaggagcagaagcaccgcatgggcaagacactgacctcttgcatgtcccccagtgctggccccaagcagtattgctgcaggagctcagagaagccctactgcgagtttgagatctataagcaggctgcagagagcaaacatgcagatggtagaggcgaggagagaaggagccccatagggccctactgtgggtctgagatctacgagcaggcagcagccagtgaggactcaggcagtagtgacgatgagcagaagcgcaccacgggtaacaggctgaccccttgtgtcttatgccagccccaagcagcacaagcacaggaagttggcagagccctaccatgggtcagatctaccagcaggcagaaacaaagaatggtgcagatggcagtggaaaggagcaaaggcacaccaaagagtgccagccccaaccaggctgacccaagacttcggcgggaacactactgtgaggctgcattctccaagcagcctgcaggaggcatacaagcagatggcagaggagaggagtggaggcgccccatgggtcacaggctaacctcttgcatgtcccggggttccagctccaagcaatgtcagtgcaggagatcgacagaattctactgtgggtctgagatctccgagcaggctgcagagagcaaacatgcagatggtggaagagaggaacagagctgctctatgggtaacaggctggcctcttgtatgtcccaaagtgccagccccgagtggggttggcacaggaggttggtgggggactactgcaaatctgagatcaaggagcagccagcagcaagcaagggcacaggcagcagcagagaggagcaaagatgccccatgggtaacactctgatttcttgcatgtcccctagtgccagccccaaacaggacaggcataggaagtcggtggagccctactgtgagtttcagatccatgagcggtgctggtacaagaggttggcggagctctactgggggtctgagatttatgaggaacaggaggcaatgatcaaagtggagccctattatgagtttgagatctatgagcatgcagcattgaacaaaggcacaggcagtggtggagaggagtggaggtgccccattggtaacatgctgaactcttgcatcttccccaatgccagccctgtgtggggctgctgcacagggctggtggagcccgattgtagggctgagatctatgagcaggtggcagcaagcaaaaatgcaggcagtggcagagaagagtggaagctggtctggcacaggagatcagtggagccctacccacaggtctgagat

SEQ ID NO: 472008 - DNA, 1980 bp, Homo sapiens
tcttccacaatggttgaactaatttgcactcccaccaacagtgtaaaagtgttcctatttctccacatcctctccagcatctgttgtttcctgaccttttaacgatcaccattctaactgctataagatggtatctcattgtggttttgatttgcatttctctgatggccagtgatgatgagattttttttcatgtgtcttttggctgcataaatgtcttcttttgagaagtgtccatatcctttgcccactttttgatggggattttttcttgtaaatttgtttaagtttttgtagattctggatgttagccctttgtcagatggatagattgcaaaaattttctcccattctgtaggttgcctgttctctctgatgatagtttcttttgctgtgcagaagctctttagtttaatcagatcccatttgtcaattttggcttttttttgccattgcttttggtgttttatcatgaagtctttgcccatgcctatgctgaatggtattgcccaggttttcttctagggtttttatggttttaggtcttatgtttaggtctttaatccaccttgagttaagttttgtataaggtgtaagaaagggatccagtttcagttttctgcatatggctagccagttttcccaacaccatttattaaatagggaatcttttccccattgctggtttttgtcaggtttgtcaaagatcagatgattgtagatgtgtggcattatttctgaggtctctgttctgttcctttggtctatatctctgttttggtaccagtaccatgctgttttggttactgtagccttgtagtattgtttgaagtcaggtagcatgatgcctccagcttcaatctttttgcctaggattgtcttggctacatgggctctttttggttccatatgaaatttaaagtagttttttctaattctgtgaagaatgtcaatggtatcttgatggggataacattgaatccataaattacttggggcagtatagcaattttcatgatatttattcttcctatccatgagcgtggaatgtttttctatttgtgtcctcccttatttccttgagcagtggtttgtcgttctccttgaagaggtccttcacatcccttttctgctctgatcttagttatttcttgtcttctgctaacttttgaattcatttgctattgattctctagttcttttaattgtgatgttaggagatgccctgcccagagaggaggaatctagagaggcagtctgtctacagcagctttgccgagctgcagtgggctctgcccagttcaaacttccctgcggctttgtttacactgtgatgggaaaactgcctactcaagcctcagtaatggcagacgcccctccccccaccaagctccagcatcccaggtcaacttcagactgctgtgctggcaatgagaatttcaagccagtggatcttagcttgctgggctctgtggcgggggtggggggatctgctgagctagaccacttggctccctggcttcagccccctttccaggggagtgaacagctctgtctcgctggcattccagctcacattcaggttccagtccggtatatccacatgatgactgaacactaccactctgctatctcacagggacattaaacctaattcatctacaatgaactccttctcttctgatccagctttccctccagcatcacctatctctctacatctggaaacaccattcctgttttcctccatcatgtgctaagctttctgaatggcttgaagcttcatgaaaaggcctgtgtcttatccagtgcccatagtacacaggtttcttttcaagtgcacagcaaaagtgttctctcctaaactctagctggttgctaacaaatcatgtattgacctaagtgttcttctcctccagcccaagcagttgatctttttctataggcttgctgttgaaaggaataaaacccaactgtatt

SEQ ID NO: 472009 - DNA, 951 bp, Homo sapiens
gccctgtcgctgcgctcctgctcctcctcgcgtttctcctgccgccctagtccagcagtggccatgagggagatcgtggcagtgcgggtaaccatatcggtgccaaggttggtggccggggctctgagggcccagcgcgggcctgccgggtggcccgagaagatgttggcagcggctggggctttctgggaggtgatctctgatgaacatgccatcgactctgctggcacctgccacggggacagggacctgcagctggagcgcatcaacatgtactacaacgaggccagcggtggcaggtacgtgccccgccctgtgcttgtggatgtggagccgggcaccatcggctctgtgtgctcagcgccattcgggaggatcttcaggccggacgacttcatcttcggtgagctgcgggccttcctgcactggtacacaggcgagggcatggacgtgatggagttcaccgaggccaagagcaacatgaacgacctgctgtctgagtatcagcagtaccaggacgccacagccgaggaggaggaggcctctcagggagcctggacttcaaggcctgcctcactgaagctgtcaaataagatggatgtgagctgggtgctcgggagcacacccaggacagtgctcttctacctggctcttgtagaactcatccatggcctgtatgataccctcttggtaactcacaccctcacacaagtggattgggaggatgaagccagcatagcctggggttgggcatatgtttaggtcctaccccagatccccttggccttcccctaggcctacccacctgcctcagatgcgtcagggaaggcagtgaggcagcctggcatttgcttatcttgccttttaagtgttgagtcctctgtgaagtgggcactgcgtccttactagctggcctctgccagctgtttgttcctccagtttctgcccttc

SEQ ID NO: 472010 - DNA, 828 bp, Homo sapiens
ctctgcagagggtggtgtaggattcctcctctctgggcagggcatctctgcgaaaaaggcagcagcccatcagggacttatagataaaacccccatctccctgggacagagcacctgggggaaggggcggctatgggcacagcttcagcagacttaaacgtccctgcctgatggctccgaagagagcagcgtacctcccagcacagcgttcaagctctgctaaggatcaaactgcctccttaagtgctcctctgggacgaagcttccagaggaaagaacagtcagcaatctttgctgttctgcagcctcctttacccaggcaaacagggcctggagtggacctccagcaaattccagcataccagcaacagagggcactgactattagaaggaaaactaacaaacagaaaggagagcatgtccactcagagaccacattcgaaggtcaccaacatcaaagaccaaaggtagataaatccatgaagatggggagaaaccagggcaaaaaggctgaaaattccaaaaaccagaacaccccttctcatccgaaggatcaaaactcctcaccagcaagggaacaaaactggactgagaatgagtttgacaaattgacagaagtaggcttcagaagttgggtaatcacaaactccttcgagctaaaggagcatgttctaacccaatgcaaggaagctaagaaccttgaaaaaagattagacaaattgctaactagaataaacagtttggagaagaatataaatgacctgatggagctgaaaaacacagcaagagaactttgtgaagcatacacaagttatcaatagccaaatc

SEQ ID NO: 472011 - DNA, 867 bp, Homo sapiens
gcgtttcattcattttctcaactttcctgaggattgtggcctccgggctcagtgtgtataatggcccctgcttttgctagaatgtctctccctaacaaaggagtgggcctttcaggcataattagaaaggcatgtgaaaagagtaaagttacccagtcacaacttagtgactgggagaagtatctagtgactgcatgtcctaggaccccttggatagtgacagatctggaggacagttgtctgggacaggagagtaagactgagaaggccgtgccagtgtccaggagacagttaacctccaggccttcaatggttaagcatacctggggctctgtgagggtgatggcatgggccggcgcttgccccgggaaccctcattcctgctgctggatcatctggttagtggcttctgactcagaggaccttcataccctggggtgcggtgggccttccagtgattcccttgacataaggggcatggacaagggggtggcttatttttattcggacaatctttttaatatgtccttgcagaccgcactggaagcaagccctattaggcattcaatttgcccagcctttcccttttccagagccaccaaagtccacttgcctgagggccatgactaaagtgatggccttttttttttttaatcccattcgtcccattccaccttttttctcctgatctctattataaaaaactgagtttgccaagttcactagggtttctaagttttgctccgggtctaaggcaaacttttgaagtttttttctaatgtctgcagctgactgagtgataaacttatcctttaagattagttggccttcaatagagtcaggtgacagagaggtatgcttcctcaa

SEQ ID NO: 472012 - DNA, 1356 bp, Homo sapiens
agattttggttatgttgactaccaatgtggctgcctttttatgaaggtaccctcttaggagggcacccatgtgacctcttggctggtgacctgaggagaaatatgccattacaggagttggtgtcctttgaggatgtggctgtgggcttcacctgggaagagtggcaggacttggatgatgctcaaaggactctgtacagggacatgatgctggagacctacagcagcttggtgtccttgggtctgctggagtttgctgggggtccactccagaccctttttgcctgtgtatcaccagcggaagctgcacaacagcaaagattgctgcttgctccttcctctggaagcttcatcccagagaggcacctgccagatgccagctggaactctcctgatcacaagattcaaattggactacagtgttttgaatatagtggacggaggaatgccttcaacgtggaggctatattaacacataagagtgcttctatgggaaagacctcttgtaaatctaataaatgtgggaaagcctgtaatgagtcagctactattgctcaagagctaactcaggtagggaggaaaacttttgaacgtcatgtatgtgggaaaatattcagtaagaagcataaagtcactgaacataagaaaatacactcaggaaagaaaccttataaatatagtgaatatgagaaagccttcattagccaatcatgtgttacaaaacatcagagaacacatacagaagagaaaccctatccatgtgccatatgtgagaaatccttctgtcagaaatcaaatctaagcgtttatcagagaatccacacagagggaaaatcctattttgctaaaaacattttggcagcagggaaaaaaccctatgaacataatgaatgtggaaaaaagtttcatcacaagtcatacctcagggtgcatcagggttttcatataggcaagaaaccctatgaatgtaacgaatgtgggaaaacctatgagaaaggaatcctcactagccatcagagaaatcacacgggggaaaaaccctatgaatgtaatcaatgtggaaaaccctttggctggaagtcaagccttaggtcgcatcagagtattcacagagggcagaaaacctatggatgtaatgtatgtagtaaaagcttccaccagaagtcagacctcactaaacatgaaagaattcacactggggaaaatccctatgaatgtaatgagtgtggaaaatcctttggctggaagtcaaggctcagccaacatcagagatctcacatagggtagtaaaacctatgaaagtaatgaatgtaggaaaatattttgcctaaggatatttctgaactggtgaggcat

SEQ ID NO: 472013 - DNA, 636 bp, Homo sapiens
tgaggggcgctgggaatagccgctcatgtcggctgacggagcggtgtggggccgcatgcgaagctgcctccgcgccttccccgagcggctggccgcctgcggggccgaatactcctccattcctcagattccagcccccaccccagcctggaacgcccacagtgcttttatcacagctcttaactccacttggttccccaaagctatgagcccacataccacctcccagggctacaacactttgggtttctcagacactgtcaacactaagcagcatgaactgcaggacacacaggacagctggagaggggcagatgtcagttacttgacagcagggcccgtgctgggctccatgcccggcttcgccagcgtctggcgccgggagcgcagggaggcagcaggcaatggagagcaccgggtggagccgactttcaaggaggaaggggcaggaaagagggtgaaatattgcaaagcagcccaggatacaaaggtgtcaaaggttttatccacagaaactgctggtgatctttggtgagggcagaagccagcctactgggttgacaggacagatgaggggtgtaagacgttgctgagcagcctgcgtctgtgccacagaaaggagatgcagcaaaagct

SEQ ID NO: 472014 - DNA, 626 bp, Homo sapiens
ggattgggaggcgagtatggtaacagggttcaggtccctcagctgcatgtctgttggagtttgctggaggtccacttcagaccctgtttgcctgggtatcaccagtggaggctacagaacagcaaatattgcagaacagcaaatattgctgcctgatccttcctctggaagctttgtcccagaggggcacctgccagagcttgagcgctgtgctgtgagatccgctgctctcttcagagctggcaggcaggaacgtttaagtctgctgaagctgcgcttacagccgccccttctcccaggtgctctgtcccagggagatgggagttttatctataagctcctgactggggctgctgcctctctttcagagatgccctgcccggagaggaggaatctagagaggcagtctggctacagcagctttgctgagctgtggtgggttctgcccattttgaacttcccagcggctttgtttacactaaagccatatgacagggaactgtgggggcctctaggagctgacagtggcccttactgacagccagcaagagagcagggacctctgtcctacaaacgcaaggaactaactctgctgacaattatatgagctgagaaggagaacttgg

SEQ ID NO: 472015 - DNA, 821 bp, Homo sapiens
tgcttacctagctgatcgggacatggggtgtcagtacccaagcctcagtcagctaaagcagctgcatctgattcatatcctaatgtggaccaccaatcttgagccccttggagctctgctagagaaagctgctgctactatcgagaccctcgtcttagaggactgtcggatccaggactcccaactcatggtcatcctacctgccctgagccgctgctcccagctcaccaccttctactttcatggaaatgagacctccatgaatgctctgaaagttctgttgcatcacacaggtgaactgagcaagttaggcctggagacatatcctgcccctctggagagtcttaacaacaggggtcatgtcagttgggagatcctcgccccaattcaggctgagctgatgcgtacactcagggaagtaaggcagcccaagaggatcttcttggtcctgccccctgcccttcctgtggctcatggccatctgagaaactggagctgcatcttcgcttctagggaaggcctgaagcaggatcaaagcccacagcataagggctattctgacactgttgataccacctattccagcacaccaccttccaaggtcaaaagcaactgctcccctccatttcccagctgtcctgcctgggaaaaacaggattgtaacagaacaggaagtattaagtaggaaaacactagaagttagaattgtaaaatgtagtaacacactagatgcctgaagactccttaagcaggcctgatggaaagctgggaaggaggagggacaattgtgaaagagaccaaaagaccaggtgcttgaaaaa

SEQ ID NO: 472016 - DNA, 699 bp, Homo sapiens
ctctctctctctctctctctctctctctctctgtctctctctctctctctctcaagcagctcagctagttgctgctgcactggtggagttaagagacaggaaaaagcccaggctgagttgggggcagggagaaaaagagagggagagcgagagcagagagccgcctcctgtgtcctagtaaaatggcagaagagagaaagagactgcttcttctgattgaccttggctgctgcaatggtgttgaacatgagcttacgctggccttggttaatgggcagagagtttcaggtaatatgagggacaaagcaaagagacaagtgcttgtgaatccaggggttccagcccttcaccacttccagaccaggaaagatctcgcaaccctcacgaggtgctgtggctggggcccttgtggagcagacctacaggatgaggatgtcccaggggcacgagggggaaagtggtcaaggaccagctcccttccccacttcctacaacctaatcagcccgccctgccccagccaatccatcagatttcccagtctcttcttccagccctttcctggctccgaagctccagctgggtctatcccactccccactaggatctctgccatggagtcccacagcttcctcaactcattatctcctcacctcctttacttcctatagttcctctcactgataacagcctcacaagag

SEQ ID NO: 472017 - DNA, 521 bp, Homo sapiens
tgagagatcctggataccttggtgatatggtttggctgtgtccctatccacatctcatcttgaattgtaactcttacaattcccacgtgtcacaggaggatcctgaagctgttcttgcccagcctcttggaggtttaccctaccattcacagatttccattacatactggagtgatattaaaaataacagtaagcagtatgacacggaactcaaccaaccagaagttttgctagttcaaataggacaatatagagacaactatacatatatctggaagtcttcctctctttctccctcctcttggttactctatgccaaaatccaagctcccttgaactatgcttacaagaccaaggttcatggttcagggactacatccagagaaaaatcccacgactggaccatggttgacagaatagggggaaaaaagaaggctttctccccacaaaagacaactgtccctgaaaggtcagcgacgttccctttagaagcaagttgcctgctgtgatgcttctcttgg

SEQ ID NO: 472018 - DNA, 818 bp, Homo sapiens
tgtgggctccaagtagatgcagcagatccacatgtccctctgagggaaagccatggtgccaatgggcaagaacaccatgatgtgcaaggccatccaagggcacctggaaaacaacccagctctggaaaaactgttgcctcatatccagggaaatgtgggctttgcgttcaccaaggaagacctcactaagttcagggacatgctgctgaatagtaaggtgccagctgccacccatgctggtgccattgccccatgtgaagtcactgtcccaggccagaacaccggtctggagcctaagaagacctcctttttccaggctttaagcatcaccactgaaatcctgagtgatgtgcagctgatcaagactggtgacaaagtgggagccagtgaagccacactgctgaacatgctgaatgaacatctctcccttctcctttgggatgattatccagcagctattggttacccaactgttgcatcagtacctcattctaccatcaatgggtacaagcaagtcctggctttgtctgtggaaactgattgcaccttcccacttgctgaaaaggtcaaggccttcttggccgatccatctgcctttgtggctgctgcccctggggccactgccaccactgctgctcctgctgcagctccagccaaggctgaagccaagaagagttggaggagttggatgagaatatgggatttggcctatttgactaatcaccaaaaggcaaccaactcagccagctttatttgcaaaacaaagaaatgaaggcttacttctttcaaaaaaaaatgtttattctagtgttattcat

SEQ ID NO: 472019 - DNA, 1293 bp, Homo sapiens
agcagtggtggtgatgatgagaatgaatcaaggtgttggtggtggtggtgatggtagtagaagtggtggtggtgaaggtggtggatgatggtggtggtggtgataatggtggtggaggtggtagaggtgttggtggtggtggtgatgaagtggtggtggtgaaggtggtggatgatggtggtggtggtgataatggtggtggaggtggtagaggtgttggtggtggtggtgatgtggaggtggtagaggtgttggtggtggtggtgatggtggtagaagtggtggtggtgaaggtggtggatgatggtggtggtggtgataattgtagtggaggtggtagaggtgttggtggtggtggtgatgaggtgttggtggtggtggtgatggtggtagaagtggtggtggtgaaggtggtggatgatggtggtggtggtgataatggtggtggaggtggtagaggtgttggtggtggtggtgatggtggtagaaatggtggtggtggaggtagtggtaatgcaggtgaggatagtggtggtggtgggtggtggtgggtgatggtggtggaggtgggtgatggtggtggtagtggaggtgatggtggtggaggtgggggtcgtggtggtggaggttatgaaggtagaggtggtggtagtggtggtggtggaggtggtggggtagctgtggcgcagcacgttgacatggcagtgatgacaatggtagtgatggtgcaaaaggtagtggatgtgatagtggtggtagcaatggagatgggggaggtggtgaaagtggcagcgacggtgggaataagtgaagatcaaagtggcagtccttgtgattgtgatggcgatggcgatactggtgaaggtgatgaagttggtgcagctggtggaggtggtggtggtgatggtggtctgatacctggatactgagaccaaagcttcttccccatttttgctgccgccatttgtcagaaaaagtggagaaaagttacatggaaagtagactaagatgaggacagtaaatagaatgtcactacccaagctatggggcctataggacctcatgtgctccttcccagccacagcagctttttctagatctcagccctccatgtctactccatttggggtttgccatgatgacaatttcctgtgtgcatcggaaagcaagaaaagtggaaagagagtaagacaagtgcaccaaggcagtatcctggagtctctcttcgcccaccctggataagccgtggccagacctgtcagagctggccctactaattgctacttccatgtc

SEQ ID NO: 472020 - DNA, 2264 bp, Homo sapiens
tggggttgggtctgtaacttggatcctctggagtggatttgttgattgggtctgtggtgatgggcctggagcctgaatctgtgggggccagcctgagacctgagtccacaggggctgacctggcactggaatgggccttgaatctgaatctccaagggctggccaaatctgagatgggcctggtgcatggagcaggcctggactttgagtcctctggagcctggaaccacaaggaccagcctcgagcctggggccagcctggtactagggccagcatagagcctgggtctgtggaggcagatctggagcctaggattgtgggtaatgccctggtgcttagagccacaggaactggcctggagcctggggacttaggggtcaacctgggacctaggtacacaggggaagtcctgaagcttgggtgtgttggggtcagtccaccactgtggtctagtgggacatgcctgtaccatggtccttctggaacaagcctggtcgttggttctactggagcatagggccataggagctggcctggagggtgaggccatgaggactggcctatcattgggcatatctggagcctgtgtccatggatggcctcctggtgtttgaggcaaggaatgccaacctggtgctggggtgggcctaaagcctggggtcacaggtactggctgagtgccagcaagtcctttctggtataaagaccactgtccttttggtttgagtactgtggtttctacagaatttaccttctgtctctgaggcatgtctttgctggtgaatttacttttgttttttctgcacacctaatttaatattttgtttgatctgcatgtctggtttaaaatttttgtgaacactcttatcttaatttggttatgtgcatctgtaaatgatttggctttttttcccttgcttgtttctaaaaattttctaagagcaaaaataaacattctaaatgttggatacagaattattaactaaacgccactagagccgtcaccaccactaaaacactgatctaaactcctggtgttctttgatggtacttgtgggattttctttgctctctagaaattcatgagaaatggaatgggattttcaaatattaagacatgccaggttttctgggactccagctggctacatattactggctcagagtaaaatggccattattcaaaatttctttaaaaaaaaaattaaaccctgcagctatagagttaacatgtagagacttttaaattctctatgtctctaggttttttgttttgttttgttttgttttgttttctgcctacttggaatctgctgacttttctgctggagttgagagaaaactttctgcttatgacattccagacaagatttttaaagtgctctttagaagctttcagatgaatagctttacaaattataacagcttcatggtaactaacaatctagatctgttttgaaatgtaaatttataacagggtgatggtcccaatgtgactgacattgtcagccgtaattctggttgttctcttaaaatgctgtatgggatagaaataactaaatttcttttttaattttgaacttccgtcagatttttaaccatggctagttcaagtttttgttatccacatttattgctttgatttttctctaaaagcattttcaattgactacattttaaaattgcttttcatggaaaagactctaacaggtagtcttgaacacggatttctgataactttaagatcaatgaactaaataaaatgttttcaaaactcaaatgaagaaactgatgggtttatgaaactgctaaataagataaagcagaacaaaattaattgcatacgattgaataactgatgaagataatgtttttataacttttacttgaaatgttactgattccttacttacatgttttgttttacagatttcagaaaattttccttttaagctattcacatgttataaaaatttggtaaagtatattttgtgaacaaaggtgaacatattcgctttttctccctacttaattcctccaaaatttagaaactattcttactatgtttttagcaatacggttatttacataagttcaataagaatctgttctgtatttataacaggatacaattggaaacattgattatattaccaaggctttgactaaaatatcatctttgggaatgtgcatgaaatgcctggcttcaaaggtttatagccttacagtgaatgagtaaaaattgtcacttcctagcaggccc

SEQ ID NO: 472021 - DNA, 1753 bp, Homo sapiens
ccaggggaagctttgtaggggcgtcctttcaataggccatagagcacttccaggagccacggtgagagggacagggcagagggagccacgggaatgttccgagacagccagctgttctgtttggggtccttctgggtggtgttggccagctgcatctctggactcgtgcagcagttgggggagcgggacagagagacagagagagagttctgcagcattcacaagaggttaaaactggaaagctggagaaagcagtggaggtcactccaggaagactccctggccaaagaggactgtaggattctgacttacagtcagggctgtttccgttacagttggccccagtcagagacccaggatgaaactctggccctgagcgcggagaataggttttctgtttcccaagcttccacacggtggcgccaccgagcacccacctcgccagagttgcgaggcggttccacgtggctgggccgtccttgccggttctcgcccttatttaggttgtgtgtcccacttcgggcagcagtcttgcagctttttaaaaaagagatcttcaccaaaagctcctgaagggcagagggcttttcttatttaatttgcattcttctctctgcaatgcctaccagagggcgctgcacaaaatcatgtattggggatgcaattgttaatcgagttggtagaaacaggaataaattaaaataattaaatttttagtaatggtgggttacgtaaatcttgatgcctatacacatggaatccctgtgatgatacgaaatggacatttggtctttgtccctgttcctgacaccaagcgtctgaaatccttggaatctcccgaatgacaggggagagggagcatcttttgttattcataacaacccccttcctgccatactgagtgtgtgctaatgaggtgactcttggtggacccctaaatagcttcaggatggggctggttgccagaggaagcaaccatgtgattacagggctggagctttcagccccaggctgggcctccagggagcggctggggaaggacttcaatcaccagtggccaattatttaatcaaccatgcctaaatgaagtgactgccatagaaaccccaaacgatggggctcagagagctgtcgggctgctgagtgggtggggtgccagaagggtgggcgcctggggtgggccttgaagctccgtgctgcccctcatacatggccctgcgtgtctcttccacgtggcttttcctgagttgcattctttgtagtaaaccagtaatcatgagtaaagtgcctccctgagtcccgtgaactcttgtagcagattatctaacctgaggaggggatttgtaggaacctccaattttagccagttagtcagaagtatgggcggtcaggtgctgcgactggcatctgaagtgggggcagtgttgtggggctgagccttcaccttgtggggtctgtgctaactctgggtagttaggatcagaacggaattgcatgataccccgacagtgttcagacagttggagaattggttggtgtggggatttttaaaaaaggaaatataacccccacacatttggcatcagaagtgttgtgagtcagaatggttcaggaattccatacaatgtagctatctagaatcaagcactcagaaaatatttaagaactggggaaatgttttaaaaatagtcctaattgaaaaagcagatgataaagcagccgggaaaaggcaaagccgtgccacagggtggac

SEQ ID NO: 472022 - DNA, 3313 bp, Homo sapiens
gcctaatacctggcagctgctggcatcacgctcgctgcagctgcccaaatcatggctgcagacccaggcctcctgctctatggatcaggaaggagccccgccctcctgagtggggctgcagctgcccaaactgcggctgtggatctgagcctgtgctcttggtgggggtcccgggagcaggcaggatctgccctcctgggtgcagctacagctacccgaccagcagctgcagacctgggcttcccgctccacagagcagacagaagccagagacaaacaggagccccgccccttacgagttggccggggcgggagctcccctggctgctctcccaggcacaggacctgggcatctctgtagcctgcaccctctggtcctggggagacgacctccacccccacacatcatccctgcagactcaggggtgtctgctcccactgcctggcctctctccactcctgctgccggctcagatcttggagcagggttggggctgagcctcgagtccgtgaatggcaacgggagggagacagagtcctgggcggaatggggcgcgtccctggtaaggccccgccttcaggccagaggcttccagtcccaccgaccagaccggagtgaggactcatggtgcctcttccaggcctgcccatggccgcccatggaccatttggcatgcatttcttcccctccaaggtccataaaagccccgggcttagctagagcaagagaggagggagagaacggagagaagaaggcacaggaagaccagctgcagagaggagctaccctctctgctgagagcttcagagacctgcagagacatccggactaccagctgcagacaggagcaaccctctccagggcctcctctctgctgagagcagcagaccgaaggcggggactcgggcgctgttggcagctggcgacgcggggcgaagccgcggctggcggcgcctggccagtcccgcatccgccgcggtgggtgtgcccgcaggggtgcgccggggccagggccgagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaaggtaagggactctgcgaccccagtcccccgcagtgcgtctgctggggtgttcaacacccgccctgcgcgacccgagtgttggccccggcgctcgaccactctcctcttgcctctgccacccgcctcgcccagtccccagcgccgcgtccccggctccctttaaagcagtggctgcggcagcttgggccgacctggcgcccccgcctcccagcctggggtctgcgacagaaaaggagcggggctgctcgggctgcccaaaggtgggcgccgctccctttccagcccagattggctctccgcgccccaattctgggggtggagaacactggtgaggagggggaggccgtgctgtccttgcgactcaggtggtgcagcccccgcccagcttttccgagctaggcgctgcggtctgggatgcagcctgcgggactgggcgttctttgccgcgggctcccactgctacctggaatcgagctcttagtctctctcctgtcgcaaaagtctccccgtagtgccaaccctggcactcctcggcccctggctgaactttccagggctccctttgggccgcgaccttgggcggaggcaatggggcagctccgagtgctctagacgccgccgagggcgctttgcccagcccgcatgcctcctgtgggctcctttcccttctgcctctccggtaaggtcaaatctgtgactgggtactttgaccccgcagactggccagaaatgggagttggaaagtcgagcccatggccgctacgctgggtctgaacctaactcttgccctgggcatccttcggggctgccaaactcaagtcttagttcctaagcgccctggagtgcaagcctttagggcaaagagggagtattttccaggagagggaggaggaccccctgaggcctgggcaaagtcctatctaccaaatagggccagaggaggatcagatgcagccagtcatgaaggtggagccctcacaaatgggatagtgctcttagaagagagagctctgtcaacccttctgtcatgtgaggacacgccagatgccaacagtctgcaagctgaaagagggaccccaccagaacccagccatgctggcacgctgatggcattctccgagcctccagaacgattacaatattccctttcatttggatatcacttcgtctttagcaaagcacttgtactcccattatctcattgaaccctctggcaagtctatagacttaggacagtagtggtagccccatcctggattaaactttactgtcccatttctctgaccctgtcttgggactgctggatccattaaatccatgccctttgacttcatctgctacttggcatcctccatgtgtgtcagctgcctctcatcccagtatcctcactgactattgcaaacctcatctacacttcccaaactttgaaagccttctcttcccacctccagaaactctagcagactggccctttgggtaaaagccatgaactcttaagccagagcttttggcttcaaatctcagattctcctactgctaacctggtcttctcattgtaaaatatgaaataaaataataaaagcatctagctcctaaggtagtggtaatgagtaaattcaacatgtgttgcatcttttatttagcacagtgcctggagtaaatgtcgactcctatgccagctcctctttcttgcatctagaagtccatccttctccctcggcttcttcctccagacctgcaaacatgctcgcctttcccagagctcaccttgtccctccctggagctactgtccctttctctcctgaattgcactggaaaacagccaaagcgtagcccatctgctgcttcaaccatcttgtcaacccttgacgtctgcctcctgctcttttgaaactaagcccgagcctcacatggtcttcaagttccacagcatctgacatcatagaacagtcttctcaaaactgaccccctttgtgtttctgagctgtaccccatcctggctcttccttcttacctgttccccatgcatgactgtcttcaggggtgctcctcagactcctctgcttgctcttgcttctcaccaccccccacccccaaccac

SEQ ID NO: 472023 - DNA, 757 bp, Homo sapiens
ccaggtggctggatctcagctgcatgggctttgaggagcgagtggactcagtgggccacaaagtcttttgctcccctgaactgggctacagtccagagggcttggaaaccacaatttggagtaaatgtttcctaggaattcagctccacttcctccctcctgggtcacttcagcgaaagcctctcaagggtaggcacaaatactccacaggggggcacccctgcacccaccctctttgggcagctcccatccgagcagcatcatccctggtccagaattcagcagatgcctctgcaggcatcagctgggtgccacagctcgagttgcaggtgcagacatgctttcctttacaaatctcatgtactggtcctcagtgtgatattggaggacatggaattgatggtttctttaaaaagaatgtggccagcgtccccagtttaaatgtggaataatggagtttttattgtggtaaagtgtgccagagaactgctcatacttctgttggtgatctttgcttgcagcctctggctgcagggaaagtataacgcataacaataaaaatagttgccaacatcaattaagtattgactctgtcctggcctctctctggccccttcattgggaattccaatattggctccatttgtccatggctttttcatcactgaatgacctcaatctgcataataatggagggataacagccaagaaagctctgccagaagtgtcctttgtaggaaattacttagaaggctcc

SEQ ID NO: 472024 - DNA, 3353 bp, Homo sapiens
tcctcgcctgccgcattcagaaccagcccatccttgctgttagggtccttcactgagcgcctactctgggctgtgttctctagtgcattcgtgctaataatgacaacaattcttgtcctctgttggagtcaacaggtggatgctgcaaggagatcctggaaccttggtgtaatggagaacttcctcatcatgatggccccccaggccaaagaccagtcctctcagggggatgaagagaaagaccctccgaagagccacccttattctgtggagaccccatatggctttcatttagacctggacttcctcaagtatgtggatgacatcgagaagggaaacactatcaaaagaattcctatccacagaagggccaagcaggccaaatttagcactctgccccgaaacttcagccttcctgacagtggggctcgcccccctgcagccccgcccctccaaaactggtctcccgtggtgccaagggaggcatcacttgggacacaggagcaaaaccagtcaccaccgcttggtaatgccccccaggcctcaacaagcaggagtgaggtgagctaccacaggaaggctctgttggcagaggccaccagacagttggaagctgctgagccagaggatgccgagctcacttttgggagtggacggccccagctcttgagagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggtgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacagctcccatttaaatgagaacatgcagtatttggttttccgttcttgagttacttcacttagaataatggcctccagttccatccaagttgctgcaaaagacattgttttgttcttttttctggctgagtagtattccgtggaatgtatgtatgtgtgtctgtgcatatacgtatatataacattttattatatgtatatatatttattgactacacatgaggtccatactggctactaccagggatgcaaagccacgctggcctcactcaccaaggtcattccctcctgggatttttgtatttgccttctacctggactcttccccctgaggctcttcttgtgactggctccttctcgtcattcaagtcacagccccaatgtcacctcctcaaaagtcttcctggtgcctctgtctaaagtggctgcccctacctctctctaggggagaaccctctttctttcttgagacactctttgcttttcatttctacccaacagaatgttaattcactcaaaaggggctcctgtctgtcttatctgtttccctaacacctagaccagttcctggttcctagtaggtgttgagtgaaaacgtctgttaaatgaatgagcgatggatgactctcgggagctaggttaaattccagtaaacttccaagtcttcaaaattctgctaagcagctttgagtctcttcagctgaacgggaaaggcaacgtacataatgacagcctgaag

SEQ ID NO: 472025 - DNA, 4853 bp, Homo sapiens
gtttgtagggagcagctgcagatgacggccgattaaaacgaggggatcagattttagctgttaatggcgagaccctggaaggtgttactcatgagcaagcagtcgccattctaaaacaccagagagggactgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaatgcataccactgagcaaatgaaccttattctcagcaggaacaactagcatacatgttctgaattctaacagtgctaaattacattcaagtccaggaagatcacctggaattaatggcatttcagttggcaggcatcattcccacccctcggtcttaggaaaaggaggtagaagccccagaaccacacggcagagatcagcaagttttgtctcaagtcagacaaggtctaggtggccttggccttatgcaaagtgggtgacatatttgattatatttccctttacctccatagtagtcaggccagcagcatggactgcaagaacctaagggagcaacatacttagctgcaaagtgagcaaatgaattgagcctaggaatatgtgatgaaaatgcatggctgatgtttcctgatctccaaggagactcccatttgctgaagttttgcatgctaagaaatcaactacagcagaaaatacaagaatacctttaagttgattattggcaatcttattcatatattagcaagaaaaagggagagatgcttactggtggatgctatagagtcctctgtttttaaaagtaccatggccgggtgcagtggctcacgcctgtaatcccagcactttgggaggccagggcaggcgaatcatgaggtcaggagttcgagaccagcctggccaatatggtgaaaccctgtctctactaaaaatacaaaaattagctgggtgcagtggcaggcgcctgtaatcccagctactccggaggttgaagcaggaaaattgcttgaacctgggaggtggaggttgcagtgagccaagttcgtgccactccactccagcctgggtgacagagcaagactctgtctcgaaaaagaaaaaaaaccatgaaggatgagtactagagtcagtaatagaagtagttcagcattatttaactacaacacaatgctgcaaatatttcacagtaattatcaaaatttaatgggctctaatttaaaatgttatttaataagtatagattttaattgagaattatctttgagtagatgtaatcacaaagtgcattaactcttgttggaatattttatggctattccaaagtatagagtgcctaaattttgtgttgaaaatgtctttcatgacggtattaagttttctgaaattacacatggcttttaaaatttctaatgtatccaagatgtgcaatgttgttaggatctcattcttcagtgcatgaaaagctactaccctcagaacattttgtgttaattgtacctgcaagaacacctcaggcaagccaagaagaaatgaaacccaaataaaacttgaaaatgcaccttaaaaatatatatacatataatagttttgaaatgggattctgctttattttgatggaatggccattaaatacacattttgagataatacattgttgtggtgtttctttatacattatccttttaggtcgtgctagtaaaagtatattgatgaaggaattatgatgctttatacttcttactgcactaaattgatagaactagtacttgtcataatcggttctgtctccgctcacatgactaatacgtaattgcctttccaaaaagatatttttgcctcagaacttactgacaagctgagaggctatgaagatggaaatttgtgaaagaagtagtgctcttatatttggcctcatcatttgggccatttcagtatagtaatgatatcactaatcggaattagcatgagagggaagtaagccaggaagaataaaactgctgaatgtttgtatgtgtaagatatttccaaagattctaaataaatgtagttgcctacagagcaaatggagttttattatatatgaaaaagtgtactttctggatctaattgtgctttttcttcagcattttcttccctaatagaaaaaaaaaaaaagtccaacttttcacaaggttttttggtgtcctgttaaaatctggaatccatgtggctcaggatccatgccgccatgcccagccaacctctaatgtttctttcctggccctttcatgcatgtgcaggtgagtatttgacaaagaggcgatctccatggctctgtcaacctacagctccctcctttccagacactacatgttctagccaacttggctggcctccctgaacgtgaatctctttctcctctactcgtggactctgtgtgagtttccccttcctgagtgtgacatggatactgcctccagggataaaactgggacagttgtagaatttaccttgttttccttcttgcagggatcaaaatcctatgctgcctgttatctgatgtctaaaaatgtttcatatattataattgaacaaatgtaccatcgggttttataccgagacattcagttcccagggaaaaggcaggagacagtggccttcctctatctcaactataagaggctttcctcttttactaatccacctcagcacagaccctttacgagtgtcgggctgggggatggtcagatctttctcatcccacgaggccatatttcagactatcacatggggagaaaccttggacaatacccaaccttccagggcagaggtctctgcggctttccgcagtgcattgtgcccctggctagaaatgaagtcagtccaggcttgggccacatcctcccaaactcactctcttccttccaactttccactgtagcactgcagctgattgtctctggaaccatccagaccaatggagaaaaacatgttcatttagctgagtcctcacaataagataccaaattccaacgtgactctagtatagtttcacatgacagagagcaggccctgaaagaaatccaaagtattttaccccaaaatatattcttctgacatattttaaaatggccctggtgggcaaatctacattctagtggggaaatctacattctgtagagaatcaccttccctttccaggtcttttcctgatccagagagattaactagagtctggcaccttttaaggcttgataagagacatttaccatctgttctacataataagaaccttggtttccacaaccccttatcttaacccagatactcctttctattgattcctagcctttagataataactctttcaaccaaatgccaatcagaaaatctttgtatccacctatcccatctttctgaaccaaaccaatgcataccttacgtgtctagattgatgcttatgtctccctaaaacgtgtaaaaccaacctgtaacccaacaccttgggcacatgttctcaggacctcttgagattttgccttgggccttggtcactcatacttggctcagaataaatctcttcaaattgtttacaaggtttgttttccctgacttatgagagcacagcatccacacattgtgcaaaatgccttgttcttcaagactcagttccctattacaacttccaagaaacttttccccagacatcctctgcaagttttgctaatgcaacttcctctgccattccatgaaacctgttgcttgcttatttttaccttttcaattaacatgttgtgttaaaattacctgtttacagaatctatctttcccaggagatgctgtaattgcccaatggattcaccttgcccactgctgttggggtgatcagacccaacaccaggtcatggggacgacgaagt

SEQ ID NO: 472026 - DNA, 676 bp, Homo sapiens
ccatttccttaggaggattagtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacagccctgttaacatgcaaagctgcagcccagagagacaggactggcgtttcccctcaaactgaggactgctcagaaactgacttcataatttgatttgaaattatttcaagaatgaatggattcaagacttcgcacatatacgaattattttttccgtaaggtgtttaaacatgtaaactt

SEQ ID NO: 472027 - DNA, 1685 bp, Homo sapiens
tcatcagttaaggcaggaacaggccattttcacttctttcatggtggaatgtcagcagttaaggcaggaaccggccatctggatgtaaggatgaagctgaagcataagaaagagcaatccaagtacaaagagagagaaaatagatttcagtcagaaggagcagcacctgcaaaggcccagaagtgtgaacttgttgtgttagaagaacagaataatggaggacaaggaattcagacagatgagaacaatgagagagagaaagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagagaggtgaagagagcaaacggggaggattcccaaagaatgccgtagtgagagtgacattgtattttcaatgactttctgtttttaaaagccattagttcttccttggcgaaggagagaggtggaaagttcatgtacatattgtgtcaaaacgcttttgatttaataagtttatcttaaaagaggccacttggaactctgtattttttaatatactatttataaatatttcaacatgctgtttttaaacaatgcatagattaaacatacatatatttatacatatttagctggaggcaagttttgtgcatttctaagcaatatatatgtttttgtacagtttagtgaattaagctagtcagttacgtttcactaaaataaaatctcattatgaagaatttgtaatagttttgggtagaaattgctttattcatttagtggaaatatctttaaggttcatataacatagtaccattgtttcacactgatggaagcttacttgacattaaatttcattcctctttgagacaaatatcaagaagacttttaatatagaaactcttttaagaaactcattactgaaaattgaaatgggctcttttagcacagccaaaaagaatgaaagaaaaaagtcacagttttattagtttgtcttatgtttactatgatattaattattccagccatctcattttaattaaacttttggcaaatgcactagatatatttgaggtaatggagagaattctaataatcagagtgaattattatctctgctattgaagttattcctgtactattacaaattttccaagaaaaaataaatggatgcctatttgataccatattaagcaatcaacaatcttgttatgcttcttacttcacaaagtaccctagttcatagatgacaatgaaaatgttaatgatttattttaattggattgctgtgacatgctgttacatgatttgcatagtagagcacttcctatcatcccaattggttaatacaactagaactacaattgtctattttccacattacaaagctctttgaatgttttgtgtatttgcgtatgttttgtatatttgcaagcagttttaaaatgtactcatcaagcaagaagaatttgggagattttggagatttgtattgacacttccatggtattccaaagtcttgtgtttaattagagtgggatttttagaactttaattgtggtacaatggttagacatttaaaaggcagttttattttttttaaaac

SEQ ID NO: 472028 - DNA, 1380 bp, Homo sapiens
ttcttgtttatataattagttaactcagctatcgtgcttacggatttgctccttggagtttacattccttcagagtccaagcatgcacggccaaaggttgtgctctgggcccactgctgcaaatggtagttctggctacaaaattggctcagcggtgtctcctgatgttctggcaactttaaataagggggacctgcattatcaacctgcatcctgcacagacagtagctacgtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagccacagatgttggtttctttattttcctgaaaataacctatacggataagctactgcccgacggttctcagaatgtggttcccagagcagcagcaacagccacatctgatgaacgcttagaaatgtacgttgtagagcttctgccccagcctagtgaatcagaaactctagaggctaaggtctaacagtctgtgtttaagcaaaccctttaggtgacacatgctgaagaactagtatatactcttcttcccttgctaaaaagtggttcaaacctaaaacatcgtgtatgcaaagagttgaactataattttgcagtccatcttaaacaagccatttttgtgactgttttagatttctgaactatcttagtaattctgctgtgtgttctgataaatttactgaatgtggattaggctacatggggttccttgaaagtattttcaaaaactatctgattcaataagttaggtgctatggtagcatgatgtttattttaagcaaactctaccataaaaagagcaggtatatattttaatagaaactttggatctgtattaagtgctgttgtttatcatcttccaggagtggccttactatttttgtaggaggaagtttgaacctttatttttaaatgagtagcaaatatgcaatatcgtggattcagtcagacatgttattagcatgttagtctgttgcttaggcttgaaaacgtttctttgtttctgaattttctatgagtctttgtaatacttaataacatcctccaagtgtaaaaacaggtgaagaaagaaaaaaacaggcttttctaaatttgaaaagggtggttatttgtgtactgcactggcaagcaaatgcgagtcaagtgcgtgtcagagtctaagctgatcccctcaaagattggtgtgtcccttttttatgcaatcagggctttcatgtattctgctgtaaagcacttgtaagattatgaggtgaaggagtgatgatc

SEQ ID NO: 472029 - DNA, 806 bp, Homo sapiens
cgcaccgctgcactccaggctgggtgacagagtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgttgaagtctgcacaatatatgcctgcgtgaaaagcaatggaacccaaattaccactgtggaagacactccaagtgatataccaacacccacaattcgtggcatcacttcaaggaaatattactcatttgatggccatgagttctgattatcacattctgtttaaggagaccttaatagaatagtgtcagaatatagaatgtaaacagaaagacagaatatatagaaaagagaatattgggcttattattatggctctgctatcactattttcatttccttacctccctcttcttcccaaactcctcctaacttctttacctcttgtagctcccatagaaacagctcggtc

SEQ ID NO: 472030 - DNA, 900 bp, Homo sapiens
ctgctgagcgcccaatttgtgagcagcagaaaccaacactgagccctcgatacggcaccattccttgggggttatcagccagccacctggttgcaggtttattatattgcacctcttctatcatggaaagggcagagaaggctgtgtatgctctgaatcagcatccaatatatggtactgtttctcccttagccaggattcacaactccaggaatcaaggggtggaagtggaagtggcaccactcaccatcacctctaaagatccactagcaaaatttttgcttcctgttcctgcgaccttacattctggtggcctagaggtcttatttccagagggaggaagcctgccaccaggagacacaacaatgattccattaaactggaagatgagattgtcactcagacactttgggctcctcccacctttaagtcaacaggataagaagggagttatagtgttggctggagtgattgacccggactctcaagatgaaatcagtctactgctccacaacggaggtaaggaaagatgaggaacccacagatacggagagctgactgtatatctacacacgaagtttccaattattacatctcataatatgtgttctccatatttcctagtcttaatttatgtttgttgaaaaataattttgtttaatctcaaaatagaataacattaatgattcaataggatttagaatttttgttgaacttggagacatacacgaagtaacatgaaacttttttaatgactaatttgtccccattctctctttcaagacatctgttatttgcatattattattaagcttgaatattttctaatgggaaatgaggtggtgtaactttagaaagtatttttctttaaacaatctccaagctaaatgaatgttatat

SEQ ID NO: 472031 - DNA, 1376 bp, Homo sapiens
ccagcaagtaaagaaggatggtcaagcaataagtctacagctcccagtgtgggcgacgcagaagacaggtgatttctgcatttctaactaaggtaccgggttcatctcactggggcttgttggatagtgggtgcaggacagtgggtgcagcacactgagcatgagctgaagcagggagaggcattgcctcacctgggaagtgcaaggggtcagggaattccgtttcctagccaagggaagctgtgacagacagcatgcggaaaatcgggtcactcccaccctaatactacgcttttccaacggtcttagcaaatggcacacaaggagattatatcctgtgcctggctcagagggtcccacgcccaccgagcctcactcattgctagcacagcagtctgagatcaaactgcaaggtggccgcgaggctgggggtggggcacccaccattgctgaggcttgagtaaacaaagcggcatggaagctcaaactgggtggaggccaccacagctcaaggaggcctgcctgcctatgtagactccacctcttggggcagggcatagctgaacaaaaggcagcagaaacctctgcagacttaaatgtccctgtctgacagctttgaagagagtagtggttctctcagcaaggagtttgagatctgagaatggacagactgcctcctcaagtgggtccctgacccccaagtagcctaactgggaggcatcccacagtaggggcagactgacccctcctatggccgggtacccctctgagatgaagctttcagaggaccgatcaggcagcaacatttgctgttcagcaatattaaatgttctgcagcctctgctgctgatacccaggcaaacagggtctggagtggacctccagcaaactccaacagagctgcagctgagggtcctgactgttagaaggaaaactaacaaacagaacgacatccacaccaaaaccccatctgacataggcatcggcaaggacttcatgtctaaaacaccaaaagcaattgcaacaaaagccaaaattgacaaatgggatctaattaaactaaagagcttctgcacagcaaaagaaactaccatcagagtgaacaggcaacctagagaatgggagaaaatttttgcgatctactcatctgacaaacggctaatatccagaatctacaaagaactcagacaaatttacaagaaaaaaacaaacaaccccatcaaaaaggtaatcaaaacaaggcctgttggagaagacaacgattgagaagacacttaagcaaaataagaaagcaagtcacgtggagatctgagaaagacagcttatggttgaaaaaaacagaaatcttttttggacctttcatttgtaactgcaag

SEQ ID NO: 472032 - DNA, 731 bp, Homo sapiens
ttctcttaaagttctggagcccagaatcttgaacaaagttttatggggctggaattaagataccagcagaactttggcaggggactccattgtggtgtctcagagggagatgaggaacttactgggaactggagtaaaggtcactcttgctatgctgtagcaaagagagtggtggcattttgcccctgctctagagatctgttgcattttgaacttgaaagagacgatgtagggtatctagaagaagacatttataaggagaaaagcattcaagaggtggcttggctgcttctaaaaccctgtgattatttgcataaacaaagaaatgacctgaaactagaactcacatataaaagggaagcagagcacggaaaaatgcctccaaggcatttcagagacctttgcagcagtcccttctatcacaggtcagaaggcctaggagggaataatggtttcatgggccaggcccagggccttgttgctctgtgcagcctcaggacatggggccctgcatcccagccactccacccttagctgtggctaaaaggcaccaaggatcttaaatacttcccagtcctatgtctcacaattctttcttccccctatgcttagcattacaaattttgcccatatatttatgtattagtattcagcagagagcagcacctcattatgctgatttctgggccgttttttactatttatgtccagacttttcacaagcttggaaa

SEQ ID NO: 472033 - DNA, 1162 bp, Homo sapiens
ctccgtgtcttcctcttgctcctatgtaagacagggaatgacacaaagctggtcacatgcaatggggggattcccaagccagtggccacgagaaggcactttcaaaatcatttgaaatccccatgcccagcagcttccagatggtcattactggaagattctttcctgtgtttagatgcagcccagccccctgctgcttcataaaggccacatctggtgggaggccgcagaccctgggcatccagaaggaggcctgccccagccagactcagcacactgtgcagggtgcagagacgaaggagcaagacaaggccctgcccaccaggaacttacagtgtcctcagagtgaccagacacttttccagctggttgggacctgggcagtgcagatagttggtggcctgtccgaggcccacagtcaggagccatatggtattgtcatgggcagcaccacagcccatgtgtcccccaccccaaattaatatgttcaagtcctaacccccaatacttcagaatgtgactgtatttggagcccttggcaaccaccattctactttatgtctctgtgaatttgactaagtatcccatataggcaaaatcatacagtatttgtccttttccaatcagtttatttcacttagcccaagtcctcaaaatttatctgtaggtcagttggcctagcaacatggttgaaaattctgttatttctccatgaacttccctttggatccttgtcaaaaataaattttccacatttgtagtgtaagtcctgcaatactattcatcttttcatagttgatttggctattctagatcccttgaatttccatatgaattttgggatcaccttgtcaatttctacaagaaaagtctgttaggattttgattgagagtgcactgactaatgagcaaatgagaattgacattgtaacaatattgggccttctgattcataagcatgacacatcccttgatttactttggttttccttgatttctccgagcctcattttaaagtttttaatgtacaatatctgttttttggtcaattttatccctaaatatttcacatttttggatattattgtaaatttttttttaaaatttcagtgtccaattattcattgctagtatgtagaagtacaattattatgactatttc

SEQ ID NO: 472034 - DNA, 720 bp, Homo sapiens
atcaaaggaatgcagctataaacagggtgcttacagaggagctgccagtcctgtgggaaagctcagacaacctttaggacctcgcctggaagatgaggctgagtgactcgccgaaatgcacagagcctctgagtgtggacagctgagagccagacacaggctgtccaactccagagcccaagagaaagaaacctctatgttgctgagcaagtgggaagtatgcccagcacacaggctcccttcctggagaggagagactagagttgtgagaggagttccaggtagtgagggtgtgaacctgccttgctatcgggatgctctccttggctgcttagatgtgggtgtacctttttccacagtttcacacctatttcctagggtctaccttttcaaagctttaaagcatttggcccaaggccacggccagaattctagaacaaggaacaggtatactacattctccagaaaaattaaaatgtttaagaaagaactgagtgtggagggcatgtaagaatgcaactgcaacattccagggccaatggcatgaaaagcatcatcacaccaaagcattgtcacaccaaagcatcgtcacaccaaagcatcgtcacaacaaagcatcgccgtcatgtcgaattattggttgtgcttaactttggttaatcactgtttgctcctccctacctttactgccccgtgctagattcatcatctgctgttctc

SEQ ID NO: 472035 - DNA, 804 bp, Homo sapiens
gcagcagatctatctaacgagatgtgtaataaacttttcctcaatctgcaggtggatgtgcttcctaagaagtaccgccttgccctgttccaggaagtcaatccagacttcatttctcattttgccacaggcggcggccagatggacgcattgggcattggtcactgtgccgttggcggctggggcatctccaggacgtctacactggggttcggaggcaaggccttagaagaacgagccttgccagctctgggcttccagagcaggggttttgcaggagagtcagaggttttccagtgccagggggccctgaaagcaacagccacctgcagaggcggcccaaggagaggcagtggtcaaggccccccgacaggtctgaaatgccactcaggaccacagctggggcccaagcccaagccactgtctctgcctgaccactctgcagggacagccccgccaagccctggaacatcgacctgcctgcccctctggctcttccaacagcccctgacaatcaatgacactgaatcctgtcaatagggcagggccaggggtctaaggcggagaaataatcacagtcttgttgctgccaacattgcagggacagattttcattaacccagtgggcctctcccggagcctctccacgtgatctccacccacaggcctctaactcttcatccctccttgtccccagctccctgcttgcaagagtggaactgtcaagccccatggctttaatcccaatattgtctatgctgtgggcttgcagcttggttccaaggagttgttttttttttaatg

SEQ ID NO: 472036 - DNA, 2921 bp, Homo sapiens
gactgtgctccttcgaggagccacctggggaagaagtgggaggcagagagaatccaggagcttacttagcttccgtgctgtgcatttctttaaatcacaggattcttgcaattttctgagctgtcggttccccacttggcgggattttgggctctgaggtgggaattctgcctgggaagccctgcagaggggaaatgaaccgggagcagccctgggggcttggctctctgaggaggtggcctgtgaacaaaaagaccagcagcaggggtgggtgtgagccctgtgggtctgtggagggagagcatctgaggtagacgcgatggagcagggcagtgagtttgaggaactcgctggagcaggttctggggtctgagatggaaaaagaacttttttttttttaaacccacttttgggaggtggaagaagaggactttctttccaaggcaagggctgtgggaagggggaaggagggagaagaagtggcctgtgcccgggctgcccacgatctgaggctgaatcaggaaggctgctgtttgggtccgtggtccttgcattgaattagtgtcgcggggctgccacaacaaatcaccccagactatgcggcttcaacagcaaagattcccatctcacagttctggaggccagaagtccgaagtcaaggtgtcagggccagaatcctcgccaacatagtgctccaggcggctgctaccaatcctggtgagaaaaccccactcaatgtggcttacgcggaaaaggaagcacattggttcctgcagcggaactaggggtgcacctggcttccagtgcccagttctctctgcactggctggcagcttctgtgttggcttcaaacaggctctcctcctggggtggcaccgtgcagctcagcctcccgtccttccaggtccgggtccggtagctgccactgaaacccacggtccactgcagtcaaggggctgcaacggcactatgggccagctcgagtcagctgtgacctccggctcagggtggagccttttcccagcacgagggcggagcatgcaggagggcagcagctcagcaagctcctgggccctccctggttccgctgatgctcgctgcgtggctgagccacctgctaagccacactggctcctgtgctcattctcccaggtacagtgtgttccgggtcaccgggtgcctaaacacaaagtgtacttatccatcggcctgctgcctgctgcttgcttcaagggccgcccagaagcccaccctgtttctccccacctgctctggagcaggacgttgcctgctctcacctggaaaatccggggacagcagagccctgagaccgtcgaggccagagatcctgtccctgtgtccgagagcttcatggtcccctcccatcccctgctgctgaagccccagttgggctgtgtgctcagatagaagtagggtgagccccccaccctctgccccacctgtctccccacggttgagtttgctgccctggttcccctgcctatctacagccaagctaataaaatcctgcagtttccatagattgtagggtcccgccgagccctccggctgctttagtttccagttggttttgcaaggagggggaaaaggcaaatgcctatcactccacctttggaaggagacgatgaatagtaactcctttatctctgaaggagatcttttcatgcttgaaattccctgatcttgtcccagatctgcctgcagggattcaagatggcatcccccaccccatgcggatttgctgacatcctcagatttgtgtcaggcacaaggaccaggtccctgggggaggctgcttttcccaccctcagtgctgactaatagaatttcaatatttggtcttaaaaccacggattcttaaaaactgctggagaaagaaatctcagcaagataagaaagttaaaaaacatctccactctccctgcagctacaggaaaacacattctggtctacatcaaaaaatccatccttgtaaatattattttgaacaagagttttggagacttcagaacagttgcaatgatcaatggtaaataccttttactccttaaaaaactccataattctgtttgattgtcttacttaataattgattactctggtaatagtatttaaatggacattcctgttttctgaaaggtatacatacttgcagttctatagagtagccttatctcaggatattgcattcccaacggattctatagttattctacaaggaaggagggctgggaatggtcacctggtctacactggttcatcagattaccccatccatctgtcacagtgaaatgttcaggtttagatatgtgacccaagcagaaccatttgaatttttcctggtgttggtctatggatttggggaaggaattttctgggaggatacatggactctcgataccaaaccggctcgaatttgtaagattcttcctgagcctctgttccatgccaggcattgtaataaaactgggggtcaaacatgagcaaggaccctgccctcaaaaatagctatgttgctaaatctcatttgcttttatggagcctttgctctgtgccaagtgcctcccaaccttgccatattgaatccttaccggaacactgagttaggtgcatctttggtcctttctgatggatgaagtaacgtgcggggacagagccaattaccaggtcatgaacaacacagggcagaggaagtacagcgctgtgtgttcatataccgggacgacgaacccagacttgggcaccaatgaaggcttcctggaggaagctgcgtcctgaaggagaaggggaggctatggaggtgtagcaggtgcaggaggagtgtttaggcagcgatggagccacagctcggcacaactgaggaactgaaaagttggttctgctgaggcctgaggtgcaac

SEQ ID NO: 472037 - DNA, 1653 bp, Homo sapiens
ctctgtagcgtaaccagatcaaccctgaaggcgctcgggcaggcagagtggagtgactggggacagcccgggaggaagctcttctctcctccccatgcaaaccagtgcggggacagagccaattaccaggtcatgaacaacacagggcagaggaagtacagcgctgtgtgttcatataccgggacgacgaacccagacttgggcaccaatgaaggcttcctggaggaagctgcctgggagtcagttgacctatacaaggaccagcgcaacctggctccaggccacacgttggctgaatgctcatctgtgaaatgggaactccactcacaggagcatgagggttacatcagaggtgtacatgtgccacggagccctcgccaccctgggggagatgacagtgacatagggcctggctcctccaccctggacctgcctgccccaaacccccacaacacgctgaaaagacagaggccaggggaaggaagaagagctgtaccacaaaaggagatgggcgagcctgcaggaggaaccaacgctgccaacaccttgcttttggacttccagcctccggaactgtgagaataaacttctgttgtggaagtcacacagtgcgtggagctttttcgtggcagccccgggacacggacacgaactctagaggagagcctctggcacagtcagtgccgcctgctaggctcactcattgcttgtttgatgtctgtcttcactttgcacggtgggccaaggtctgacagtccctcaacaaacactcgctaagtggaggacacaatggtgtacatctgtcttgcatccccaggcccccagttaatatttacagaaggccaggagggctggcctggaaaccccctttgatgtctttcccaccctcagggattcattccagctcaatctgagtccacactcatgaagcctggtggcaatgtctgtctccagggaaagagctcagtgcccagcacaatactcagcacaccaaaggcatcctcaaaatgccccctctgtggagccagttggaccccttaaagagagaagcatctcttgaaccccacctcccctagggtgccctgtgacctgttccaggagggtcggtcaccctccagcccactcacctctccctctggcaccagccccagcctttgcgccacgttcaggctgggcagcgcacaaggtcacttcaacttgagaaaagcggtagagacagcagtgcttaaaatgctcgtattaacagcagcagtctgcaatcctatgtcattttaatagcaaccttctgccgtgagcaggcggccggcatggcagctcctccccacaggggccatcccccaaaacatccactcagagtcaggtgggaaagacaggggcttagatccatgaggaaagctgtgctgagccccagagcccccagagagggcctttgaggggccccttgaggctggggtcaggggtaggacatgcagaagcccaagccgggtccttctgtcttctctggccaagaccaaaaggcccagggagggccacagggccattcagcactggccgccgtaaagctgaaggggagggttgcgggggggcggggttagggggtgagaggtccccaccctggatccactgtgctcttcctgtatgattcccgagggc

SEQ ID NO: 472038 - DNA, 592 bp, Homo sapiens
ccctctccaacctcttcttctcccacctgggtatggcaactgcatgcttccagtcgcccaggccaaaaaaggctggactcaccgcccgcttttatgccatgttccatttctcttctgcccatcagctgggcctccccacggcccgatctccacggttgttttatggaagtgcctaccccatgctctgcttcaacactcgataccgactcatcagatgcttgtctggattcctgaagttgcctcccgacccttctcctgctcctccgaccttcctccccgcagctggacaggacacagcagccggggacctcttggtaaaacacacatcggctcacgacttccctctgctcgaaacctcctgcgcattcccatctccgagtgaaagttccagccgtgctatggcctctgtaggagacgtggtggcttcaaacaacagaatgtatcctctcccagttttggagcccagaggtccaaaatcaaggtgtcagtgaggtaggttagataggtagtgtggtcacagcccccgttagaggggaacaaacttgccaaagagatggagagaacaaactgcccaacagtgcatcagctgtat

SEQ ID NO: 472039 - DNA, 761 bp, Homo sapiens
agccccttctgatcagtcttgctttttgatgtccttgacagaggaactggcttctctggccggagagctggtcttttaccacctggagaaacttggacccctgggagagctcactgacagcaatggggctttggggcagagacacaagacggggagcgggcttcaccagaccctccgtgaatatcttggagatgagaagtctgagcaactgcttccctcaccatactacagaatgacttttccagggactctggtgtccgccacctactgcagaatgtactcttccatcagcaaggtctatgacaacatcaaggacattgcccgcttccgcagttctgttcctgcatacagatatttgttggcccatcccggtgtccagccaagagcaccgagtcagggcagcatgaagaaggtgggctggggaaccacactgtctgggttctaatccctgcatttccacttcccagctgtgtgaccctgggagctttcctttcccttcctgtgccttgggtacctcacttatctgcaaaacaagcatcatccacctcgcagggttatcgtaagcatccagtgaagtatcacacacaacatgctcagaacagagctgcctatattgtaggtcactgtgcgtactttagtgatttttgtcatgagacaattactactctttttgtttgttgatcaaagtatttattgcatagacctttccaagcagtgctgtttcattgggaaaactgccagggtttagattcctgctctga

SEQ ID NO: 472040 - DNA, 3136 bp, Homo sapiens
gcgtgagctcccctaggaggccgggagatcccttgaggcaagagctctctcctgctcctcttgctgtgcccttctcgcagtgcactcatagcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgagaatgcgccagggccgctggcaggcccagagatccgggtgttcagagcctcagctccacctcctccctccatcctgttcaggaagccactgtcagcccaagataataacagttatgatacagatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtaggccactgggccctgcagacctgcgctctcctggaacccccactcgcaataggatggccctcccatctgttcatgtgcacacagcggctcttctttgctgtgattggctgtagagcacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgagtgtttgtagagtggggtgggcttcagtcggtgggtgcatcccgcaggacgttacagaggctctcccccttgtgcagagtgtttctagagtggggtgggcttcagtcagtgggtgcatcccgtgggaggctgcagaggctctcccccttgtccagagtgtttctagaatgggatgggctttgttattgacagtaggaggcataacttaaagtggtaatggctactgaacatgaaggaagtaaatctagttttctcgtggttcttgacagtgatagttttgcaaagcaacaccctacatagttcatactttgggaattactgttagggtgtaaaaaagtatatcttttctacaaatgtttacagagcacttacaactagttaataaactaagccaaataatgtctaggggtgcaaaaagaaaatgtgagggtaggtagggcaggcgttaaaggaatagagtgcgtagagaattagatgctaacaccaacagtggctttttggtgtttgaattttctgttaattgatttcttttcccatagaaattttggacggtgtggaacttggagagccagcccataagaaaacggggaccacagtgccagaatctattcattctttcagtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccac

SEQ ID NO: 472041 - DNA, 1448 bp, Homo sapiens
gactgctcaaagggatgggagcccctaatcaccagatgttgttaacagagcgctcgaaagtgccaccctaatcgcaggcttcccaacctaatcgcaggcttcccaacctaatcgcaggtgccccaccctaaacgcaggcttcccaacctaatcgcaggcgccccaccccaatcgcaggctccccacactataatcagacgccccgcccgccgcttcgacctggcgcatgcgtggtgcgcacgcgtcccgtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaaggtgagttcgcggggcctcgggggtaccaggagtcgcccgcggccgccggaagccgactgggccctctgggcagccaatgcccgcccgccgtagtggagcccgagcgagggtcgcggggcccctgtccgcgctgggcgcagactctcctgcaccctccggggatggggcctcggaaacggacactgaggggcgtcccgcttgcgagcctaagtccatggaggcccaaatgtggaaagccgtctcgcatcctgggaaaggcttccttgccacccagacgtccctagcccttgcgacgtcgcgctcgccacgccctagccacccgaccagctctccgcaggggctcggcttcttcgcgctccccacacttgcctggagttgtctcctcccgcggccatttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagagccagagtctgtctgggcattcatgcctttagccccagctctgcaatgtgaggccacaagctaagtgctggagaaacaaaggccatgaaaggcagccctgccctcctgggct

SEQ ID NO: 472042 - DNA, 1955 bp, Homo sapiens
aaattcagtgacgacgtctggtaatgattgagagtgactgctgactggaggattattattgtttccgtcttcaaaccacagctcgcagagccagcgaccacatgatgagaaacagccatgcttcttagattttggcaagggtggctaatgtaaaaacggcccatctccaaaacatgatggatgccacataccccatggtttccaggatgaagccagacactgtctcttccatagtacctggagcaaggagaaactttcaaaaacatctgcaccctataaggttgaagatgggttggcaagaggaggacgtgcttgtgggaatcatacttgtagactgtgttattgtccagcctctcagtgggatcagaaagaggttggtttgtctggcaattgccagaacagtgcctatccgtgacctcttgtctgagcatctgccagagaaagctgtgatctctccagggaaagccagagcagactgcgaggcacctgcggaaaaacgcagcatatgcgcataccctagacacagacgtcatggtgttccgcaccagcgacttaacattcaccagatagttactgaatttttactctgtgcctagtagtcttctaggctctgggaatgcattaggttgtcctgaggcttatgaagccacctgtgatatgtaactttaacaagcatgacaatttgtttactggacattagaaacttctaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtggccgatccatgaccactccaggccccatgaccgccattctagaagtgggcgatccatgaccactccaggccccatgaccgccattctagaagtggccgatccatgaccactccaggccccatgaccgccattctagaagtgggcgatccatgaccactccaggccccatgaccgccattctagaagtggccgatccatgaccactccaggccccatgaccgccattctagaagtggccgatccatggctactccaggccccatgactgccattctagaaccatgctgattttactacatggctcctttgttgaaatgttttggaagaacatggtgtggtagtcaggcttcaacctgatcccaatgattcctgcatcccgaggttcacacccttgggcactcccctcccacactgcatcacagttggtgtgtgtgaccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctgaggttcagttgtaagttggtgtgtgtggccaatagaatatgatagaaatgacggcaggccgtttctggggttcagttgtaaaacacat

SEQ ID NO: 472043 - DNA, 677 bp, Homo sapiens
cagcccagatacgcaggtgatttagccaaggctacatgaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctgaatttggggacatgtaatgatgactgagagatcatatagtctacataaaacagctcatcatcctagaatgagaaagagagaaaccagccaataaagaagggcagtgtgtataggtactt

SEQ ID NO: 472044 - DNA, 665 bp, Homo sapiens
agctgacccgaaggcttctcctctttcctcttttgtgggggtgctggctgcaataggaaggggcagcgtggctcagatgtgggcaatggtgaccacactgtgggcctgccaccattgaaggtggagcctgtctctgctggagcagccaaggcaggctcaggatgcaagctgtcagtggttctacccttcaggggtctggagggcagtggcccccttcccatagctccactgagcagtgccccagtgggaactgtgtgcgggctccaacttcacatttccccttggcatcatctagtatctctagccacggcccaagctgtacctggggccctttgagccttggctgtagttggagcagctgggatgtggggagcagtgtcctgaggctgagcagggctacacaaccatttaaccagtctctaagaagttccaaattttccctcatcttcctgtcttcttctgaactcccaaactcttccaacctgtgccccttacgcaattccaaagctgcttccacatctttggttatctttaaggcaatgcccctcttctcattcccagttttctgtgttagttcattctttcagtgctctaaagtcgtacctgaggctgggtgatttataaagaaaagaggtgtaattggcttatggttctgcaggctgtat

SEQ ID NO: 472045 - DNA, 712 bp, Homo sapiens
ccaggccctcctccttgaagctgggatttactgaggcttctgtttcccagggagctgcatggtggctttgtgggtgctggggaaaagccaccaccagctcaaagagatgggatttatcaaccagcgccagccccagggccgggcctgcaccctcccatggcccagaaccagctgccaccatctggtccatccatatttctctgaggacagagctggcgagggaccagcccaggaaggcaggagacagagcgtctggagccagaagcctaaagacaggttaatccacatcctgtggctacagacaggcccaggggataatttggagaaaggggacaggcaagtatacagccaaggggcctggactccccatgtggagccacagactggaggttccgtccctccttgcatggctgtggctgctgagcccccactgggcaacaagaggctccagagcaaagggccagtcctgccccagcagagggagcttaaagggtaccagggctgggaatgtggggaagggcagacccatggcacctggcttcaagtcaacgccaagcaaatacctatgaacctggagccagggtccctgggggcccaggtcagtgatctgcagagccatctggctgatgccttggcctgtgctgggaaggggagggttaaggcttgagcagcccttcctggttagtgtttaacttgcagtttctgaaggcca

SEQ ID NO: 472046 - DNA, 663 bp, Homo sapiens
gacagcataaggtcaaccaggctgcagcttttctcaccctgaagagccatgcccgcagggcaatttgccccccacccccgcctggctgctctggccttagctgtgcatttgcctcttgggtgtagttgctcatttgtgtcaataacaggcttgacttccaagcctcctgccgctgccttccgggccccacctaccacttcccagggctattttgggcaggacccagtaaagacctggctcgatggtgagatgctgcctggagatgcaggttggagggaggggtcctcagagccctacttggccctgcctttccaggtggtctcacctgtgtccctgcagaatggtgagctcaccccaggaaaggagtgcatcactgagtggtggccgaaccacttccaaatacttctagaatccccacttctggctccactagagctccactgccgctctgccctgagcttccgtcagctctcctggaccctgacaacccaggggctactctcctgcttgccctctgatccctgtgcacggggttgaagggtgtcttcccagattcgtgcccacccagaaccttaccataatatttattttttaattgattaaacttggtgattactatttttaaactacagatctccttctttttttttttaatactttaag

SEQ ID NO: 472047 - DNA, 886 bp, Homo sapiens
tgtttttcagaggccaccccctagtgggctcagagttcctaaaccccatgccttcccaagagtaatttatttagccttgcagacaagctaatttacagaggagcaaatgtcatgggtgcatcctggactccttgtttctgttcttggaagactggtctcagagagcgatgacaataacggtgatgaagatgataatggtgatgtcagtgatgatggtgatggaagtgatggtgactatgatgatgataaggacggtcattatgacaaaagtattgatggtgatggtgatgatgatgatgatgatgatggggatgatgataatgtgatgaagattatagtgatgatggtgatgatggtgatggtggtgatggtggtgacgattgggatggtgatgatgatggtgtccgatgatggggatggtgatgatgataatgttgggatgaagattatgatggtgatggtgatgttggtgatgataatttatcattacatgcgaggaagtgccaaatcctctggtagttgcccaggatgcataaatggaaagtacaagcccgatcacaaggacttaaagcctagtgaaaagcaagaaaacctaatgtccacaaaatctattgcaataaatgcatgacagagaaagacagcttgtgccacatagatggccatgaatgtgaagataagttgtgagattgggatatgtgttggaagcaaaaccagcgatgtgtgttgacgaattggatataaggcagggtttttcaactttggaactactactatttggggctggatcatcctttgttttgcgaagtggtcttttgcactgtggaatgtttagcagcattcctggcctcggcaagctagatgacagtagcattacctccccagttac

SEQ ID NO: 472048 - DNA, 867 bp, Homo sapiens
cccaaaggatcacagcagtgtgcaaaagccaaaccagagggccagagctggaagtgagaggtggggggtaatcaaccagatgagaagatcaagttctgcagccattgttgaaatcaaaatagtcatcatcactgtcactatcatcattctccctatgtgccaggtactgtcctatgagctgggcatgagctccctcatggaggctttccaatgccccacaggctggacaggaagcatggtgccagtgtctacttctgatgaggcatcagggagcttacaatcatggcagaaggtgaagggggagaaggtatatcatggcgagacaaggaacaagagagagaagcctgagcaacagagcaacctgtttcaaaaacaaaaagaagaagaagaaagaagaagaaggaggagaagaagaaggagaaggaggaggaggaggaggaggaggaagatatactatatgatctatactgagtattacacctaaacaccatgttggttgtctttgtgcgggttgatgagaagtttgagctccatccccaatctttacagcatttttcaaatttccttaaatgactgtatattgataaatgaatcaatatacattgattgtccaaagcacaacattggacaatcacaatgtttgtccaaagcacaatgttgtggaaacaggataggtcattgttgcacaattttccctcttgacttcttctttctcctgtcttttctcccgaaccctctgatggggttggaaacaatgtcacacattaaagtaataatattttggaatcaatgttctaacccttccacccccaattctcctaacaatttgtggtcagtttctcttctccccacattctctcttctctg

SEQ ID NO: 472049 - DNA, 3204 bp, Homo sapiens
gccatctcacctaaccttgtattcagcttagcagcagtgtgtgctttgggtagaagctcacacagggggatctccaagagctgatgaagcaatcaatcatttggcttccagagttctcttccagtgctggggagaatcggcaatcccccctttccctgcagaaagaacatggtgctctgagttcctgggccatcgttctccctggaggggctgctgaagccacaatgctctgttcagtcttctcaagaattggcaagaaagagccttgtgcattgaaggccactgaggtcatgtcctcctgggtctgcagggctttcctcaggagacaggacttttccaaagccttggacccattctccaagacaaactcaaaggattccacagtcatgtccacggcaccttggaaacttctagggcagcacagccccctggaatgctccagggtgatgggaacattctatgcctctattgcccagtgcggaagctaccagccacatgtggctatgagcacttgcagtatggccagtgtggctgaaacactgactttccaatggtatttaattcggaatcctggattcagggcactcagtgtctctgctcttgaggtcaaaagccaagaacccaattcagaggacactctgctgtgatgtctcccagggctgctcctgctggtgggagcctcacccccctgggaccagccccagaaccccaataccttcacacagccctttccctccatgggtgtcgctggccctaaaactactgccacgtgtggctcctgagtcttttcatgggggtcagaacatttccgccatgtagctgcctctccagagccagggacagcctgtcctctgattgggggtcaccatgggccacccctggagctcgtctttgtgttgccagcaccaggcggcaccttccactgtactctgggcttttgggtccctccacaaagcgacatcttgattctaccctctcccgtgcctcctgctaagagcgtcagcctttcagattgggtgggattgttggggatggtggaggcttaaggcagcgaagaaacatgggccttaaatgggagtttggaggggctaagaaggacttagaggccctggagaccccagattccagctctgcctacttgaccatggggcaaacccatccactgggtctactaagagcccctccctcccggcactgtggggagagctgaggagttgatctgtaaaagccctcagccctgctgtgtttggaaaaaactctccccagatctgagtgccacatttatcttttatttttccacaggtgatcagagtggtggaacttccttcttcatttcccctgcccctaagtctacactagagtaaccccttgaagattcctcacaaataaacacctgcccaaccttgacagtgaggttcacccttgtgtttgttggttatcccacctgggaagggacccttccctcctgtggcggggggcaaaatggaactcagtttgcctcctctttgggggaagggagtggataagaggatcatggaagtacatgtgaattaattaaattaaattaaattcagattttaattaaatttaattcacattttaaactaattaaattaagtcacattaaagtcaaattttattcagccaaatttctcttagaataaactcaatcttttttgaggctcctaaggagcccccagtggacagatgtgtggctgtcagcagctgatcagaagagtcctcttgtaacacaattggggagaatagatttactgcctttgtaaacatttctgattcctccatgaactcccacaaccaataaaaagcaataaaaagtgaaatgacacacaaattgcatccccaaagggctgtaaaggcccaagatgttgctgcatgcaatgatcagatgagattctttgcctttaaacaaataaccctcattaacaaagagagatattcaaatgaggaggagacagggccttggggggcctgggcagggcaaggaaagaatgttctttccctgaatcttaacacagctggcacctctcatctttcccctcctcagacaggactggcctgcccacccccacctaaggcacgtactttgtgtcacaacagcctttttaagtttacctgtgtctcatctaataatcatctcactattgttttaacttgtattcctggatgcctggggatgctgcccagccatgcatgtgtttattggctgcctggaactcctccaccgtggcttgcctgttgacagtctttgcccgttttaatgttgggttgtctttttcttatgatttgtagaatttcttcatgcattatgaaaagtattactatatcttataatcaccagtctcctcccctaatagttatttcttttatttatgatgccttttgtctgtggtcaccagccatacagaagttatagttagatacagtcaactgtgataaccttttcccatgtgatttctgctttggtcttgtttaagaaatcctttctgatgtggtatgctgaaggtggcctatcatttcttccgatgtggtatgctgaaggtttattttccatgtttggtttcaaattcacttagggcttatttctgtacatgaggtaagcatctattgtattttctttccatatggctggacatttgtccctgcacaatttattgaatggtcccacagatttgtaatgccttccatatcagttaggataaagatctactgtgagaaacacaaagccccaagataaatggctgaaactagatagaagtgtatttctcgctcatgtgtgaatctggggcagcctttcttgggccagtctgctggctctgccaggaatccaagctccttaattcctagggcatgactggaaccttcatggtccaagatgaagttctcaccaacccctgagtttccaggtagcatcatggagagaaagagggaaggagggtcaaggacaggtatcagctgtatgtattctaagccaccgtccagcatttctacttcttcttttagccagactttttttttttgcaaaggatttggaaattctaagtagcccattctcagacttagagtggacatccagcagtctctaccacatcttccgtatcttatgccaaagttatatatatgcaaatatatatttctggatttttaattctgttctgcatatctagttgcctattcaaatacgat

SEQ ID NO: 472050 - DNA, 1301 bp, Homo sapiens
ctggcatgtgaagtgtgggcagcctctgggactgagcccttcacctgtggggtctgatgctacctccaggaagtgaagtatgggtagcggtgagagtaagagcctgactggttttgcttctctgtttgcttctctgtggcctcatacagagtccctggaaaagaacctgagttatctccagggccttcagacttttgctcagatcctcaatttggatgaaaagagaaaaagaagagcagtttccagtgtgacgcatctgcagtcccatggggagaggctgctggcttgctccaaaagggacctgctgggtgcggggtggaacattctggtgggttctcaatttgctgcatcccacggcgtgccccctcatgtcttcctaatggaaaacagccgtgggatgtgtcttcatgacattgggatggccacacagaagcaggtcaccaggaatggcagtgcctctgaatcctggtgcaattggaccagagagtcagtatctcccaaatgtatgggaaagtccccatcccaagaacagatcaagaaagtcttttctgacttttgccatggacaaaacaggcctaggagggcaagagagtgctgagaagggcctgggtgggcagagcattccacagaaccaagggaacactctttgtgcacaaagaacctctgtaacgtttccttgctgctttttttcccccttcaaaatgaatttgtcctgttttaggaaaaggcacttaagaggacacttgggcttcttcctcctcttggctcctgtgggtaatgctgctgtgaacacgggtgtgcaggcagctcttcaagactctgctttccactcttttggtatacaccccgaagtgggattgctggatcgttggataattctacctttaattttttgaggagctgtcatactattttccatagcctctgcaccattttacaattctcaccaacagcacatagagttctgatttctccacatcctcaccaacacctgttattacctgtttttttttttttccatagtagccaccctcctccccctgcatttgccaataaagttttattgggacatactgggacacaaccacacccattcatgtacatattgcctatggctgctttcccgctatagtggcagagctgtgtcattgtacaagaccacttggcccacaaagcctaaaatatcgatcagcttgtcctctacagaataaatctgccagcccctgacacacacacacagattcctcagtagaattcctggatttgcagtggcttctaagatcccccagtgtaactgagag

SEQ ID NO: 472051 - DNA, 1216 bp, Homo sapiens
tttggttgattgttgatgcctctgatggtccttaagcaccatcagctgctacagtgaggaactgtgaagacacagtgcctaccttccccccacttcctcatggacagtgtgtcaactttcttcactgccctgtggatgcagtgccaacctcctctactgccccatgagtacagtgtcaacctttcccattgccccatggacagtgctaaccttctcctactgccccgtggacatagtgccaatcccctttcactgccccatggacacagtgccaccctcctctactgccaaggggacacagtgtcaactttccccactgccccctggacacagagcagcagagaacggagctgcctgaccacccacagaggggctgcaggggagaagggagtggcatggctaggtgtcctccctcggctggccgggggcagtaagcagggctggacagactgtacctgtctcccctggctggaggaagggaaaggccggcggctgcctttcctagtctgctgaatacactcgccagccatcgcccttccctgtctgagtttctggaggttccagcaatccttggcgatcctccacgtgtgtcggcatctctcccatctctgccccatcatcacatcatgctgtttgtgtctctcctcctctttgtacaaggacagcagtcacattggactagggcccacgctaatccaggatgagctcatcttcacttgagtatatttgcaaagatcctatttctaaatcaagtcacaggcccaggtactgagggttaggacttgaacatgccatttgtgggacacaatccaagtcctaacaactgccaggtggcctcatcagcacttgggagcaaggactcaccttgtccatcagggagtgctgggcagactcaagtcacacccttgctgtctgcagtgccagagggcgccggaagtggggaatccatccatcgtccattactggccctggaggcacagtgcctttcctgtgtgtgcccttcccattaggctaacaggagtagtcagcagcgggaggaggagggtccactctcccctctactgagtagatgagaatgatgtataataaacacatgaattatgaatacgtaaatgatgcttctgaagttttaggaaagagattccttccttttacaagtagagctgcacagatcttactgcactcattggtttgggaagactctggttatagactc

SEQ ID NO: 472052 - DNA, 807 bp, Homo sapiens
gtgacctgaaggaccagcaggagttggccgtatggaggagggcgggcggcacaggatgaacttcctaagcagtgagaagggcgcatacaaaggtcccgtgacagttctggcaggtagatacctggaggtgtcagatctctgtgctccaagaggtacctggaaacccatgctccttccagcttgctgccaggcactcttgatgtgcggtgtggacctggtgggcctgctggaagctggccaagtctgcagtctagctggccggaaggggaaggaggaagccaagggccagcagtttccttgggaggaaggaggggaacctgctcacataccttctcctcatgtcccgccagctacgacccagctgccctctgctgtagaggaggcagggactgtggccacatgcccggctaggacgaggggaatcctaagggaaagggggggcaggagaagccagtggctgcacagtcactgaaggtgtgaggcaggggaaaaatagaggggagtggggtgggggcagagaagtaacccctggatcattggaaatggtcacactgatggccctttggagagaagggtttgggggtgaggaatgggccccgaaagtatgcagggagagggttgaaggggccatggcagtcgtgcagggagggagatgctaactcagctcatcacaaggacagaagtggcagctctgggagccttggtggggagcccacatgactcagtgcataaacagaggagggttgtctaggatgatgctggtcctctggctggggctccctgggaggagcccaggccccgtgaggc

SEQ ID NO: 472053 - DNA, 1174 bp, Homo sapiens
gagcaggaatacccaggtccacccagagctgcactgcttttaccatgctgaccttttgcattagtgtgataatatcaattttgtatagggtcctaatcaaaatgttccaagtctggctcctaatccaacaaatggcatcatctggggccgcggttactgtgctgaaggacagtgacaatcctgagctcggacctgcacctgctgagtctgaggtgcctttgagaagtttaagggacatgcgaagaggcacaggaagcagctgcccctctgtttctggcaccgccatgaccccgctccccggtagctgcacttggcgattagttcctcagtttatgtttgctcacatcaaattcaaagggcagggccattgttttgagttcataaaggtcaagagcaacaacttccaaatcagaacgaattcatcttgtcattaccaaggccaagatggtgaagggcccttacagcaagctgacaactttccaggatgtgcacatacgtgtaagtatgtgagtgtatgggcatatgcaagtgagtgtgtgtgtttgtgagtgtgagtgtacgtggaagtatgtgcatgtatatgaatgtgtgtgcatgtttctgtgtatatgagtgtgtatatgtgtgagggtatatgaatgtgtatgtgtgttcctgtgtaaataagtgtgtatattatataaatgtgtatgcataggagtgagtgtatgtgtgagtggtgtgtatattgtgaatgtgtatatatgtatatgtgtctatgtgagtgcatgtttgtgtgagtgtgagcatgtgagcatgtataagcaagtgtgtgtgtgcatgtgaaagtgtatacatttatgtgtctgtgtatgtgagtgcatgtttgagtacgtgagcatgtatgagtacgtgtgtgcatgtgaatgtgtgtttggatgtgcacgtatgtgcaactgtgcacacactggcatcgcccacatcaggacagcccctccaccgcctcatgttctcacgccttttctggcctgcacaggaaacacctgctccatggtacttcttgggacatcaactgcaaaagacggaaggtgaaaagtggttctgagcaacaggtgcaaacccggcattctgacagtggagaaattcttccgcctccaggacgacctcactcttcgctttttcattttgcattgtc

SEQ ID NO: 472054 - DNA, 1170 bp, Homo sapiens
gcaaggaactcaactcacatggtccttaggaagcctcctctccttcacccaatccttggaaccatgtgtttgggtacacagactgaaccgtggatttcaggtgtagattatgagtcaggcctgatcaaagcacatgcctacatcaaccacaataacccgggacaatggaccatggaatctaccaagacttgtgaaatagcaggcaatggttttaacatggagtcaccaaaccatgaaagtattggggaaaccaaggctcccagtgtggtggagatagaagtcagcccagccctctccgaggttcacctgctcctgaagaaggaaaatgtccacgaacatcagctgatgaaagatgtcttaatcagaaatcatgagcctccagaactgactgaccatgcgcgtttgactaagatcattcacagaacggtgcatgggtgccagctgtctgccttttccctgaatttccacagcatcccagacacagttgtttgggaccagagtctgatcagtccctgcagcccaatctgcaatagaatcctggggctgccacacgttggcatcaaccctgtggcttcaaacaacagaaattcaccctcccgcagctgtcgggctggagctctgaaatccaggtgtctgcagggcctcattctgccgatggctctcacggtggttcttcccggcctcttccagcttccggtggttaccagcagccctcagcatcttgcttgtcatcaacacgatgcatccctcccattcagtggctgactcctccctgtgtctttacatcgctgcctctgtccaaacttctccttttttgtaaggacaccagtcatgttggattagggcccaccccaaagattagggcccatcctaaggaccccatttttcatttgattacctctgtaaagaccttatttccaaatagggtcacattctgacatgctgggggttaagattccaacttatctttttgagggacacagctcagctcacaaccccttccactcccacaaagctctgttccactcagcaacacaggggtggctggagagcaatcagaactgcagtcagacatctggcagcccccagcttctggcactgacctgtcctgtggggtagacaccaggcgctgactctacgtctccatcgcgcatacctgtctccttcctc

SEQ ID NO: 472055 - DNA, 1105 bp, Homo sapiens
tgggtctctgctggggcattttccttgtcatgcctctgcctggtctcattctgaggctgactctcctttcaccagtgctaatgactatcgaccccctgggccagtgctcttctcttcccctgcccatcctgtgggagagactgagctctggtctgtctcacccctcccagaaggtggtgagaggtccctcgagtggagccaacataggccatgtgccctcctgtgcatggatccctggggccagggccacagccatgggaaatgctgatcagctgaaaccaggaaggcccccaggctcctcgagagagaatgaagtgggggtccccaaaggagatgatcggtacaccatgacagccgccttgactaccaaggtcagaatcttctcagcagagcctggtgctcctgggcattcctgggctgccaggggcccgaggaatggacagggacccccggccacccagatcctgtcccagaaatcgtaccgagagcagaccaggcggccctgccagccggcacctgccccgcctccacaccccacacctggctgcgcgggagccactcagaggctgttttgattggctcatttcagcggagctcattatttttacagggaacaatttctaaccattttccttgtctctcagggcggttgctactagctgagttactcgggccgttataaatacattatcagacacattcaacaagcgatcgcagtggacatgccgaccacccttgaacttgcgacaggccccgctgaggctagaggcaccagccccactgccaggcctgatttctttcctggtactcctatcacagctcggtgtgtgctgaatttcttgccccagcctcggtttgtactggcttgattcacaaatgtgattgaaaaccaagggcctattcctggaattcagtgacttcctctatgaagtatcagatgttgtcattcgaaactggcttcaatgactgtttactgagtttttcttctgctagtggtgctggcacatgaacagttaactgcttgactttacagacacgcacagggaagcttagctgccaagtgtgagctgagagtagaagagcagcatttgatctaaatgaaaaa

SEQ ID NO: 472056 - DNA, 1084 bp, Homo sapiens
ccggcccctagggcaccccttctgtccacctctctaaagatcagtgcagaagtttactctgtgaatgactctcctctatctgctgtcaaaaactaccacctacttgatggctttaaacggcagaaatttattctcccacagttctggagtgctaatgactatcgaccccctgggccagtgctcttctcttcccctgcccatcctgtgggagagactgagctctggtctgtctcacccctcccagaaggtggtgagaggtccctcgagtggagccaacataggccatgtgccctcctgtgcatggatccctggggccagggccacagccatgggaaatgctgatcagctgaaaccaggaaggcccccaggctcctcgagagagaatgaagtgggggatcggtacaccatgacagccgccttgactaccaaggccctggtgtgtgatgttccccaccctgtgtccaagtgttctccaaatgaggacaatttatagagggaagcaggcactgaaaataaatgaatatatatttatttatttatttatatataagatacatattatatattaaatatatatttcataaaatatattatatatttaactattatataattaaatatgtaacatatacatattatataatatgtacagcatatatatttattgtataaatttattaaaaaatatatgaagttgaccgtaaccattttaattaagacaattttctctctgcaggttcaggggtacctgatacctttacaagagaaaattcattaaataagttgtctatcttggagttgtttctctgtaagtttctcttgaatgtttcttaaattttagatacagcaaacttgtacatcttttatttttgtcccattttggtacagtttataaatgtgtttgattaaaaatagggcttcattaaaagatgccttccatacgttgagatattctgaagcaaaattacataatttcaaaattaaatcttatatgctgtcaggacactcattgttgaatttatctcatccctccctcacttgtaaggggtatatttaatgtcttcctgtttgcaagctttgtctt

SEQ ID NO: 472057 - DNA, 4847 bp, Homo sapiens
tgcagcccacagccccatgacccatggcccacagcccacagcacacaggacacagcacacaggacacagcccacagcccacagcacacaggacacagcacacagcacacaggacacagcccacagcccacagcccacagcccacaggacacagcacacaggacacagcccacagcccacagcacacagcacacagcacacagcacacaggacacagcacacagcccacagcccacaggacacagcccacagcccacagcccacagcccacagcacacagcacacagcacacagcacacagcacacagcccacagcacacagcacacagcacacagcacacagcacacagcacacagcacacagcacacagcacacagcacacagcacacagcacacagcacacagcacacagcacacagcacacagcacacagcacacagcacacagcacacagcacacacacaggacacagcccatagcctacagcccacagcacacagcacacaggacacagcccacagcccacagcccacaggacacagcacataggacacagcccacagcccacagcacacagcacacagcacacagcacacagcccacagcccacaggacacagcccacagcccacagcccacagcccacaggacacagcccacagcccacagcccacagcacacagcacacagcacacagcacacaggacacagcacacagcacacaggacacagcacacagcacacagcccacagcccacaggacacagcccacagcccacaggacacagcacacaggacacagcccacagcccacagcacacagcacacagcacacaggacacagcccacagcccacagcacacagcacacagcacacaggacacagcacacagcccacagcccacagcacacagcacacaggacacagcacacagcacacagcctacggcccacagcagggggaacaattacaatagaaagagacctaggtatagaaccgggatcaactccaaacacgccacaggcagtggagattcacagcccaggagcagggcggggtccacggatggaaagtgactaggaggaaacatcaggggctgggggattcaggctcgagtcacctaacaggattcttgctgaagctctcctcccacacggatgctgtcccagctaggaacctgtgaaccacaaagaacaaccagcaacttccgatgccgtccacgggtacccgggaccctgggatatgctcaggccttggggatgcccagcccctcgccgcctactcacagcaggacttgagtgccgctacattcaggcagcattggacctaatcgaaacaggaaagtcgggaaacttctcaggagaggtgacactcacaggagtcctgaaggactggggcaagttggccaagggacatgagtacaaggaggagctctccaagatgaagtgctggccgacgcaggggcctaaggatgcaaagccagggtttgagcccaagccacctgccggaacctgtggcttagccatgctgctctgctgccggtgcgcctgtgactttcgatcctacagcccttcagaagacggtgaccatgggagggggctgcagagagtctcagaagcttggacacccgaggaaaagaacctggcctcatacttccaagtagtttgaaaagagatgagtgtcttactagccttctcaggtaacactgggtatcttgtttgacatcacactgaaatttgacaagttggggtttctttgataagtagtggttgattaatgatgggttgtaagtggaattccatacccatgcattttgtactctattacattacaatgcgctggtttatcttactttgagtggacattttacccatgcatgatttatttaaaaggctttattgaaatgtaattcatatgctatacaattcagccacttaaagtatataattcaatagtgtaaagtgtgcatttcaatttaacttggtggattttggtgtatctgcagtgtgtgcaaccatcaccaatgtcaattttggaacataccatcacctcagaaagaaactgtgccctttagctatcactcttctatcctccttccacccccccacttaagcagccacttatccattctcagtctctttagaacatcctattctggacatttcctatcaatgaacaacacgtggcctttcctgtttggttcttacactcagcaccatgttttcaaaggttgtccgtacactcagtgccatgtaaataacattttgattaaaaataacatttgcaagttaaaaagaaattatatgaggcggctggattcttctctctgttttttcattcaatctgctgcaatatgttttcaaaggtcttccgtgttgtgccaagtgtcagcgttcccctcctgtttccggccacagaatatgatgccactgtctggataaatcaccttgcatgtatccatcatccactgatgggcatttgggtgtgtccactgtttgactgttgcgcataatgctgctattaacatgtgtgtacatgtgtggactttcactcctcattcttaacaccctgggtggggttacagagcccaggggggctctgtctaatgctgaaagccattggtgtggcagtacctggtggatagggtcagtgtgttctggacagaactgtggcctccaaagactcatatgccaaagccccaaacctccactgaacatatttggagacagggccctaaaggaggtaattaaggttaaatgaggccataagaatgtggtcctagtcctataggactgttttcttatgagcagaggaagagacataagggttgcacacacacacagggggatgttggggacacacgaggacacagccagaagacagccacctgcaagccaagaagagaggcccaaggagaatccaaccctgacagcaccttgttttggattttcaggctccagaactgggagaagatgaatttctgtcgtgtaccacccctagtctatgatcttctcttatggcagccctaggaattgaagatcgtcactgcagaactgactgtagaatttattgtccaagctagggtgctttgagtgcaaaggggccgctgtgaacccaaggaccacagctccaggcagaccagaacatatgggtcaccctgctggccaagagcccccctccctctggggaactcacttctcctagattggcaatcaccttcctaaacactacacaaagaaagctacctgccccctcttcccatctcaagccagggttaattaatatctccgatgtcccaatcccagaacacttaataactttctcatctgtatctttgggacttgatatttgatcagaggcatctgggcatggagaaaacccaatctcagcagaccctcatcccaagtccaggtttcaaagggatgcttgtctggtctatgtttgctgaaattcagtggaacaaaatggaaaataatatgagagtagagacttcatttgttggattcagccatcacagaataaattttggctaaatgaattgaagaatgactgaatctaaactgccaattgctctattcaaagagaaggtaagccaaatatgtgtgggttattatttttctaccaagtttcttagaggcacaggcatctctgtatcccgcatagcatttagcaataccttgtgtacagtcagtcttctctaaattcctactgaacaagttatgactatcatgaacatgtgtggctgtggcacacactttcctacattctgattctactaactgtcttctgggacccagacactaccatttcgcagtaatacatgggatcattttgctcctacaggcaaggaagtctagggaatgtagtttgcaggtttctaacccctgagaacaggagagaatttggaagggtggtgatggtgccgagaaccacagaaaatagccagtgacttcggagattttcaatgaacaattgtgcatttatatcttatgtatctgtctagattatgaacggcttgtgagggcagggaccaagggtgtttaatttaccgaagcatacttgggacctaggatcatgtgcaataaatgcttgctacataaagcttaagttaatagacacttgatggctgtcctcaggtctcagatgtacaccaatttcaatcagtttcactgatagtgggcctcataccaacaatggtgactgttcgagagtgcccaataggacgggttttcatagttcatcctcagcctggcccccaaggcatggttcttcccctcccattctctagatgtgaaaatcacggtcagggaggtgatgtcaatggtctaagatcatgcagctggtaggtggtggaggtagaacttgaaattatttgtttaattccccaaaaaaaaaaacaaaaaaaacaaccaaaacccagaaacaaaaacaaaacaacaaaattgtgttcttctgagtaacatgcttcttcttgcttgatacaagtgtctatactgatttcacggacctgtgtgtcctggggggcggggtgggatggcagggagggatgtgtcctggggggaggcgtgggatggcagggagggacgtgtcctggggggggtgtgggatggcagggaaggatgtgtcctgagaaggggggtgggatgacagggagggacgtgtccttgtgggggaatgggatgggatggcagggagggacgtgtcctgggaaggggggtgggatggcaaggagggatgtgtcctgtgtggtggcagggagggacgtctcctgggcgagggtgggggaatggcagggagggacgtgtcctggcagtgctccttcccagtgcagaccctggattgctatc

SEQ ID NO: 472058 - DNA, 1238 bp, Homo sapiens
tttccaacatgaagaaaagataaatgcatcaccaccatcatcaccaccaccatcatcaccaccaccactgccatcatcatcaccaccactgtgccatcatcatcaccaccactgtcattatcaccaccaccatcatcaccaacaccactgccatcgtcatcaccaccactgtcattatcaccaccaccatcaccaacatcaccaccaccattatcaccaccatcaacaccaccacccccatcatcatcatcactactaccatcattaccagcaccaccaccactatcaccaccaccaccacaatcaccatcaccactatcatcaacatcatcactaccaccatcaccaacaccaccatcattatcaccaccaccaccatcaccaacatcaccaccatcatcatcaccaccatcaccaagaccatcatcatcaccatcaccaccaacatcaccaccatcaccaacaccaccatcaccaccaccaccaccatcatcaccaccaccaccatcatcatcaccaccaccgccatcatcatcgccaccaccatgaccaccaccatcacaaccatcaccaccatcacaaccaccatcatcactatcgctatcaccaccatcaccattaccaccaccattactacaaccatgaccatcaccaccatcaccaccaccatcacaacgatcaccatcacagccaccatcatcaccaccaccaccaccaccatcaccatcaaaccatcggcattattatttttttagaattttgttgggattcagtatctgccaagatacccattcttaaaacatgaaaaagcagctgaccctcctgtggccccctttttgggcagtcattgcaggacctcatccccaagcagcagctctggtggcatacaggcaacccaccaccaaggtagaggtgcgctgatgtgcaatgtttgcttttgttttatttgatggaacatggctaattgctaagaaggtgacatgctgcccactgaccacccaatgttcattctcctcttcttccttactaacaaaactgcggtggtggtggtgaggagagggagggggtataacaaatgtgccaagccaagagtttatatttgcaagcctctcttatacctagagttgatcgtgacacagctctggccaatgatgtgtaagcagaagttgcttgatgtgacttctggcaaagctcttaaggagaggactgacctgtttccacatatctttttcctttcc

SEQ ID NO: 472059 - DNA, 1687 bp, Homo sapiens
caaagagaagacctgttactgcctgatgacaacatggctgctccaccttttgcatctcatctgcatcccagccaggactaaggacacggaaaggaaaaagatatgtggaaacaggtcagtcctctccttaagagctttgccagaagtcacatcaagcaacttctgcttacacatcattggccagagctgtgtcacgatcaactctagttttgttagtaaggaagaagaggagaatgaacattgggtggtcagtgggcagcatgtcaccttcttagcaattagccatgttccatcaaataaaacaaaagcaaacattgcacatcagcgcactgtcaaagcatgttccagaagcttcttcaagtccaaggacagcagctcagacagggaactgctggaggaagtggcttttctgctcaattaccctctaccttggtgtaatggtggtggtaatggtgatggtggtgatagcgatagtgatgatggtggttgtgatggtggtgatggttgtgatggtggtggtcatggtggtggcgatgatgatggcggtggtggtgatgatgatggtggtggtggtgatgatggtggtggtggtggtgatggtggtgttggtgatggtggtgatgttggtggtgatggtgatgatgatggtcttggtgatggtggtgatgatgatggtggtgatgttggtgatggtggtggtggtgataatgatggtggtgttggtgatggtggtagtgatgatgttgatgatagtggtgatggtgattgtggtggtggtggtgatagtggtggtggtgctggtaatgatggtagtagtgatgatgatgatgggggtggtggtgttgatggtggtgataatggtggtggtgatgttggtgatggtggtggtgataatgacagtggtggtgatgacgatggcagtggtgttggtgatgatggtggtggtgataatgacagtggtggtgatgatgatggcacagtggtggtgatgatgatggcagtggtggtggtgatgatggtggtggtgatgatggtggtgatgctggtggtgatgaggaggagggtggtgatgatggagatgatgatgatgattttttattggtatataatatttgtacatagtttgaaggtatgtgtgatattttgattcatgtatataatgcataatgatcaaatcagggtaattaggatatccattcccttgaccatttatcttttcttcatgttggaaacttcccaatgcttttcttctagctatttaaaaatgtacaataaattattgttgactatagtcaccatactgtactattaaacatgcgtattaaccaacctcttgaggacttttattgaacgaccacagctctaccttctagatagaagcacaaccctgaaagatgcattatctagccatcttagaattagaggtgaaccccatcactcctacagcccagtgttatttacaagtccccgcctctggtgtccacctcattgatcaaggatctatgttgagctttggaggcagaagaagggatgcaaactcagcatgcttcatgggaaacatgcttcttctttctcacaaattctgacattatcaagtttaggggcctgagaaaaacaagacatacattatcttctcgagttgttggtgcccgtgagtgtagaagattgtatgacggtgcagtgtccc

SEQ ID NO: 472060 - DNA, 1019 bp, Homo sapiens
cggtcacaggcactgagctctgccaccgacattgataatgaaaggaaatgccaagtctcagttagggttaaataaagatgccagttttcccccatacgagttgaaagaccctttgaattctatccaagtaccctgggaatctctggacaaagaaaatagtagaaggaagtgttttctgacaaccgagatgggaacaagccctgcagaagtctccaggcgaagtcagagccttaagactacagctgctgccccggatgttcatgctgtggaaagttcttccggtcaccctgctaattctggccctttctccccgctgggggaagtccacagcctggaaccctggggaacccctgcggtctcctcacctagtcccctcccctattttcccaacaaaggagccagcaggcccctgcaggaggtcctctttgaagctctctgaggccatttatctaatggccttcacagacttgactatttttaaaacccatccaaagccaaattgagctgccattgttcatttttctcccaaggaggagaggtgtgtgtattcactcatcttgttgactgagccctgagtagaggaggtgagagtatgtactcatcttgttgactgagccctgagtacaggagttggaagtatgtactcatcttgttgactgagccctgagtacaggagttggaagtatgtactcatcttgttgactgagccctcagtacaggaggtgtgagtatgtactcatcttgctgactgagccctgagtagaggtgagagtatgtactcatcttgttgactgagccctgagtaaagggggtgagagctgcactcatcttgttgactgagtcctgagtatgggaggtgagagtatgtattcatcttgttggctgaactctgagtacaggaggtgggagtatgtactcatcttgttgactgagccctgagtatgagaggtgagagctgcactcatcttgttgactgaaccctgattagaggaggtgagagtgtgtactcatcttgttga

SEQ ID NO: 472061 - DNA, 1238 bp, Homo sapiens
gttttccccaaactgatgttactagcaaatgtgctggtggtgaagacagcggtcatttgtgagcgcttgcagtgcggcaggcaccgtgctgcttgttcgcggggatggtctccttttactctgctcctggcatcttccatgccagctgggcggatggctgtggctgcccatacgaagcctgcatttcctatgcgttctcacgtgtgttgagagcagaaccaaaactggataaatgcgttcatctgggggacaaagattcctcaggatcgttacattggactggaaaaaggtgtggcttaacacttgcggttgcaatatcctctgtggattttatgaaaacatactgcaatgcaatcatcatagaactcatcaaccctgaggaagacctcgacacaaaggggtcagctgttggggtctttccattggcaaactccctcgctattcttgtattgttcatggactcagaagcacgtctccagcctgctcaatgccagattccagagtcgcagagattcaaagacataacatgccacagtcatggctacgtctgagcagccccttcctgatttgccgaccaggactcctgtggttgacatcattatgaggttgttatggtggtattactggttaatattatcaccactgtaattgctgttcatgtttaggcaatatctgtgtttccaagtacatccaggatgccccccctttcccagataaccacatttacttattttaattattgacagggaagttaattgaaatatgggacttccacagaccccagagtcttccaatgctctgatcccagacaatttaaataattctgccaataaaaattcaacgagatgctatcaaacattttatgagtccgaacagacaggtcccactgtgtctaaacatctctttttggaactctcgttgagaggaaacaagcaagtgtgaatgcccagcaggatttgttctcgagtccccttttcttagagtgcaaaactcctgaatctcccattccttctcctattttttttttccattattttatttacttgaaaatatcctgctaagtgacttctaagagcagctctgttccacatggtatggagctgggcctctttctcatgaatgccttatttaccagctcgctaaggtcttaggaaaattggcatcttggccctgagaaaacaggaggttgttgcaatccagctgccagctgctcgacctcgggggtgggggagtaatta

SEQ ID NO: 472062 - DNA, 635 bp, Homo sapiens
tttaggtagaaagaccttagcttagcatgagactgaccacctgtgcccatgggcacccaggagctggtgtctgtggaggaccgagtgcttgacctggggagtctgacactaaccctgggtggttggcatcagaattgcatggcagtgcacccagctggggtggaaatagaacagactgcaagaatgaaggaagacatagctgcggacataaaaccagccgagggcctttgcttatctcaggggctgcggccattccacgtggagatttgcattctgcagagaagagtgcctctctgccatttgttggcttcctctgctgacttcgtcctgcaggctgcagactttatttcttccctgctaggcccgctacctgaggattctctgaaacatggtgcaggggactcagaagaaagacgcatgctgtggcccaaagagaaacttggtcttcgggattttctccagagagcataccaccctctctgaaggttttccatgatggtagatcgtcacgttggttttacggaagtcgtccaagccatccaggccaatttcagggagggaagtgacaggtccccttgagggagatggcacctggcttacttgtgggatttgtaagtggattcaaattgcagctt

SEQ ID NO: 472063 - DNA, 1037 bp, Homo sapiens
catctagtgccctccctgattgcctctgggctggcacagggctgccgtcatgagccaggaccatgggaatcattgttctgggcattagtgtacttattgtggctagtggtgagtgggaagacattgctgggttaatagctgtaattgttgactcatggacaatcaatcgccccagcaagtccacagtcctgagtgactgcaaagagcagcaagtgccacattgctaccacaatcggcaatatccaccaaaaccctatgagctgcttatagccatccctttggagcttggcctcatctccttcactgctgtcataaacactgggccttgggcaggtgggtcatggagcggaactgcagaacccattggtgtgggctgggccaggtcacttgttcacccacttgacctcatagtcctgtcctgtgatggcatctgtctggctggctccactctgtgcttcccggatccctaggatagatgctgagatgggtcccagacccccgagactgagcacggccccatcattctcagtttccaaatctctttcctagacaaggatccaacattttcttgcctttcacctgcaggaaattaggaccattcataacttaagaaatcaggctgttaccgccccactcccaaaacacctccctgagtcctgtgcaggctcaatgaggtctttgagagagagggcactgaaaatgcagtgagtcaacttcagaagaaaaatggagagctcaccagagatgcattttcatgagaaggaatattcaaggaagaaagacttctggaatccgtagaaccatgcccgaggtctactagaaagctctgtgaatcacaaacacagtcaaatagttttatgactgatctaatgcttttgacaggttgctccacagagctgctggactcacgagctattgataactgtacttccagaagctaaattcaccagttacacacatttgatagggaacatacttttctctttcttgcttttatattctttttctctcctcccctgcctaaattttgtgtgctc

SEQ ID NO: 472064 - DNA, 2123 bp, Homo sapiens
ttgggttgcaagaaagccccctaaagacaggacctgttacagctggcaggtattctgggatgtggggatggaaagaacacttttctgcagtagcccatgttggggctgtgtggccgtggccatggagggcagacgcagcctctccacgaggccacccacactccagtgacggtcacaccagaagcatccctggaggtcagagcagggcaggggaggcggtgtacccttccatcctcacaaggctttgggccaagtgaaaccccctccctcggaggccccccttctgggactacaccttccacctgaatcttgtgccagcaacagaacttcttcctgcctttccagggggcagtaactaggtttgcatctgatggtggtcagtaaaagagataaaggacgcagggccactgtttggaaaacaacccatggaaggaccccccacccaaccccattgattcacctacctctccagccacccaccctccttccctcataataatctcctcccagatgaaggagctttcagagagccaaaagggaaggtggaagacacagtctcttttggtggacacggggaagcaagatgaaaaaaaccacaggacctagtaaggtaccgtcaagatccacccagccacctcccctcccaccagaagtgattgaagcccctcttcctggctcttagagaaccgcaggggacccggagcagacagcaggcctttctgatgcttaaagttttagcatttaggacaatgccctgtgcttatcctctgtacacccctagcttcctggccatctttggagttcattcattcattcattcactcactcattcaacaaatctccactgaacatcaacagtgtcactggcactgctccgaaagcaggggataaactgatgagcaaaacagaccaaactgcacctccaaggaccttttagccaggggaggagagtctggcagttggaaagcgtgtccacagtccccagggaaccaggaaccacgtcctggggagcagggagcttgtggaagaactgaagctcagtaaacaggtgactgaggtgggggcaccacggggtcagagtctgcagggcagtcaccgctggacatggttgaggaataacggaggagactccaggcatgagcgagtaggggtacttgtgacacaggtggttcaaaatcagcatggagcggggactcagagcaagggtgtgagccgtcagactgggccctccaggggtgacttcgttccctatctcctttcgcgtctgagccctccccacaaaactggttctgcttggcaccctgccctgtgcctgaagctaagcctcaaagtggcctcctgggctggagccagggctaactgcggcagtgacaccacgctgatttgcttcattgaagatgaacatttatgataccagcacctcctacaaccttttcttcattgttctgtgtaacatggaccattttctctccaacgttgcccttcttgagagaagggtgataaatacgttgaagcccaattgtctttattattcacaaggtgaaagtcctttcctggtaccactgtcaggctctccacctccaaacatcaatcactctccatccccaccctgcccgtcttccaggtcattagtgaagggctgtgtctcctcactcagcctcagagtcaaaactcggcactgcagcgtgctggtgtctggccccgcgaaagtggtcttcctcagcacccagagctaccagatgttagcattgcctcgaaaacaggtgcacactggacctctcagggtggagcccagtctgatgactctgaagcccgtgagtgtgactgccacactgctccctgccccacggtcctgccctctcccttacaaacacacccaagagtttcccaaggggagactagacccttctgattccattcagtacaacagaaatttaatgagcacctgcagtgtcttggagatgctgcttggcaccagggccacactcagaggggagcctgtccagaatagatgactgctgtgcaatgagacagatgccaagacagaggctcacctggatatgatggggtcaccaaggtgacagtggcacctgctcacccctgcccagcttctgggatgggag

SEQ ID NO: 472065 - DNA, 832 bp, Homo sapiens
ccctattttcaaatgcggtctcattctcaggcactgggagttgggacttcaacatatcttttttggagggacagttctaccatgacagtcatttggggaggaattgggcccatccagctctcagatgtcaccgagaacaggggtcatgtcactgatggttttgggttctttgtgactgcagataccctggcctatctggatagatgcactgattttatgtattttccagaagaggtatataaagaagtccccgttctaatcctggaaacctgtgaatgtgacctttcatggcaaaagggcctttgtggatgggaccaagctgaggatctcgatggggaggccatcccggctgatccagggcgaacgatctgagattttaagtgaaaaagcaaacatgttttaaaaataatggaaatggtggtgcggacctgggcagtatcctgttgggggtcgtattagaatcgtcagcaattctaacaggtgcaagatgtaattagatgcccgatgtttgatcgttccatttcattccatcaaaactgcattatgaactgagggacgattagtgacaactgacagaaatggtgtggaggcatggcctcagcccctggcgggagtctggccccacgcatctgtcaccagttttgttatcaagtttgtactactcttatacaataagttgggcagttttccttcctcttacatatatttctgtaatagtttcattatgttttttgagagcttggcattacccatccttcagtttgttaaaaattgcctataaactatttctcattggtgctttctgagggaggaagggatgcttctgacaatc

SEQ ID NO: 472066 - DNA, 664 bp, Homo sapiens
ccttgcctttcaaactggggcaggggtgagagtgacagtaaggagaggaaggactgggagggagttaatggtagctctgctggtgttccttgtatatgaaagaatgttttgcctctcataggtgggcttgtgtcctttactgtttctttcacacacccttgctcacaatcactctcctggaagaaggacctccccttgcctcttcaaatcttaccaatccattggccaggacccaacccaggtctcttcctatgaatccaactactcagaaagccttagcaattggcttacctgaagggcctacccttaagccagtttcaggagtggtggaaatatggaacgcaaaacagaaatggcaagaaatgtggttgagtaggatgtgggtgggaaaccagattataaacacctttgaatgccagattaaggagtttgggcttgctcctggggacaggggagtccaaaagaagattaagccattgacacataaactgaaccatagagatgaagaattgcttatctcaaattgttttaaggtacaaaccagtctcttctactgaacgatgcatacattttctgagggcaaaattcctgcctaatattttcttggtgtcctcttttttttcttttctttttaaaaatagagatagggtcttgctgtgttgct

SEQ ID NO: 472067 - DNA, 533 bp, Homo sapiens
gtgatactctcccgtggactgtgatgcagatgattctgttcaactagaggccaataagaggagtggagaggaatggagcacttagggccaaattctgaagaatgccgacatttaaagacagaaagaggtggaaaagagacatatgaggaagccaggaaaggaaagtggggaaggagggacagcactggcctctgcagctgggctgaagtgggaattgtaggtgctacacctgggtacagaggtacacacatgaagatgtgctgcccagatcttcctccagagaagcacttgctgtgcagctgtggggaatgtagtcagcagacaacctttagctgtcagctccttcagagtctgcctcaactgcagagagctgccttgtccgagatcatagcctttccactgcctcctgtatctggtgacctggatattgaaagagctggcctcttcagcccaatgctgggcactctgcccaaggaaacttgctccaaagctttctgccaggttggctgaggctttgttgggcctcatcttcc

SEQ ID NO: 472068 - DNA, 921 bp, Homo sapiens
ggacctgcgcaaacaccagcgcaacatgcacagcaacaataagcccttcccgtgctccgagtgcggcctgaccttcaacaagccgctgtcgctgctgcgccaccagcgcacgcacctgggcgccaagcccttccgctgccccgcctgcgaccgggagttcgctgtggccagccgcatggtggagcaccagcgcgtgcactcgggcgagcggcccttcccctgccccacctgcggcaagtgcttcaccaagtcctccaatctgtccgagcaccagacgctgcacaccggccagaggcctttcaagtgcgctgactgcggcgtggccttcgcgcagccctcgcgcctcgtgcgccaccagcgcatccacactggcgagaggccctttccttgcacgcagtgtggccaggcctttgcccgctcttcgaccctgaagcggcaccaacagatccactccggggagaagggattcctctgtgccgagtgcggcagggccttccgcattgcctctgagttggcccagcacatacgaatgcacaacggagagaggccctaccagtgtgaggactgcggccaggccttcaccaggtccaatcacctccaacgacaccgagccaagcacggcacctgcaagaaggagcccatcccttcctcctctgacgagtgaagatagcatcgtcgacctcactacttggaaccttcccagaagtggtccctatgatgaactcccccaaagcaacgccgtttttggaggaactcaaacccagtccaacatcccatcatttcacttgactgcagaaatggctttacccttaggatatatctttatgagtcttggctttgaagtggagaagggctttatcttagagaaggtggtttatgtcatattccagttattctagaagttcaggacagccttagcat

SEQ ID NO: 472069 - DNA, 1775 bp, Homo sapiens
ggggtttgagcagcagggcaccgaggaaggtttctgctgagaggtccactgctatgttcacggcggccagtcggagtgaccagccaccccctaaatctttaatctcacgggcttccttttgtgggctggtgtgtggccatgggggccgccccactggagctctccaccagtcaggcacagtctgccagtgcagaagctatgatgtagatccccacagcacccaaggctgctctgcaagcaggtacagccaggttgtggacctggaagaggccagcaggccaaggggtgctcaggttggactgactcagtctgataggcaagactgccttgcagagtccaggtccgacagttcctctaaggctaatgtttcctatgggagcaagctgagccttgaaggatggctgtgcctggccatgctctgctacaaatgctcccgcaacaaaccctctgggccccacatcagctggcttgtttcccctacttctctaagcagctttccctgccaactcaagtgttggtaatgggcaaaagttctcctcctgctgggtttccagagggctgtggtgagaacaggttactccttgccagttcaactcacctgttcccctggagtcattgtgtgccaggaatgagtcccagtgttcagtagccctgtgcaggcttcctagcttccacctgcttcagaccagcttctgcactgtccctccgtccactcttggtgcctttcctctgaagttgatctagtttcaaaacatttttttcaccccctccccaaagaacttcattcttattaagaagtcacttcccatttctccccttttcacagttcctgaagaaccaatctgcttctgtctctatggatttacctatatttcatataaatgaaatgatactctatgtggccttttgcttctggctttttcacttaatgtttttgagggtttattcctgttgcagcctgtatgatgactattcttttttatggctgaataatctttcattgtcagtctctcctacactctgtttattcctctgtccactgatagacctttggaatatttccagcttttgtgaataaccctgctatgaacattggtgtacaaataactgttttaatacttttgggtatatacctaggagtagaattgctggatcatatattaattctatgtttacctttttggggaaccacaacactgctattcacagtgtctggactattttatgttcccaccagcgatgtacaaagattctagtttctccatatcttcaacaatccctgttattttctgattatattcatccttgtaggtgtgaagtggaatttgcatttccctaatgactaatgatgtggagtagcttttaatgtgtttattagccatttattggtatatgttctttggagaaatgtctactcatgtcttttgcccatttttaaattgggttgcttgacttttggttgaattgtaacagttctttacgctctggatactagatccttatcatatacatatatatgagaagataataagagaaaatatatttactcttattctgtaggttgtcttctcactttatctataatgtgccttgatgcccgaatgctttttacttttgatgaagcccagtttatcttatttttctttcattgctaatgcttttgtgtcatatctaagattccattgacaaatacaagataataaatatttgttcttatgttttcttctatgagttcagggttcagttttaaattttccagtaaagatttgcactgg

SEQ ID NO: 472070 - DNA, 768 bp, Homo sapiens
atttggcgtacagattattttgtcacccaggcacgaaccaccatgcccagcctccattcttcttcttcttctccttctccttctccttctccttctccttctccttctccttctccttctccttcttcttcttcttcttcttcttcttcttcttcttcttcttcttcttcttcctcttcttcttcttcttcctcttcttcttcttcttcctcctcttcctcttcctcttcctcttcttcttcttcttcttcttcttcctcctcctcctccacctcctccacctcctcctcctcctccccccttctcctcctcctcctcctctcctccttctccttctccttcttcttcttctttttctcttcgtcctcctctctggcacaatactggcttatacttagtccaagaccaatgtacacctggtggcagttacttaagtttcagacatgctataaaacacagcaagcatcactacttgcattattcattctctatttaccatgcattggcttaaatttgtattgcttatcctgtcacatccatttctgtggccgaacaccggagagtcccttgcaaaccactggtgtaagcccaagagtccaaaagttaaagaacttggagcctgatgttcgagggcagaaagcattcagcacgggagaaagatgaagactggaagactcagcaagtgggcttctctcaccttctgtctgctttattttagcagtgctggaattgattagcatcaatggtctttacaatttggtatgcttt

SEQ ID NO: 472071 - DNA, 559 bp, Homo sapiens
agccagtctactctctctggattgttcatccactacctcgatattctgctttgaaaacagtgagcaagcaaatgcagccgtcacagcccaacaaaggaaaggcgacccaaggccagaccctctgggatgaaattctgggattcccccatcaggcaaataaattattaatagatcagataatgctgatcaaggatagggaaatcgagagtgggtggtggatgagacaactgacaaatgtcatttggagcttgggaccagttctcaagtgcaagtcaccagtttcttggtgtgtctctactccagagctttctcagaagataaaggagcctgctcagccagcacacaaccatggcctggaaatgtggagacagttacagcttccaggggcagttctcaaccaatgggatcagaagccagtgaacaaatgccccagtgttccatctttcacttgggcaattccgagagatccaaaagaatcaaaccccaggtacttactgctacaaatggtgacattgcatccttatacttttccttcttccctgtctcactctccctgacc

SEQ ID NO: 472072 - DNA, 597 bp, Homo sapiens
ctgaggtgatctcagatggagatgagggacttgttgaaaactaaagcaaaggacttggtgccctgcatcccagctgctccagttgtggctgaaagaggtcaacatagaactcaggctgtggcttcagagggtgcaagccccaagtcttggcagcttccacatagtgtggagcctgtgggtgcacagaaagtcaagaatgggggtttgggaacctccatccagatttcagaagatgtatggagatgcctggatgccggacaggagtttgctgcaaggggcagtgcagaaggaaaatgtggaattggagtccccacacctagtggagctgtgagaagagggctaccatcctccagaccccagaatggtagatccacctacagcttgcactgtgtgcctggaaaagcagcagatactcaatgtcagcctgtgaaagcagccgggaaggaggctgtaccctgcaaagccacaggggcagagctgcccagagaccatgggaacccacctcttgtatcagcatgacctggatctcattttattactgtatgaatacagtatataatacacataacatacaaaatatgtgttaatcagctgcct

SEQ ID NO: 472073 - DNA, 792 bp, Homo sapiens
cgtctggagagaaagggctacagaagctacatgagtaaaaccttccactctcatagctccagccacccagtacgtggcattctgttatggtatccccagcagattcatacagacccctaccatgacctgaaccccctcctcatctctgttgttgaaagtgaaaacatgagcatacatatctatggaacatggaggggaagccatgaaaacaatcaatacttccagcaaaatggaaagtgtttaaaatcattcacattagcaaaaagggaaaaagaagaagttaacttccgctcatcaccagctgaaatgatcgtacaggatcctgcaaaatatctgggtagctccaacataaataatcttctgtcctctggggaaaattcttttttcactctatggcttcagaaaaactgttggcatagggaggacatgggagaagaagatcatggggaagaagatggctccacaggcttttctccatggattttagaaacaccctctaaagctcctcctttgagaactgttagaagcctggaagatgagggaaaggacaacaccattgacgtcaagggccagccagttttaaaggcagcatcagaagatgtcgtggttcttggctgataaactacacttgctcattggaaatagagacaaaggcctgaatcaaaactacccccctttatttatctgtcaaggagttaatgagaaacaaacacttaaaagcattatagagccttctttatttcagagaatcttaaaggggaaagggacttcagagcttatctattgcattgg

SEQ ID NO: 472074 - DNA, 1838 bp, Homo sapiens
tttttatcacaaaataagtgccctcaagtatttttatgtggctccccagccagatgtgggatctgtgactgctttgaccaatgggatacagcagaagtgacgctatgccagtttcaggcatagccgtttactggcctggaagtatctgtcttctacttattggactgttcacttttggcgttctctcacttaggacccagccattgtatttcttctttacagcaacactcagaagagttgatattcagtgttgcaattcctctttaattctcactcctccaatctgcttttcttctccaccaaacaaccaaactgctttcatcaaggttgctgatgacgtccatgtttctgaattcaatggctacttctcagttgtgaaaggactcgtaaattcagtcactgtagcacagtctaacctctttgaggaactggagagaatgagaggtatcagaagacgacatgtgagcaagttttgccctaactcaaaacgaaataaaaatatggattagggaaactttacaccaaataccaacccctacacttttttgtttcccatttgtttgatatatttttctccatatctttactttgagcccatgggtgtcactgtatgtttgatgaatctcttgaagatagcatataggtgagccttccttctttattcatcttgccactctgtgccttttagcctatttatgttcaaggttaagactgatatgtgcagatttgatcctgtcatcattaactggttgttatgcacagtccattgtgtagtcgctttatagtatcaatggtctatgtgtttctgtggtgggcagtaacagtctttgtttccatgtatagtacccccttaaggatctcttataagacaggtctggtggcaatgaattcccttagcatttgcttgtctaaaaaagattttattttccctttgtttatgaagcttagtttggttgaatataaaattcttggtcaaaatttcttttctttaaaaatggtgaatatgggccctgaatctcttctggcttggaggatttctgctgaaaagtctgctgttagcctgatgggggttccctttgtaggtgacctgcctcttcctccagctgcctttaatattttttctttcatgttgaccttggagaaactgatgattatgtttcttggggacagttgtcttggatagtatctcatagtggttctttgaatttcctgaatttgaacgtcaatttctctggcaaggttggggaaattttcatggacaatatcgtcaaatgttttccaagttgcttactctctctccctctctttcaggggtgccaataagtcataggtttagtctctttatattattagcccatatttcttggaagttttagtcattctttattattctttttctttatttttgtttgaattagttgattcaaatctttgagtcaaagtctttgacttctgagattcttttcttttctgagcttggtttttctgctgttaatattttcaattgtattataaaattattgtagtgagcttttcagctctatgggatcggtttagttttttcttaaaatggctattttgtctttcagctcttgtatcattttttagattctttagattccttggattgggtttgactttctcctaagtctcgatgatctttgttgctatccagattctgaattctctgtctgtcatttcagccatttcagcctgctaagaattattgctggggagctagtgtggttgtttggaggtaagaagacactccggcttttagatgtaccacagttcttgtgctagttctttctcatctatgtgggttgatattcctttga

SEQ ID NO: 472075 - DNA, 2721 bp, Homo sapiens
tgagagtcaccatgatagggagtcatcgaaaggagtgtgtcatctctctcaggtttacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatcctgctgcaggagcccatgcagaatggcagtctgctgctttctaacagaccaacactgcccccaaacaagaggatggaaagaagggctgtggaggagacacagaaggggatcctcactgttgctgccagtggcagctgcctgaagactgccagaggtactgtggaggccttccctgcaccagcccccaccataggctaccaaatcgttggcgatgagttagaagtgggagggagaaaggccaacatcttctactccttctctcactacttctggatatttgagcacattaacctctttgggcctttcctcataatataaattaggcctgctatgatggaatatcatagactgggtggctttaaataacaaatatttatttcccacaattctagaggcgggaaagtacaaggtcaaggcacctgcagattcagtgtctggtgagggccaccttctggcttacagataatggtcttctccttatatccacatataccaggtagaagaacactagtccccttcatgagggctccaccctatgcaacctaataacctcccaaaggcctccataccatcatattcaagattagccttcaacatatgtatttgaaggggacaaaaacagtcagttcatagcactcatctataaaaggaagcaccctccagctctgtattctatgggcagagtagtggtaagctacaggtatataatttttagaaagtctaatcaaactttatcttctcttgattggtttttgtaatctacagtttgtaaaaccctacaaaataaattctcacccaaagcaacagaattttctaatggtatttagctttaagttgtgttgatgcaagtgaatgtatgaaatcagcttcagataataaatggatatatggttattcatcaccaagatggacacatggaaatataattagttgtgtctctcattgaaacctaacatatttattcactaatatattttttaaagtatagctatattataacatatgaatgtaaataaataataaacttatttagttagctacaaataagtctcatttatgttcctgagaaaacccacactatcaaaaagttgtcatgactatttcactacaagtaacagaaagccaatgtaaactaagttaaacagaagggaattgtttctgctctcgcatctgggaagggcattgaaggaatcccttgaaaccaaagaaaagatatgaacaccaggtcctggaaacctgggatgcaggactc

SEQ ID NO: 472076 - DNA, 1069 bp, Homo sapiens
agcagcagagctaaaaatccaggactgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatgtttgcactaaggttctatattagctagtggctaccctaggcagtactaaaattaagcacagaagcctggtcaagctgcttacacttca

SEQ ID NO: 472077 - DNA, 851 bp, Homo sapiens
gcagaaaagatgagctctccaggaactcgccctttcctcctgccctctattgacaaaaatcttaatttgtgtccatttaaacatacgaactgggtgactgctgaagtattctgcaccaatttaatcaatgaaatggttgcaatattctcacactttactctcctaagagtgaaaagtcatggagctggagacatgtttctatcttgcactaaaaatcaccattccaaacaaatgatcagacaaaggtttggggagttaattatctatcagtttgacccatctagatatatttcttatgaacaagatttggagctgactaataaccagtcttgggagaaaccttgggacttttctccagagaatgaagattgtatttctggtgttctacaagctctacctaaagattctacctgcgtaacatggataaaaaaggagacacagcactgctaatgatttcattttccggtaatcaattacagctatttactccattcaccgtttccagaccatacttaccacctggttatttttagatggcatgaaaaaattactccaataaatgggatatgggagatgatgctgagcagcagagcgtttgcactatatgtgaccataaatcaagatgatatgttactaaaacagctgtctggatatgatggaaagcagattgtggccacctgcccaaaagttggctgtggctagaaaccagtttggaaagacagcaaatctctaattgaatagttaactgaataatgaccctaacggagtaccattcccttcaataatgctgctcatcagttatcgttagtgttagtgtattttatgtgtggccaaagacaattcatcttcca

SEQ ID NO: 472078 - DNA, 516 bp, Homo sapiens
ggaacgccacatgactatagggatgctcagaaaaacctggcagggactgagcacatcttggaagaaggttcgaccatcctcctttggctcggagaagtttgtcattactgatcgaccttctgctgcaggtctgttggagtttgccggaggtccactccagaccctgtttgcctgggtatcaccagccaaggctgcagaacagcaaatattgcagaacagtaaatgttggtgcctaattctacctctggaagcttcgtctcagaggggtaccgagctgtatgaggtgtcagttggcccctactgggaagtgcctcccagtaaggctcttggcttcatccttgaatctctcattatcttacactccatatctaatccaggagcaggtcttgtcagccatattctcaaagtagacccagaatgtgactaactgtcaccagctctgctaccactactctgatcacattatggttacattttactgaatttaacatagaagcctcttatttggttctgctg

SEQ ID NO: 472079 - DNA, 863 bp, Homo sapiens
gcattgtaccttggaaggtgcactcacacacaccgacacactctcactgggaccatgcaggaacactgattcacctaacgggcacagcttcgggatgtgggaggaaaccggagtacccggagaaaacccacacaaatgtggagagaatgtacaaactctgcacaggcagagtcctcctccgggaatccagttcttttctcatcaaccttataatcaaatgacattgaacgaagtgatacaatttgaggacatgctgtatatttattacttatttgtttatagcctgacagaagagcagtttcctcaaaaaccagaagacactgtacaccgagaagatgactttaatagaagtgggaaagagggcaatttgtcttatttcctacctgatcaattaataataaccatttatcctctgggtgccttctatgagccaggtggcattttcctgctgccatatgcccatcagtctataccaagcttcagtattagtcacttatcgagttactgactgaagctacctgcatttgaacagaacacatccacaaataaagtattttaatagtgaaaagataataatagtttcctggcaataataacaagcacatgggggctatttcatctatgagagagtgtgtatgtgtgtatactgtgtgtatgttagtgcttcagagatgcttgatttcctaacagaagatggattttttggtggaaaattttccttttcaaagttaattacttcagtcatgtttgaattttgtataaattgagtaatcagaaaaataaatactaaaactcaggaggactgtcaactttgcctaagtaaaggcttgtctgatagatccataaattaagaaacaaaatac

SEQ ID NO: 472080 - DNA, 609 bp, Homo sapiens
gaaaagagtcagcgaagggggataaggatggggctgttttatacgattggggtagtgggctccatccatttcgaacttcctggtggctttgtttacactgtgagggtaaaaccacctactcaagcctcagcaatggcagaagcccctcccacaaccaagctccagcatctcaggtcaatctcagactcctgctgtgctggcagcaagaatttcaagccagtggatcttagtttgccaggctctgtgaggcttgccctccgcggactgcacccactgtccaaccagtccgagtgtgatgaaccaggttggaccagctccatccgatgggcaagaccaccctacagaggtcagaaccaaaatctcctatgggagcaagttgagcctagggaaatggctatccctggctgtgctccactacagatgctcctgcaccaaaccctctaccactacagatgctcccgcaccaaaccctctaggctccatatcatcttgcttactgccactactacctctctaagcagctgtccttgcaaacttcagtgtccttggtgattgatctcctcctgctgggatttcagaggctcatgattattctagtgtggaagctgc

SEQ ID NO: 472081 - DNA, 524 bp, Homo sapiens
attggatactataatcgataaagcagtgtgacaatggacttaacacagaaaataggtaccagagaaatgggatatttccatgggacattgctaaagatacctgaaaacgtggaagcgactttggaactgggtaacaggcagacagacttgttgaatggttgtgaccaaaatgttgatagtgatacagacagtgaagtggctgaggaggtctcagatgaagcctgtgaaaagagctatggggctgtatgctgcagagtcacaggagtgggggtgcccacagcattgagaacccactctttgcaccagtgtgacttggatgacaggtctgatattgatgaaatccctcagcttttgtctgggatcttttctttatccttgacctttgggagtttgattattaagtcccttgagtcagtcttctttgggctaaagtcttggtgttgtataaccttcttgtatttgagtattgacatctttctctaggtttgggaagttctctgttattattcctttgaataagcttt

SEQ ID NO: 472082 - DNA, 1311 bp, Homo sapiens
ccgtcgtagcaaatggcacaccaggagattatatcccacacttggctcggagggtcccacgcccacagaaccttgctcacttctagcacagaagtccgagattgaactgccaggtggcagtgaggctgggggaggggcatacaccattgctgaggcttgcctaggtaaacaaagtcactaggaagctcaaactgggtggagcccactgcagctcaaggaggcctgcctgcctctgtagactccacctctcgggcagggcatagctgaataaaaggcagcagaaacttctgcagacttaaacgttcctgtctgagagctttgaagagagcagtggttctcccagcacagagtttgagatctgagaacagacagactgcctcctcaagtgggtccctgacccccgagtagcctaactggaagaaacctcccagtaggggctgactgacacctcacagagctgggtgcccctctgaaacgaagcttccagaggaaggatcaggcagtaacatttgctgttctgcaatatttgctgttctgcagccttggctggtgatactcaggcaaacagggtctggagtggacctccagcaaactccaagagacctgcagctgagattcctgactgtcagaaggaaaacaaacagaaaggaataacatcaacaaaaaggacattcacaccaaaaccccatatgtaggtcaccatcatcaaagaccaaaagtagataagaccacaaagatgggaagaaaccaaagcagaaaagctgaaaattctaaaaatcagagtgcctcttctcctccaaaggatcgcagctcctcttcagcaatggaacatagctggacggagaatgactttgacaagttgacagaagtaggcttcagaagatctgtaataacaaacttatccgagctaaaggaggatgttcgagcccatcacaaggaagctaaagaccttgaaaaaagattagatgaatggctaactagaataaacagtgtagagaagtccttaaatgagctgatggagctgaaaaccatggcacgagaattacgtgacacatgcacaagcttcagtagcagattcgatcaagtggaggaaaagataccagtgattgaagatcaaatgaatgaaatgaaacaagcaaacgctgagagattttgtctccaccaggcctgccttaaaagagctccagaaggaagcactaaacatggaaaggagcaaccggtaccagccactggaaaaacatgccaaattgtaaagaccatcgatgctaggaagaaactgaatcaactaatgagcaaaataacaagctaaca

SEQ ID NO: 472083 - DNA, 558 bp, Homo sapiens
agcgctagcggtggtgaatccatatgggttgttgcagcaacctccattcttgtgttctcagaagaaagaatttgactgaaggacataaggcagaaggagagactgaggcaaattttggaacaggaaaaaaggaagagggatcgggaaagggaaacaacactgagtggtcactgagccacagcaggaatggagaccaccctgcctgcctgaggaagggacccattagtgtctggcagcccaggtcctgctttttggagaatcgctgttgttcattgcctttcaaagccaaatcagaggaggacattgggaagaatacctttttcgatggctacggaaatttagtagcccacttcctattggtgtatgagggatggcaggaaaaccagaatttctttgagtttcctcaaaacagcaattttgaatgctctgtttgaaagttcacatatctctgtttctccagattggtccctggtgccttatttagttcatttggtgagatcgtgttttcctagatggtcttgatacttgtaaatgttcatttgtgtctgtagtgaagag

SEQ ID NO: 472084 - DNA, 832 bp, Homo sapiens
tgatgggtgcagcaaaccaacatggcacatgtatacctatgtaacaggcctgcacaccaaccacagaatcagacagtttgcatcatcttggtgcaatgtctgctgactcctggcctcctaatgagtaatataatcatccaggtgatgacctacctgtgccccagtgtcaagtttcctggtgacattccagagatcagagagtttcatcctaactccactgcacccacaactctcaggccacccactgggctttcctctgggcccctgactctcctctccagcctcagtctctcctccactccgcccccacctagccctctggccacaggagccacaagccattctcagaagcggctgtgcagtccccgctttgatgctattgttccctgctctccctttctcccttgcctacctggcaagcggcacttatttcaaaaggtcctctgggaagcctttgctaaccctccctcccccgcccaccaggtagaaatggccactcctcctttgtgttctcagctgtcctttgagtcacagtgtctgtgacggtttactttccacgttgttgtgcttttctccaacaaaaatcgtaagctcctcgagagctaggactgtgtctcaattatacctgccttcctagtaccgagcacatctgactcgtctcagtgacttgagttcagtgagggagcaaatgaagcttgtacaagcatagagaactcttgctgttcatggtggcggtgaggatgggaggatctgccttgtgatggtccttgtaacagacatttgatcccgagcaatatcttctagacctctcggcattcatggacactttatc

SEQ ID NO: 472085 - DNA, 843 bp, Homo sapiens
tcagagaagtgaaggactttcagctgcagtcacagctgccaagtgacggagctcggcttcaatcctggttctatgcaatgctagagtccacactgtccatctctgctctgatgaaggcagattcctgcccacaagtgaaggctggggaggcctcaggaaacttacaatcatggcggaaagggaagcaaacacttccttcacttggtggcagcaaggagatgtgcagagcgaagccggcgaaagccccttataaagccatcaaatctcgtgagaactcgctcactaccacgagaacagcatggagtgctgcttccccagttggctccttgtccacaggtccacagcgatggcacagcagcagctccaggtcctggaggacagcccggctgggctctctgcctcctgacttctcctcttggttgtctgaactccttcgcttcctgacatctcccccagccctgccctttcagctcttctttatctaccctgtccgctctttcctgtggattctgatcctcagacgatggggcctggagtgtggctggggaggccttcatggtggtctgggatttggctggagtattcacagcagccagccaggtgcagatagcatcttttgccctgggagaagtagcctcttctactgtaccatgctgaaagagtgtctgttcttcctcacttcaaatgatgttgaaaaggccctttctgttgccttagcctcaggagacaccaggctcctggaaggaactgacaaggaaagcaacctcgaaggcaatgcttcccgctgaccgagtgctttctgcccatgacttcactgatgcctcttaacagccagtcaccatt

SEQ ID NO: 472086 - DNA, 892 bp, Homo sapiens
ccacagctatgtgcatcagttggcgtatcagttccgtccgtccctggtgcatcagctccatccacccctggtgcattagctccatccacccctggtgcatcagctccatccaccccaggagcatcagcgtcgtccaccccaggtgcatcagctccatccaccccctggggcatcagctccatcaacacctggtgcatcagcgccatccaccactggtgcatcagctatgtccacccctgctgaatcagctccatccaacgctggtgcatcagctctgtctacccctggtgcatcagctctgtctacccctggtgcaccagctccatccacccctggagcatcagctccatccactgctggtgcatcagctccatccacccctggtacatcagctctgtccaacgctggtgcatcagctccatccacccccggtacaccagctccatccaacactggtgcatcagctccgtccacccctggtgcacaagctccgtccacccctggtgcatcagctccatccgcccctagtgcgtctcctctgtccacccctggtgcaccagctccatccacccctggtgcatccgttccgtccacccctggtacaccagctccatccagcttcgctgcatcgctatgggccttgaaatgtgccagtgaaatgtgtgaatattcacagtaagtgggggaaaataaaggccataaatagcctcatgacatttcaagttgtgttttaccagacttatgagttaatagaaaacacggcctttggagcttcttggatttcaggatcgcaggaaacaaggctagaaaatcaagcagccccagaggtcatattcatcagcaaaattctcccagtgggacctggtagcacattgaaaacttgggccacttc

SEQ ID NO: 472087 - DNA, 1420 bp, Homo sapiens
acctctcctgcttcaagccctgtgggcattatccccagtgcaggggctctgtggggagaaaactctgatgattattgcctgcgtgggaatctacctggtgccaaagaggcgggacaggctactgactgactggctaacagaccagcaggggactgacagcagagtgagcctgcagttgatacgttcacactctgagcctggccaggtgtcctatacacaatggcagcctgctgtggacacagcaacccagggaccaacaggctctcttgggccacgaccgatggagcggctgccctccaccagcagagggcagagggccacagtgctacagccttctgggtactcacattcgaccttcagcaacagagcatttcttaccaccacccccgttccccggctggaagtcccggagcagcaggtgttcacaacagcatcattgccaccacccccgcccccctcgaactctctggccatgttcagtctttttacctcacagaaccttggctttttcaactcaagaggaggataatgtctacctccatttaaaaaggtgaaggggatatgttttgcaaattctaaagttgtagatgaatcaatcatccccagaactacttaccacaataataaaagatgttgaggggaaaggggagggactggaaggagaaacttttggggcaatggaaatgtcctgtatcaacatatagagatgatggtagaagagtatatatttagtgcaagtcattgaaatgtacacctaagatctatgaatttcactgtatgcaaagtttctcctttgaaaattttccctttcaaaaacagctatacaaggcattattggtacaaatggggaaagctgaatatatctacattggataatattattgtattagtgctaaattcttggatgtcaaattcttggatgttccagagagtgtttcgcatgtgattaagatcgggatgggcagactaagtgaagcagattgcccccttaacgggggtgggactcatacaatcaatcaaaggccaggagagaattaagaggcctaataggaaacaaatgctttcctgggtatccatccagctttccttccatcttgggaatttcagcctccataatctcagaagcaaattcacatatgtatacacacacatatacatttcataggtatgtggctaagagtgtatttttaaaagttcagccatgagatgattggtgaagccagccaatgaataagggtgtgttctgttatatgactcggtcttcttttgtacacgattgaagttctgcatttgaagtaggaggacaggagagagcaagaccacctaggatgataacagctgaatttctcaacagacacttcaaagccctaggggttaacttagagagtcaaaaatcccacccataaccctgtccctaaac

SEQ ID NO: 472088 - DNA, 806 bp, Homo sapiens
gcgagcatgttttcttagccaggggaaatgagcaccatgcaaacaacgaagacggctgcgtgtgataaggggctgggctgctccagtgtggcctggaggggaaagagggactggtcactgctggctgccttaggtggagagaagacatcaggcctcagaatgtctgagctggagggggccttgggaaacactgccaccgccgggagccccgtactatcagccatggtcaaccccactgtgttcattgatggtgagtccttgggccacgtctccttcaagctgtctgcagacaagtttccaaagacagcagaaaactttcgtgctatgagcactggagagaaaggatttggttataagggttcctgctttcacagaattattccagggtttatgtgtcggggtggtgacttcacgcaccataatggcactggtggcaagtccgtccaccaggagaaatttgatgatgagaacttcatcctaaaacatacaggtcctggcatcttgtccacggcaaatgctggacccaacacaaattgttcctggtttttcatctccattgcgaagactgagagtttggatggccagcacgtggtctttggcaatatgaaagaaggcatgaatgttgtggaggccatggagccctttgggttcaggaatggcaagaccagcaagaagatcaccattgctgactgtggacaactccaacaaatttgacttgtgttttatcttaaacaccagaccattccttctgtagctcaggagagcaccccaccaccccttttgctctccatattctagaatctttg

SEQ ID NO: 472089 - DNA, 3192 bp, Homo sapiens
agatagcatcaagaagggacccctggggaaaaggcagtctttaagcgtcacaccagtctgaagaagtgcatgcagttatgacggccatcttacagagtgagaaagtgaggttcagcgctaacgcctcgtccaagagggagaatctgttccgtgcctctcaacgtctggtgtttgctggcaatcctgggtgctccttggctcgtgtcagcgtcatgccgtctccctccatcgtcacatggcgtcccccattctgcttccggggaggcccagccaaagacaaaatatctgcggaatacatgaatgcaggaatgaatgattcctggcagaggaggaagctgaaattcacagagatgacagccattgctcaggggacacaaaagagagaaaaccacttgaatggtcccccaggccggctggctataaatgtcttcatagaagggcccagcctggactttggtgcccagcaattacggcctccgtacaccccgcccagatgaccagcctgaggcacctctttggtcttctccctgcccaggcaggcaaccactggtctgctttctgttactaaagattagtttgcattttctagaatttcatataaaagcaaccatacagtatttactgatggttttttcactctgcctaattatattgctatgtatctacgcagtctcatatgttagagcgtgttccttcttattgctccattgcatgaatataccataatttgttcatcaatcaccagctgaaggacatttggttgattccagtttggggctattacaaataagtctgctatgaatatttgtgtacaagtctttgtatgaatagatgggacacatgcttttttttcctcatgggttatgtggaatttcatagatttagattttacatttagatctatgatccattttgagctcatttttaaaatatagtataaagtatagataggtctttctttctttgtttttgcaagtagatattcaattgtttcagcaccattccataaaaaaactgttctttctccactgaattgcatttgcatctttgtcaaacatcagttgtccatacacatgtgtatctatttctggatttccttttgtattccattgatctatgtgtctatcattaagcccatgccacacagtgttggttactgtagctttatgctaagtcttgatatcagggagtgttaagtcctcccacttcacggtttttcagggttgctttgactattctaggtcctttgcatttcatgcaactcttagaatcagcttatcagtcttacacaaaagactgggattttgattggattacattgactctatgggttaatctggggagagctgacatcttaacaatgttgagtcttctaactcatgaacatagtatacctctccattcatttaggttttcttgcacttcggcaatgtttcataattttcagtgtgcacgttttgcacatcatttttcagcgtttgcactgtgtttcagtgttttcatgtcttttgatgctgatgtgaatgttgtttttaaaattttcagtttctgtattgttcattgataatacacagaaatagaattgaattttgaatgttaatcttgtatcctgcaatcttgctaaactcagtaataaattacagtgcaaattagtttttctacgcacaagattatgtcatctgcaacagatttacttctttcattctaatcggaatgccatttatttatttatttatttatttttccctcattgctctcgtgaggacttccagtacagtgttgaatagaagtggtgagagcagacatccttgtcttattcctgatcctagtttgttaacagagtgaattacattgattaattttcaatgttaagccaaatttgcattcctggaataaatcctacctggttatgatgtatcatccttttgatatgttattggatccaatttgataaaattttgttatgaatttttacatctatgtttatgaggggtattagttgtagtgttctttcttgtaattttctgatttaggtatacgggtgacgctggcttcatagtatgagtaggggagtattccctcctcttcagttttctggaaaagattgtgcagaatcgatattattctttcttaaatatttggtagaattcaccagtgaagcctgaggtttcctttgagagaagttttctaggtataattcaatttctttaatagatatggatttacatctatttcttatttatttctttttgagtgaccattggtagctaacatctttcaaggaatttgtctatttttttaactcatggaattattagcccaaagttattcatatttttcctttattgtctctttagtatccatagaatttgtagtaatgccacctctcattcttggtattgtaatttgtatcttccctcttttttgactagtgtgactagacgcttatcaattttattgatcttctcaataaccagcttttgggtttactgatttttctcaggtttttctgctttctatttcatttatttcctctctgagttttattatttcctttcttctgcttcctttggttttattctgctcccgtttctctagtttctttaggtggaagctgaggtccaggatttgggaacttttttccttttctaataacatattagtgctgcaaatttccacctaagaactgctctatcagcatgccacaaattttgatatgttgtgtgtttaatttcattccattaaaatattttctaatttcccttttaatttcttccttgatccttgagttatttagaagtgtgttattacatttccaagtgtttgggtgatttttctggagatctttctcttattgatttccaatttaattccatcatggtcagtgaacattctttgtatgacttgaatcattttaaatttattgagactatattgagactatagtctatcttgcaaccatttcatgtatacttgaaaagaatatgtattttgctgttttgagtggtgtgttctatgaatatcaattagatcaagttggttgataattctgttcagactttctgtatgctcactgatttttttccactagtcctatcaattcttgaaagaggagtatagaaatctctgattataactgtggatttgtctgtttctccttggaattctatcagtttctgtttcttctacttt

SEQ ID NO: 472090 - DNA, 963 bp, Homo sapiens
aagctgtggggcaggaggggcctgtccttgaaggtctactcaaatgccacctcccctggggggccccaggaccacctgtagattgtgctcccccagaggggttccttggggacaatgtagcccacagccttgctctccagtgagggggccctcagttggtgttgcctgggggtctggccgtggggtttggaggctggtgggtcaaccctgctggtgggttgagctggaccaggaagtgctgctcagggaggacccactggacttcccgcaggcccggtccttggcctccaccccacactggccactgggaaatcagggacaagacctcttccctggcaccttcatcctgcatgtttcttcccgcttgctttccgcccgggattaccgccggggctgggcttctgcacgtggctgttgcttgggcccccacgtgggctgcttgaaaaacatctctctgaaagcagagaaagtgtgagccgtcaagaaggagcgtgtggaaggagagaggtcctcggaggaggggaaatttacagcattcatttggcccattctaaggacaccgtgaggcctgcatgaaatgccttccggagcttgggaatttcgtggtggggtaaactgcttatcttttcagtactgtttttgtttaaaagcctcaaatcattttgtgcaacacttgcagagaattaaaaaaaaaaaagactcaaatctctgggtcaccagagtccctcattttaataaatgattttctgttatgcttgataatggcattaatagaataagaagggagaaatagaagaccaaaactggtgaccaaggattacacctggctggtctacagtgtccccagttcatgtcattatcattggatttgctttttaaattcagaataggtgttgggttggagggtgggctctttgtcttcattgctgtgatgtttggaaaataaaacaactgtggaaaata

SEQ ID NO: 472091 - DNA, 634 bp, Homo sapiens
ccctcaggactcctcgggcctgaacgtctttgggaggaactctagcatgtccagggcagggcgggggtgcctgggaaagcggagtggcaggcagcctcagttccacatgcccctctcactctcactgccctgtaaagatactgattttcattctgcccagtgcagaaaccctccaggtgtgagacgtagaggaaagagcaccaggccggggtcacaaaaaccagacaaattctactctcaaggagcttgtactcttgatggagagatagtgaatacactaacagtaaataagctgcagtctcctcccagggcgggctcagtgaccactccagagcggccctggacgttgctgccctctgacaacctggaagccatcagttctctctcctgcaaactgcagaacttgggcaatttgggcagccaaagacctcttcccacggattgtagccaactttaatcctgcctgcccagcccatgctcctgcttctgatggcagcacccttagagaggccccctccccactctcaagttgtgagttgggtggggtttaccttgagtgcacctgtggcccaagcctggccaatgagagcaccacattcctctcgtcttgtctcagggtttgtttgggggtgag

SEQ ID NO: 472092 - DNA, 602 bp, Homo sapiens
aaagatcgaatgtcaggctgaacataggtgctggtgataggagtatgaaatcctggggacccttggacaccctgattcctcatctgaccacgtgctctggtggacagtctggccaggagccggtcgccgtctctgctgctggacagctcttctgcctcaccagtgtttgccctgtgttcagtccacctctgctcatgatgcagacggtgctgagtgagcgggccccttctgctctcctggccaacgttaagtgccttcagactgaaaagaaccgtccagagaggcttttccggctagagattaatgtcactgaaaaatgtgggtcccgagcgattaatgcggccttctttgccacacattatgaggaaactcatcagggtctctccccaccccggcatggggcttctcatccttgggaaaaagagacagtgctcataaatccagggaaagttaagatggccgtgagagaatctggagtgtttgacctgcttccttggaggagacggtggtctttgatgcctgggtcctgggccttgtgccatcaaggaaatgggtgaaggagatgctggcaagaatgaagacctgttgggggcagcggttaa

SEQ ID NO: 472093 - DNA, 770 bp, Homo sapiens
attatcaatggcaaatgcaggctcctcctgtggaaagaaattctgcttcctggagctggtggtctcttctcccaccagttcaaagaagcttctctcgcactgtggagctgccctccctgccccacaaggtgaacccttgctgaagcaggacagcaagcaggtccaggtggacctccaggacctgggctatgagacttgtgccaaagcaagaatgaggctgaacaggaggaaaccaccagtaccggtaagagcacaggagtgtgaggagcacaacagcctcaaggaaatggtcctgatggaggggctgtgctctaagcaggggtgccggggctcaacgctggctagttcctccgagaggaagcccttggagaaccagctagggaagcaggaagagttctgggtatatggaaagtcagaaaacatctcagtcctacgaaaggacatcaaagatctgaaggcccagctgcagaatgccaacaaggtcattcaaaacctcaagatccgggtctggtccctcttggttacaagtgattatttgtctagtctggaaagaccctggaagctgggagctgttggcaccctggaggggtcttcacctcatagtgtcactgatgaggatgaggtgtggctgtctgatggcactggggctttctactctccaggacttcaggccaaaaaggacctggagagtctcatccagagagtatcccagctggaggtccagctcccaaaaaaatcaactagaagggaagctggctgaggagctgaga

SEQ ID NO: 472094 - DNA, 1556 bp, Homo sapiens
tacaagaagcatggcccccgcatctgctcctaatgagggcctgaggctgcttccacttgcagcagaaggtgaaaaggaaccagggtgtgcagagatcatatggcgagagaggaagcaaaagagagcaaggaaagaacttaaagtataataaatatatatatatggcggtgcgagggccactgcacagccagcagagccgtggtgaggacggcagtgcctgcacgcagctctccgcctcccctgcccgccagcccaggcggccccagcagcagcgaccagaggagcccccgcagccgcgcaacggccaggtggacgcctctatctacagcctcggaaaaaccttcgtgaacatcacgccagctaaggttggtgtcctggttggcaaagactggtcaagctttttcgtgaataggctgacactgcggggccagaaatgtactgtggtcctggactcactgctgcaggatggggaactgaccgtgcatcttcaaacgaagagcatcggtggagcccccaccttcaatgtcactgtcaccatgattgccaagacactgggcctgctgatgagcaaagaagctgtccatggcagtttcatcaacaagaaatgttatgaaatggcctcccatcttcagcgttcccagtactgacctcctttgttccttcccctcaaccgttccccacagctttgcccccctttccttctcatacacacatataccattttaattttgggggacattaccccacacccctattgctgccaaaaccacatgggctgggggccagggatagatggacagacaccttcctctacccatagccctcctgtgtgttcttggaaaacgttttggagggattttttatgaataaaaaagattctactaaaataaataactacatatgtggtcatattgtttgaatctgtattcttttactttgatatatttatgaatacttacaccagtactaccattttaaattactgtagcttttaaatcaggtttgaagtctagcagagtaagtcctccaacttactgcttcttcaagaccgacttgcctattctaggttcttggattttcaaatatattttgaaattagcttttacatttctctaaaatctcctactagaaatattaatcagaattctgttgaggtaatatgctaacaaaattgaatcttccaatcaatgaacatgatatatatttctctatttagtcttctttaatttttctcaccaattgcttttacgggccttgtacccgcttcattgcatgtattcttaagcatgtaatgattctgactattaatctcgattatgttttactgaatttcattttctagctgctaattgctagtatggagaaattaagatgatgaaatcaatgttataaaggcatcatttaggtacaacagactgcaccactttaaaatgtgtaattcaatgcatgtttacaaatgtatacactaatggaactactgccacaaccaagatagaggaatttccctacgccccaaagtttcttgtacccctttgcagttcatcagtctttcagcc

SEQ ID NO: 472095 - DNA, 498 bp, Homo sapiens
cggaagggtgttggtgtgatgatgcaacagtatttgctcccctctcctcctttcttgcgggagaccttccttcctgttctggactggactgctggctctctaggcctgccagacagcggtcatcctgggaatgtccctcaccctcacgcttttcccggtgcgcatgggtggggctttttggctggtggatttcatgggaaggagattgggggcaagccagctttttctttggagacctctccaaatgacagtaactataggcctttcctctgtggccagtttttccagaggagggtcctccagtctccttcctgtgggagagggttgtggctaagcctggctgggtccctcactccatccatcaactttaacttcatccttatcttcagtctgttgcctgacttccatgcttcattgtgtctagagtcctcaagttcaggacctctgtggtttaacttctccagagaattactcacctcctgagagcactgaagagag

SEQ ID NO: 472096 - DNA, 798 bp, Homo sapiens
gaatctgtaccggaagattgtgatgtgcaacaaaaagtggattttatatgacaaccatcgaccaccagctcagtggatggaacaagaagaagctccaaagcagttcccaaagccacacttgcaccaaaaaatgggcatggtcactgtttggtggtctgctgccggtcggatccactacagctttgtgaatcctgatgaaatcattacatctaagacgtatgctcagcaagtccatgagatgcatcgaaaactgcaatacctgcagctggcattggtcaacagaaaagacccaattcttctccatgacaatgcccaaccacatgtcacacaaccaacacttcaaaaggtgaacaaattgggctatgaagttttgcctcatctgccatattcacctgacctctcgccaaccaactaccacttcttcaagcatctcaacaactttttgcagggaaaatgtttctacaatgagcaagatgcaaaaaatgctatctaagagtttgtagaatcttgaagcatggatttttatgctacaggaataaacaaacttatttttcattggcaaaaatatgttgattgtaatggtttctattttcattaataaagatgtgtttgagcctagttataatgatttaacattcacagcctgaaagcataattacttttgcaccaactttttttttatggcagtgtattttcttttatcacatatttagaattatctaatcatacattgttggagctggctgataacttagagatttcctagtttgccttcctcatttaaaaaataaagaagtt

SEQ ID NO: 472097 - DNA, 622 bp, Homo sapiens
ccagatcacgtctcaggccaccatggacccggccccccagcgcagttacctgcttcagcatgtttgttctctggtggaagtgggatcaggagaccctgggctaggacgctgtctttgccgccaacatgctgagtgcctttggacaagtcctctgatgcctttgggtctgtttcctgtgggacctggtagtagcactaacctggctccaccacaggcaggagcccgaggtgtggcttccaacccagacggctgcgtggctgccgtgacaaagtaccgcaaactgggtggcctaaaacaacagaagtttattctttcacagttctggaggccagaaacccaatatcaagatgtcagcagggccacattcctgtcaatggctctaggggagaacccactgcgtgcctcttccagcttctcgtggttaccacatcactccaatctctgcctctgtcttcacctcaccttcttctctgtgtgtgagctctgcgtgtctacacaagggcaattgacattggatttagagcccactcagataatccaggaggatctcctcatctcaagatctcttacttagctacatctgcaaaggccgttttttcaagtaagatcatattcacaggtt

SEQ ID NO: 472098 - DNA, 800 bp, Homo sapiens
gcctccaggtagacggtgttatactagagatgtaactgagagagccaaataggcaggccaagctccttgaggctagacctagactgctgctgggctttgcaaaacccaactggggatgggtcctgggctgctctctgtggttctgaagcaccatctcccgccagtgtggctgctcccccttaatctgcatctctggtgtctcctatacagcctctgccagaaattcaaaagcagagagggcttttattttctatcttccaaaataaatttcaaatttggcaaacatgtcctcctggctctccccagcacccccactctcagtggagttgtccacgggtccaatgggcatcgtggcggtggtggtggcaggagccacaataggctcctggttcctcttgaaaatgttcctcatggtggcagaggaaacagctggggacgagaggtgaagagggcaggccttgaccccaaaactggtcttgaagtgaaaaaccaaggtccactggacttcgcctctggggacaaagagatggatgccatttatcagttgagcctagctcctccattctacccttgccgctggattggcagtcctcctcccctttctgcagacagctccccacagccggtccacgaagtgttcattgaaccttatctgaggcacctggaagtggccctggcaccgtagagggacccaaggttcatggtggatgcaggccttctctccagactgaccgtccagaaatggtcctgtagcaaagtaaagctgcttggtgtcaaataaaccagccaggaatgaagac

SEQ ID NO: 472099 - DNA, 576 bp, Homo sapiens
ccacagcacactgctgggccccggtggaagatgacagcacaccactgccccctccctgcccccaccctctctcctcagcaagccccaccccacctgggcctgctgcttttgaagcaccccaaattcactgtccctagggcttctccccgaggccgcactgggaaacctgcaggcatcctgcaggctgccccttcctgcaggacagcctcctttccctgcaagccccccgctggggaggctccttgtcctctcaagctggtggctctgtccttccctatcaagatccagcggctggagctggagcctggcgtcatcctggcccaagctgcccaggcgggacgaccagagaactcagaggtggggatgcagtgggacgccacgttcagcacgcaggttgctcactcactggaccagtggctcttggaaccttttgagaatttcacaaaagttcctttctctcaaaaagaacaatagctagtgttaattgtcctcttagtatgttccaagatctatgttaaatttatatacctatcccatctaaccctcatcatggccctatgagaagggtgctatatt

SEQ ID NO: 472100 - DNA, 1262 bp, Homo sapiens
ggaatgtcacctctgttaatggggaagcgacacctgtgcacagccggaaccacctctctgtcttcattaggcagtccgcggcctggctgccggctgccctcgctgggtgacagatgatggggatgaggagtgagagcagcagcctcctgctgtccaggattcattcccagacaatgaccccaaatgcctgtccctgctccccccaccccccaacatcaaaatagccgagaaaaatgcccttctcgggtcattggagatggaggtgggttggggccacctgtggaggcacctcaagggctctttctcaaagataactgtcatggcatcactcccctgctccaagctttttggtaacaggattggcaaaatgttgacaactgttgaagcagggcccttggctgtctggccctctgccagtcttccagcctcacccgttgccagtcacccaattgccttccatactcgggatcctcaggaaacatccacacttctccttagtaccaggaaccgttataatgctctggaacagttgtttgtttccatttcacgaatccctgctggtacagagtctcctttaagccatgggaattcaacactcctggattctaaggacagaaatggatatgtgaaagccagggcccagctagtaagtgacacaaatggaggcagtgatacaaaaatccaggatacaaccagaggcagtatgaccccggagcctgttctcctaaccactctgaaattgcctcttaaggttccctggggcttcctgagctcctggttggtgactctgaggcctccaggatggcaacccatcatcagcttcagagggccccagaccggaaggatcctggaacctgaagggacctgggggcctaaacaccctcagggaaatcctggagctctctgcaagctagttcaaccgtatccatccatttagctaaagcacatccttcgctgaagccagcctggtctcatccccacttctacccccaagccttgttcatgatatgcctttgcctacgatgcccatccttctgcttcctgccaatccagaccttacttgttcttcccactctgagttccacctcctccaggaagctttccctgaacaacaccacccccaaccaggggagatttttctctgtttctgaccttctttggcatttatggctaccactctattggtatttgattatgaactttcacttcttacctttgctcatgagtgtttctggttggtttctccatttagaatgtaatcc

SEQ ID NO: 472101 - DNA, 508 bp, Homo sapiens
gggagacagctcccacccaggtcaccagcagcctccacagtagttactcagtgaacatcatgcccaacataggtgtggcaattgagggattccaaggaattggcaaagaagtgaaatgccattcagaaagcaaggcgaatgcatctacatgtaaaactcaggataccaggcacacagatgaggtcccacccccacacactgtctccctgttctcacgaccagctgtgggtggtcccccttatctttctaagcatttccgctatctgctccccacataccatccccctaatctgggaaaggttttgtcagtcctttatgccactgtaactacaggattcaaagcttatggggctaagggcttggaaaaaatcaaagacaaacttttggagatgggtcttgcatattcctgtgggctgactgaacaccgtggctcggggaagtctgggttccttcacactttgactgtcagaaaatgaagatcacaagctctgggaggtgtaaccttgtc

SEQ ID NO: 472102 - DNA, 575 bp, Homo sapiens
tagatagccagcttgcctgggatgaaaacaggcaagaaaaatgattacagagatcaaagcccaaggctggcagtaccagtaactaacacctgtgtacagcatgacacccttttcagaagaaaccagtgtaaatcactgctgcctctcatgaatacagactggtcctcacaagactctgagggtcccaggacagggactggcttgcttgaagtcacactgctgctgtgtcttcagcagccccatgaccacattttggaagacggcccctgtgttctgattgctctctgtgaggcgtacgaaatggaagagattggcaccgtcagagagaagtgcagaggcactgcagatttttgtagtgccctgaggtctcgtccagaaactgtggtgtggagaactgctccccctgctgactcactgggtgccaggcctttgcttcaagaactaccttagtgtcagattgaagaagtctggaatttcacaaccgacttagaaagtgtgaaaacagaaatagtaagcattattccccgcacccaaagtttgaacctgttttgtagaagggaggaagcggctctaac

SEQ ID NO: 472103 - DNA, 635 bp, Homo sapiens
taaagaatattaataaaagtaatgataataataatctttgcactgctgctaggtgcctgtttgagtatgtctcatccaaaatgcttgagagcaggaacgttttggattttggaatatttgcattatatgtattcactgattgaccatcccaaatctaaaaatttgaaatccagcatgctccaaaatctgaaactttttgagtgccaacatgacgctcacaggaaatgctccctggagcattttgggctttggattttcagatttgggatgcttaatctctatcatactgatgaagctaccttccacaggtgtcttgggaaagtagtttctaaactgtgggccatggaacccctggaatttgtgggaatagctcagggaccaataggtgaaaatgggaagagaaatgggcaggcctcaggcattcatcaccttgaccccaggaagttccactttcctctgtttcgatcagtgcctagtagagagtctggcacaaaacaggcactcaataaatgaattaatgttttagacatttcagttccttctatgagcctgtaaaatcaaaaccaagttatttattctcaagaacaatggttgtgcaggcattgggcaaacattctcattctaaaagggagaaa

SEQ ID NO: 472104 - DNA, 785 bp, Homo sapiens
gggcggtgcaagatgtggtttgttaaacagatgcttgaaggcagcatgctcattggaaaggagaagggaaagagactgagagatctgattcagggaagtcagctaaggaactatattccaaatgaggagaaagaaataaaagattttattcctagtgagggaagcacagatgcagataaaaagacagaaaagctgcagctaagcaggccttgccaggaaaaagaagcctataaggagcagaacctggaaaacaacaggcaaagcaaaactgcaggtccagagcagcgtgaagcaaggataagaccactaagtgaagatgctatcatctgtccagaggccagctcaactggttggagagctgagctagacggaaggcagcagggaagcctccctgaattagcaccagcatggaaggctaggctaacatgaggggtgggtggaaatgattattcatttacacagtcagttagagttagttttgtccatgagggacagaaaattcaaataactgtggcttaaataaggaagaagctcatgtttctgtcccgtaaaagcccaggaatatcatgtgcctaaaccagaggttactttagggaggacacgtgttccacatggccagtgaatgcatttattttacctgcctggtcccagtcagtatttaaggtgatatttctacaaacatctgatagtctccagaatgtattcattcactcattcattcatccattcatgtattcatttttattcattcatgtattcctcaattcagtaaatgtttataaagt

SEQ ID NO: 472105 - DNA, 1535 bp, Homo sapiens
acatgagggcagacaccgcactccctctctctcacagatgcatgagcctcagctgcagcgttctgacttgcagggtgggctggagtgccaaatattttgatctcacatgtacacaggctgatttcttcccatgcctgtgacttgagtgctggaatttcttctactttcttcttcttctttgtttttctttctttttcttctctttcctcctcctcctcctcttccttcttcttcttctcctcctcctaatcctctctttttctttctcttcttctttctcttctctttctctcctcctccttcttctccttctctcctcctcctccttctccttctctcctcctcctccttcttctcccctcttcctccttcttgtctttctctcctcctccttctactccttctcgtcgtcctcctcctccttctccttcttcttcttttcttcttcttcctttccttctcctcctcctcctcctaatcctctccttttctttctgttcttctttctcttctccttttctcctcctcctcctcttcctcttcttcctcctcctcttcctcctcctcctctacctcctcctcttcctcctcctcctcttcctcctcctccctcctcttcctcttcctcctcctcttcctcctcctcctcctccttcttcttcttcttcttctcctcctccttcttcttcttcttctcctcttcctcctccttcttttcttcctcttcttttcttctcttcctcctcctcctgctccttcttctcctgctcttccttcttgttcttactgtgaaggcttttttaattgttttaatttgggacagacatggccgtgggcgcttctgtggggcaagcctcactgagtctcggatacctgctcacctggatgaattgtccagggtgtggagggagaggacccagagcccgtgcccttcagatgcccccacggctggagaagctccaccctgccccacccatgccacttctgcagttccttttgttcttgcttccaagtcacaagaggctacaacaatccaaaatgatcaatcagaaaagtgaaaaggatgattccttgggaaaatacggtagtggaggtgctctgatgcagattcagccaaaatgctgtgggagtgaatgtgttgggacaattggttctgatggagatctacaggaaaaaggctcacggaaggatgtggtggaggatggattggactgggaggaggagacaggctccaaggatgtccataggctaacaaaagagcacaggctgcagagagggagtgatggctgtgggaataaagggaatgggaaggaggttcacgtggtccacacccctgccctgactgcagatgcttgaaccctcttaaaaaactatgtgggctttgggaattcagtgaatgactcaaccagaattcaagaatatcttggcttctgattgcactccttcatcaaagggggcgtgcactcccttctggttctcagatgcctccatctgttagacatgtctcctctcaattaaataaaacttgcccctcc

SEQ ID NO: 472106 - DNA, 835 bp, Homo sapiens
aggtaggcactgttattattgccactgttattattgctactttgctgatgaggaaatggagagacagctagtatcagatgttgaaaagtagactgctacatggtactgcctcctgcacagcaggaggaagtctccagtgcaggaaggattgagatccagccaacaaacacttgctgggtagcctactgtgctctgagcaccctgctggctgctctcttccctggtagcccatgtggtcctcacgtttgcttggcaaagcaggtgtcattactgctgctttactgctggggaaatacaagctcagaaaggagaaataattcatccacggtcacacgctccatctccacagctaccgagcccttctgccctccccctgctgggtgggcccagacagcagctgtctctttaacaaacatctcagccattatacccaaaagcctggaagctaccagagaaggcctggagttcgtggacagtgctcaggagcacggcagcagggcaactcctaggctgcccgcagaagcgagctatccccccagtgaatctcaaagcatcactttcctaatctgtacaatgggaataataacagtaccaccctatggggttgctatgggaacaaaataagaccacatatgaaaagctccagtccaatggctggtatatattataatataagctcaaaaccttacagactctacatcaatactcttaacagtgagaatgggtggagagtgggtttaggtccattttagaatttgtctttttctatgtttgacaagttcccaggttgagtattatgttactttataattaagaaaaaaaaaacccaataact

SEQ ID NO: 472107 - DNA, 969 bp, Homo sapiens
gtctccaggacatacatgggctcctagttctagacatggccacccccatcttggttcaggtccccccagcttcagggcccatgtcagtgaaaatgtcccaattccaaaccgtccacccactccttcagcagagagagctggatggtggagttctcagagaacaggtccatctggagcaagccaaggagcagcaggaggagctgggcagtggtaaaattaaagatgtggaaaacctgaagcttcccagccccacttgcctgcagatgaaggcagggccacctacagcagggcctctggtagccctctcaggcctctgtccatggcccagagaaggattcgaggagggctcccaagtcagagaggacccatggtctgccttccatcctccaggggctgttggagggagggagaggatcttcctgtgtctgagggcggccgtcagtgttggcagcaagtgctcctgttggcacaggggaaatataagctgcatctgccacttaaaaagcatttctgagaagtgcagaggcggcaagagtgtgcagaattgtcagcgtgtggggattagcaggccggcacatttcctcctgcaggcagccctgctccgcggctctcagagacataaggcatttcaggaaaagcatcgtccaggcacggagcagccgttaaaaggaaacccagggaaggccatgggaaaagagtggctgctctctaggaatgataggctccgcacaaaaggagcagggtccctgaggaaccagagtgaccagtgcccagcccgggctggggcctgccatcaggggccaactgctctactggcatttcaagaaccccagagaaattctgcagttaccaccacaccagtctgtgaggttggtactgccatgatcccccttctacagctggggaaactgaggcttgaatgaaaagaaatcattaagagtatggttagaacttgagccctggaccaca

SEQ ID NO: 472108 - DNA, 829 bp, Homo sapiens
taatttgtgacgccagctctaggaaatgaactcaagccctctactagtcctgacctcagaaccagctaggggacaaccagataagagtgacgtcccagaagcaagcagagatgtctggggctcaggccttgggcttctctctccaccctctctccctaggtgagctcatcaaggacaaagcagcaaatcccactggtgtgaccttgaaactatatccaaaaaccaaccccttccccactgtgactgctcctgtcccagccccagcaaccgtcatctgcctggacggctggcatggcttccggcttccacacacctccacccgctgtccaccacccacggcagccagagggagcctgctaaagcgacccccatgccagtccagggcagagctgccaggcaggctggaggcttgtagcacaggcaaggaagaccagtccagcaatcagctgagtaccaccggtgacttcagtcaatgtggcatggagcagaagaaccactcagctgagccctgcctgaattcctcacccacagcatagtgagatataataaaatggcccttgtttttttttttaattatactttaagtcttagggtacatgtacacaacgtgcaggtttgttacatatgtatacatgtgccatgttgatgtgctgcaccaattaactcgtcgtttagcattaggtatatctcctaatgctatccctcccccttccccccaccccacaacaggccccagtgtgtgatgttccccttcccgtgtccatgtgttctcattgttcaattcccacctatgagtgagaatatgcagtgtttggttttttgtccttgc

SEQ ID NO: 472109 - DNA, 697 bp, Homo sapiens
ctcttacctgtgtcactagagcgttcaccccgtcacagcagggagcctccgggatctgctccagggtgtctttctctgattgttaaatatttggaatgtcactgccagtctggatgaatggggccatgagctgggttgttacatggcatatccaggtcaggaggaggagaggagaagcgaggaggacccgaagcaccagggccctgctctctgcgtgttaacttccacttatctcatcaatgcacagactgttggaatggaagactgtcaaatggagacggaacatctggtccttggagtgataaaggggctgtgggtcctgcttctgctgcggcccccttggaatatcagcaagggcctgaaaggaggctggtgcctcacggcggtggagggagatgaggcggtgtggccatgtgcagaaggggctctaggggaaggtgagaaaactgaagcagcatcagggctggggtttgaacccaaggtgtttgaacttggacatgtaagcctcaagtcttctcagggcactgtggcctttggtgggatctgggcagcgtaccacaacatcccctatgttgctgggtaaatgtaaattctctccccatctcctgtgaggcaggctggggtagttgtaaagagaagttccaaaaggtgtcacaactagtgacactttaagagctcaaggaggtctcctccaaac

SEQ ID NO: 472110 - DNA, 756 bp, Homo sapiens
gagcgcagcgatgcctgtggccagttgggggcagcagagggcagcagagcaggaatcacgaggtgctggcaaagagggcgggtggtgctgcagctgcagtgagaggccctgggtggaacgcgtggccactgggtctgctctgccccagatctccaggccacactttctggactggcctggattagacagcaaagacttaatcatcaagtctcctggattcctcttccttaatatcactcaaatacaccctggcacaggtcccatcctgtgccagtcatcacctctgacattctggaagacagccgagtcaggtacccagggcaaggacagggcttctatctggggcaccctggaggactttgtggaagaagcctacctgctggttgggcccggaggagggtcaggatttcaacaagcagagacagaggcatttcatgccagggctcagctgggcaaggtggccccacactttatggtggtggaaggagttgtgataggggagagtgaacagggtcaaacgctccagattgataagatactgcccactgagacattgaatctgatgacgtaggtacaatatttaccatcattttacacacaaggaagctgaaatacagagtaataactattttgctcaagattatatagttatgttgggacaattgattattcacgtgcaaaagaacaaatttggacccttacctcccaccatataaaaaagtgaattcaaaatgcaaagacctaactgtaagagct

SEQ ID NO: 472111 - DNA, 2968 bp, Homo sapiens
cacccccacctctgcgggctccagggcaattgctaggttcttctcactttggcgatgtgcatttgttgtggacagttcgaaagaggatctggagctcgagatggaagtctgtgcaggggaggtggacttcgaatggcctgtgctgcagttggtaattgaagctgtggtgcggacacggtgtggacaccgtttcagaggtatggtgggagaccaagcaggggggagggcccaggacagcaccatcagggatgctggtattgagaggcggggcatgaagaggaggtcatgctggagtctgaaagggagcagtcagaggagaggacttcaaggggagagtggtcaccagggccacctactcgtcaaccctcaaaggaagcctttgccattcttgtttcacaggtgtaacggcaaaataacttgcagtagaattgggagtcaaatctggctctatcagattccaaaggccgactcttggctatgcttacacttctacctacagaggctggtcacccacaggacatccatgttcagttctcaatccaggggtgcccttggggaggagggcttaaggaggcctgtcccactaggatgagctctgcattagttatactgctcttaaccgtgtgcctggggaggtcccaaccattctcccctcaaccttactctcaagttaactccatatgacctgtcttctacctcagattctctgcttagcccccacgattcccaaagtgactggagtctaccataaataccaacttaataattgctaataattccatggcacaacctacattctagcttctctctatacattagtcttccagcaacccttgagatagacagcattatctttgttttatagatggggaacctgaggcattgagcatttaagtactttgcccaagctcacacagctggcagatggcagagctgggattcaaacctaggcagcttgtgctcttcactgctctaagcccttcctcttggctcatggccatctcttcttcagatcctatttccttctgtgaatctagtgagtactcaacaacataaggctaggcagtgcctgccactcgtggatgatgggaatgagggtggtgatggtggggacacttaggatggcaccctgcctgttgtctctgaagatcacgcctctctctgattccccttatggtgcagctgcagactttgatggtggggacggatttgcctggagccatcagcacttggaaccttgtgtttcaaggatgttaaagggggcagtttcaacaacttgttgtcagacagacttggttcaagtctatgggaacttagacacatgacttaaaactatccatgcctctagttactcttcagtaaaatggccacgacaagagcagccccattccccctgcacacaggatgggggagaaggaggtgattataaatggcaaagctttgtgcgttcgtacacttaacccaagccctactcccaggccccatggagcagttgggagtgcgtgtggttattccattaggaagaccagagtttgaatcttggcttttgttactccgtctctgcctcccttggcctcagttacctaatttatcaagtgggggtaataatagtatctaccccatggtatacagaagcaactgctttttttcaaaccaccactgtgtacacaccctttgtcttttgggaaagaggcataatttttctccagggtggattgttctttgtttagcaacatgccttgatggccttgatggctgtttttagagggaaaattacctccccttctccaagagcatggactcagcaggcttggcaagatagcaaccctgcctgctccactgggacagatgctgctggtgcccttgtgcccctgccctccatgctcagcccctgcgaggttctgaacccctccaaatgagagccttctcagggcctgcctgagatgcaggttggacctgccagggagtcactgccactgggagcagccttcagccaatagcagacggaagttggaggctaaacacagcttctttgaccctcaggtgggccgactctgaggtgtgttccacacctcagtgaaatgtcccagtgaaatgtcccagtgaaatggagcccctgttgcccacagtgatggctcatcagcactctgtattggctcacttcccttccccttcccataccccttccccttcccacgccccttccccttcccatactccttccccttcccatattccttccccttccttccccttcccacacccctttcccttcccatactccttccccttcccataccccttccctttcccacaccccttccccttcccacacccctttcccttctcacatcccttccccttcccacaccctttccccttcccatacccgttccccttcacacacctcttcacctccccacaccccttcccctctccacaccccttccccttcacacacctcttccccttcccacaccccttccccttgccacaccccttccccttcccataccccttccccttcccacgcccctttcccttcccatactccttccccttcccatttcccttccccttcccacaccccttccccttcccatactccttccccttcccatttcccttccccttcccacaccccttccccttcccatactccttccccttcccatttcccttccccttcccacaccccttccccttgccatactccttccccttcccacatcctttccccttcccataccccttcccatatcccttcctttatgaagaaacataagtctcttcagggcttgtcggggctcctgccgtcccctcccctcctccctctcctcccctcccctcccttcccctcccctttttctccttccttttccctttctcttccctcccttcccctctcttcccctttttctcttcctttcctttccctccccttcccttctgtcttccctgttccttt

SEQ ID NO: 472112 - DNA, 948 bp, Homo sapiens
agggaggtgactggtctccagcatggtgtgtggcttgctctttctgctgtccgccacggcaagagccagcccaggggcagtcgtggaaaacctccttggcgttgagttgctggaggatggattgcaggaggtgagtctgcaggcagaaatccaggagtcctccctgtacctctcctccctctggctcctcagaatcctcctggagatgcagttcccctatgctgggcctgggctctgggatctcaccatttcccttttccctgctgctcagccagggcccctactctggcccctgggcccaggagaaggaaggctctttaggttccagatggcttctttgcctctgatccctcgtagtcactggaaactctttggccgccaagaaccctccacaaccaaccatgaagcatcatccctgatgactacctcatgctcccctccagcccgggatcaacagctgcccttcacagccgtcagatgtgggccgataggaggtgacactgagctgaaaggtgtctgctatcaagacttgaacagaaagggcctctacacgttggagattttttttctggcagctgcctctgaagacagcagctatggaggcttttgttctattgacaggaggcgaagcagctacaagctccttaatcacctcttcacaaacatggggaagcctcattaatcccagtgagcagatgatctattgttcccagctcaggtctctggaaaactggcctttctctgcagatgcagaatccacccccacccaactgggcaggaacattctgtccccttttctcatgtagatgaactgctaacactctgtccccttctctcgtgtagatgaaccactaacattctgtccccttctctcgtgtagatgaaccactaacattctgtccccttctctcatgtagatgaaccactaacattctgtccccttctctc

SEQ ID NO: 472113 - DNA, 662 bp, Homo sapiens
ggtttgagttaatgctccttagaaggagccgatgggtccctccggggcctttcgggagattacagatcgcattcaaaccaatccaccctggagaggaagggggagagggaaggcgagtgcactaaatcagccatctgagcccaggaagccaggaaacctggagagggctggaggcagcaccagaacagtggaaccttcagcccatggaaactggcaaatttgcagactggtacattttttaagaacctgctgggagaccctaacaggagaagcagagaccaatgttctgagactagtgtttgtggcttctcttcgtaaagagaaggcaggctattctctacctcctgattccctgacttttgagtccctagaactcaggccatatgacagagaccagttgggtgctccaaatacccacatgctactgcttattctcagccttccttgcagttaggttggggccatgtgactggttctagctgatgagatgagtgcagaactgatttcaggtcccattttaagatatccagacactaagtgctctggtgagagcccagtcctggctggcatctttactgcagccttgtgacacttctggtccacagaccccatgagagaataaatgtgtgttgttttaagctgctgagtttgtagtgatatgg

SEQ ID NO: 472114 - DNA, 723 bp, Homo sapiens
ggcgagcgggagccagataggagctgatgggggtgggctgggcctgtgggctaagactgcagctcctgtccttaagcccccaccttgtcccatggtctgagagcagaacgtgggtgggggtggggaagccggagaggaacagatgggaactgtcagcaactcgttagggttacagatggggtgctgggggcctggcctgctggtgcgggctagatggcagtgctcctcctcactgctgtcattccagggcagctctcaacttccctgggaggctagggatagatttgatatagggtgggaacttacagcacccccagatcacaagggagaggggactgaagaccatctttggtctgcaggtgctctggggaggaaacagtggggcctcagtttcctcaactgtggtgtgggagaaaaggatggacatctccgagttcattgtgagagtccagagagatggcagacagtagacactcagaacacgctggctctgccctgtccccagctttatctcgtggccagggactcagatcacataaccaacagtcaggcccaactcacttgtcaccttcatctgctgcagacggatgatagggtggataatccgtattttgtagtggtcttggctgaggcttgtctgctgggaaccagtattttggattatcctgctacccaaacttaacggtattagtttaaccagaaggctttttctgtcagtacaca

SEQ ID NO: 472115 - DNA, 518 bp, Homo sapiens
tacaaggggttgagggaagcagggaatgaagagttactgttccatagagacatccagtggtcacattgtgcactgtcctgcagagtgtcccatgtggctgggaatccaggccctcagtccaacagtccacaaggaaatgaatgcagccaacaaccagaagtgcctctccattgcttctgaatcatcagagatgctctctacatgcacaaaattaatactaagcatttattctgtggagaaacataattgccaggctgctaaaaggaaagcttgtaagggctcacagataaaacaacttcactcaaacaagaaggctgaagcccttgatgactatttggtccaccagctaattgacccatatcctatgcctgtgatatgcataaagccacaggatgtcaatcagcaaagtcagtggaaagctgggaaattatacgttaggactacgtgaagtatgtgtggaaacagatgatgataagtcctgccgttgagcacagacgaagaatcgtctttaggaggag

SEQ ID NO: 472116 - DNA, 665 bp, Homo sapiens
atctgcaagttccaaagacctatgaaagaagcatggtttccttgggtcccacaattactcactgcttttcttggctgggagtcactgtcagcattttggtcaataccattcaacaaatctctaggaagttccaaattttcccacattttcctgtcttcttctgagctctccaaactgttccaacctctgcctgttacctgcttccaaagtcgcttccatatttttgggtatctttacagcagtgccctaatcctgaaggcttatgccattaaagatgccattgttgttatagaaaaagctttgaaggccatcaagcacacaacaagaaattcctgctggagaaaactgtgtccagatgttgttcatgacttcacaggatttacgacagagacaattaaggaaaccgtgaaagatactgtagatatagcaaaagaaaataagtatgtagatgttgataggtagaaaagtttaggttaagaagcaaatgtaaaaagaaaaaaactctgacaaatatgttctaggaagttaccccagagagtggtacaactctatagttttatctattacctcaaaataatggaaacttctaaatatggttatggctgttaagattattaaattaacaccattataagtaatttcactttctttctatgattttgcaa

SEQ ID NO: 472117 - DNA, 677 bp, Homo sapiens
tgtataactgcggatggaaggaatgaacaactccagacgcaccgcattaagagctgtaacactcaccgcgaagcatctggagactcacatcatgaacttttgctcaaagaacaggaacataccaggaaaaccaagagaatccaatgaccctttaaaggaactggatccctgctgcaggctccctgagatgctgaaaaactgtgagttggcttgctttctcagcaaggaggctcatggtctggggcaagttctcagccctggtcaccagctgcctggcaatagattcagtgctgttgggtggggcactaggggagtgagactggcctttagggctgtgggctacatgggaacaggaagatcaattattgaactaatcaaggaatcaccagggaaaggtgaagtccaacttaaagaaatcaaaatcacgatacaggatatgaaaggaaaattcttcagtgaaatagatagcataaataaaaaataatcacaacttctggaaatcaaggacacacttgagaaatgtgaaatgcactgagaagtctcagtaatagaatcgaacaagcagaagaaagaaattctgagttcaaagacaaggcttttgaattaactcaatccatcaaagacacagaaaaaaagaatttttaaaaattaacaaagcctgcactaagcttgggact

SEQ ID NO: 472118 - DNA, 871 bp, Homo sapiens
cagagtgcctgctggctgcctgcttttcctttgtctttttcgataatgctaatttggttactcttacatcaatgggggatgcagaaaagactccctctgaagggctgctgggtggagaattcagctggccaggaattctgaagttaaaacccactcactacgtggtctttagtaagttcaggatgaccatggctttgctcgtccttgtctccatagcccccagggctggtcgttggacaatcattcattttctatctgggattaagcccagcccagccgggactgagagtgttccccacccagcttccctgcacttgtgtacgctcagccatggcctaaaatgcggagttctcatttcgaggctcaggactgatttctcccgccctcaatgtggggaggtcctgagtccactcattctttcaagtcctgcccagccaccttctccatggagaaggaatctcctgctcggaatttctacatcccttctcctgttcctttatgatgagccgtaatcctttcacattacaaaatcaaaatgcagaagcatgtaaggtaaagggtgatgttttccccattcttcttctccagtgtcctcctctccccagcacctccttgtgtaagcaatgttttgttttgtttgcatcttccaatgtctttctttgtgttcacactaacatattcatttatatattcatacataaaggggttttctactaatatttaaatgtgctctcattgcacatacacaattacctttcttaacttaataatatattatgggcattcctccatgccaattcacatatatctttcgtttaaatggcttcataatgttctatacatttattcaaatctttccctgttgtcttcc

SEQ ID NO: 472119 - DNA, 622 bp, Homo sapiens
tgtgcaggaggagaagccaaggtaagtagacacgttccagccacaactcgctgcctgtccctccccagccagtgcaccaagagcctcctacatgctcggctctgcccgcgctgctccctgggcctgcagtgcccggcccggcaaagcgggtcctccttcagggacaccagggcctggtcctgtcagaggcagcaccctgggaaaccttgagcaaagcttcccttcaagcagaggaaaggaacatgagagtccaggaggcctcagccacagcgcaaagatggaagtgatgaccgggagccactgcagacacagggaagattccatcctgctcaccctgagacagccatgcctgcatcctgaagtgaataccaataccctcactagatgtacacactgcaaaatacaccaacatacaggcacagctgcagagacactcacgacaggcatggacagatttacatacaggtacaagacacatagaggcactggaaagaacaaacatgctcatagacgtagatgacacttgcacagatgctaacagaaagcacagactcatgtctgcagatactgacagaggtcatcagacacacaccagtgtggacctacctgcatggacagtgca

SEQ ID NO: 472120 - DNA, 664 bp, Homo sapiens
ggttgccactcagctgcccgtgtggccaaagtgcacacacacttgcataaacacataaaggtgttcacacactgcaaacttgaatacttacacgcaaacatgtccacccgtttccacaccacacatgtaagcaatcacgcacgatgcatctgcatgtgcaaacagctcacggccacaggacttcactggcgtctaccctccttcagagattagagatcagtgattgtggttccttgcatcatctttgtttctgggaacatggagctgtggagggaatgtggactttagaaaattataaaggcatggattttagcccaagcaccttttgtatgatctcatttgttaagtggaaactgctgtctggcaagaaaactttccctgtactttttggaggaaaactaagagctctagaaattgaggtgaagtggaaaaaggaggtggttccaggggggtttctgcatcttcagatcagaccaatgttgcagtatgacgtgatatttgaaatcataaaagaaaagattgataaatttgactatatgaaaattaaacatttaagtaccttaaagaacattataagaaaattttaaaagaggggtatatacatatgtatgtgtatatatatatatatatatatatatatatatatatatatatatgacaacag

SEQ ID NO: 472121 - DNA, 1114 bp, Homo sapiens
cagctctgagcaagagcaagagccggagcagacctggaccctgcattaccactgctccgtggcctggaatgggatattgtccccatccttgggccttccctggagctgggctggcctggagaggagggagtgctccatccacacagaagctggtagagctgacccaagcagctcatggacagaccaagcccatggccaggcaccctccagcctctgtgggtcacctgccttctccccttgtcatcacagtccctccggaagctatccacgcctccgaggaggtagagagcagaatggtgaaagacaggggctctgggaccagacacctgggcaaaaatcctgtctccacttcttatcagttttgtgactttaggccaactacctacatttctgtgcccccatttcctgatgaggaaagtggtacccagagtgacttgtccacggcagcaagatttgttaatgacagaagctgggataaagcccactttttctgactcccagagcccactcagatgtcctggatatggacctgggacatggactcccaggtccatggcaccccctgctggggcaaacactgtgttcagtgcttgggtatttgcccaaggcaggggaggttccaggactcaggactgggccagggagagaagctggggaccaagggtgatggggttcattggctagaagctgcccctccctccactaccccactatcagggtgtgttttgaaaacagagagactcgtttttatctatctctgtgctcaacacagggctcttatctttctctgtgctcaacttaaatctcatgaggctcaaggaagttgtgtaatttgcctgggatcatcaagaccgtcaggaagcccttctgattgatccactccaagcctccatgtactgcgcagttccatgtagcgcctaagaatgtgggccctggcagctgcccagacattcatcctggctgcaccacctattacccttgagacttttggcaagatacttaagccttccaaacttcagtttcctcatcggtaaatgaagataataatagtgccttctttgtagaattgctgtgaggagtagataagagatgatatatgtaaacacttagaaga

SEQ ID NO: 472122 - DNA, 1085 bp, Homo sapiens
agtgtggtggtggtgatggtggtgatgctggtgatagtgatggtgatggtgctggtggtgatggtgatgatgctagtggtggtgatgttggtgatggtgatgctggggatggtgatggtgatggtgatagtgatgctggtgatggtgatagtgatagtgctggaggtgatggtgctggtgctggtggtggtgctggtggtgacggtgatggtgatggtggtggtgatactgatgatggtgatggtgttggtgctggtggtgatggtgctggtggtggtgatgctggtgatggtgatggtggggatggtgatggtgctggtggtagtggtgctggtgatagtgatggtgctggtggtgatggtgctgttgctggtggtgctgctgctggtaatggtgatggtcatggtggtggtgatactgatgatggtgatggtggtgatggtgatggtgctggtggtggtgatgctggtggtagtgatggtgatggtactggtggtgatagtgatggtgatggtgctgggtggtgatggtgatggtgctggtggtggtgatgctggtgatggtgatggtactggttgtgatagtgatggtgatggtgctggtggtaatggtgatggtgctgctgctggtgatggtgatggtggtggtgatgctggtgatagtgatggtactgctggtgatggtgatggtggtggtgatactgatgatggtgatggtggtaatggtaatggtgctgctggtggtgatgctggtgatggtgatggtactggtggttatggtgatggtgatggtggtggtgatactgatcatggtgatggtgattgtgctgctggtggtgatgctggtgatggtgatggtactggtggtgatggtgatggcgtggagttgatggtgatactgctggtgcatgtgctggtgatagtgctgctggtgatagtgatgatgttggtggtgatggcactgctgctgatactgatggtgatggtgatggtgcttgtggcggtgatgttggtgatagtgatgatgacggtgatggtaatggtgatgatgatggtgatggtgatgctgtggtgttgatggtgata

SEQ ID NO: 472123 - DNA, 761 bp, Homo sapiens
agcagagctcttagctcagtcccgtgggctctgatgcttgttactagtgttaaccatggtaacgatgagtacccgctgaagcagccccagtccttgcaaatcccttccaacttgaccttctgtgattctgaggctgcttggacttcccatcctgaccttatgtggctcttcgtgtctcaggggctccagctacagctggaggtggccccggaccccgtggctgggctgctgtggaagttcaactcttcacaccaggatgagaagttcctgtgggaagaagactgggaggaagagaaaagacagaaacggagcatgggtttgcagagtggctgggtctgcactcggcttcactacacagccgctgtgtggccctggacaagtcgcttcacctctctgggcgcccccgcttctccatctgacaaatgcggctgtaatttacccttcatggcattgtccagtgggatcatctgagcaaatgtgctttgtaaatggacaggtgctccatgctgccgctttcagaggtctgattctgctgtcaccctctctgaattttccccttctgtaaggggggcagagaggctgtcatctcaaaccccatttgagctgccagagatgttctgattccttgtggacatggcctcagaagcttctgaggcagaaatcctataaccagccctttcctcctctggttcttctctgtgaccagctttgatgccagctcatctccctgggggagggttaattactcgcaggcactatcc

SEQ ID NO: 472124 - DNA, 1158 bp, Homo sapiens
ccatgcacactgacccaaacgctgttttggcccagaattttccagcttgagcagcccaaacgctgtgtgtgatgataataataaggacctttagattgtgctggggattaaatgagataatacatgcttctggcagggagcagggcaccagccagtgacctgtggtcaggtcccagctcctccttccccttcctgctcctgacatggatgcccactctgcctagccatgccctggaaagacacccatcctatcttggctaggcagaatgtcagctctgtcttttttgaatttgtcctccaaggatttgcagaagatgggaacaggggaggccttctgaatatagtgactcttctcccagctcccagaagcacatctggcttggcagcatctttgggccacccaaagccagggtcccttggcccaggcagcatttgggtcagtgtgagggccttcacaattgaagaagaagatggataccatctgtctcaaagccgggcacctggaaatcactcctcatacctccttcttcaccctccgtggctagtcagtcaccaaggcctagaaagatccctccagaatagcacttggagtgacccaatctgtttccctggctggagagcccagtggctctcccctgaatgtctacaatgacatctaactgcatctcttacctcctttcttgtccttttagaatccactctccaagtagcagcttgcagagtatttaaaaaacactcatctgatcgtcccccaattctttgttggcttcccttttttaagaaaaatgttcaaaatcctataaagaaggacctgtttttaccttattttgcagagggggttcagtccaacttcagtggctttgcatatgcctttcctgccccctggaattctcttccctcctctcatgatctccctgccctcacctaacttccctggggtaacttctgctcattcttcaggttcccgttgccttgctcactgatggaggccttcctggctgtgtctgggatctatgctctcatagcatcctctgtctttcttcaacacacttatttttgtaaccatcatccctcctgtgaccatcgttttaacctctcctgggggagtggtaccataaaggcaagctcgggctgctataacaaaatactgtaaactgc

SEQ ID NO: 472125 - DNA, 853 bp, Homo sapiens
tttgcatctgatggcttctctattctctaagtcttaagggatgtggcagcccatggagctggatgctggggctttgtcttgggacagagggattggaaatggcctaaagggtggatttgccagggttgtggtgaggatcacatggatggtgtctgtgaaacacagcacgctgcccagcactgagtcagctctgttagtgacctgggctgcaggctcgtcagtgcagtccccaaacattcccagtccccctccttctgggtatatggaagacagcttctctggctgccttggggtcgagtggagccacggactgcttccagccgatgagttgggaagtgacccgggcatcatgcttgcctgtgggagactctccaggggctttgttcccctttgccccaatgactggggcagtatgggtcctggaggaggacacagaacagaccccagaggatctatcctggtcttgttaaataaatgagaagggaggaaatcaaggggctgctgtccacacccacacaggagcccctgcctcacccctgccacacccctaccttgcccctgctttgcccctgccttgccccctgcctcgcccctgcctcacccctgcctcaaccctgccatactccccgtaagccagcagattctgttgttgctgtaggtgggctgtactggaaggacagggtgggctggagagaggaggaggtccctctggcgtttcaaattcagtagacccagaacagaattcctcctcccgctggctcctgcttctggcttcctcgctcagtggggaccccaggaatccttcccgtggcccagcagagaaccctggatgccatcctgtgcttctccattt

SEQ ID NO: 472126 - DNA, 652 bp, Homo sapiens
ggcaacaacaatgctaataggaattcttcttcccaagtttccaagtggcatcttccaaacccaatttgggtttggaaacgggagagaaataagtaggcccaagcttagccgcttcccctactcctcccccggccccgtgggcgatgccaaggcagctggagttccgggagttgggggcatctctgccatagctgctgactttggcaaaaaagaaatcctcctccttaataccctctccctccagaatgacagggggtttgaaagtttaaaacgtagggctgtatttgaatgtttggtcttgataggcgatagggaccagcatggaaaatcatctttatcaccccaatatggaaggcaagtgtcagaccgtcttccctgctgtacagagccagatagcaccgagctgggccggcgcagcgggcataataagaagtggaaattgctcccaaggaaagtttctgaggaattaacttctgatgggtgaagggggcagtgtgggggtgggcaggtggggaggggtaagggagccgaaggaggaagccccatgactggcagagggctggtagtgcattgactgtggtgaagtgtggaactgagactaacgcaaatgtaggaagtagaggaatagataaaaatgtgaatgcaggcatcc

SEQ ID NO: 472127 - DNA, 1451 bp, Homo sapiens
gcagtggcgttagattcccatagaagcatgaaccctactgtgacctgtgcattgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggagaagaagaagaggagaaaacacacagagagtaccatgtaatgaagggggcagagattggagtaactcatctacaagccagggaatgcccaacatggtcagctaaaaagaagctaagagaaaggagtggagcagcttctccccagagtcttcagagagagcagggctctagcaatactttgaattcagacttctggcctccacaactatggaagcataaatgtctgaacaatcattaaacttttcccatgctcagccacccctttccccctaaaaaagaaaaaattttccttacgcttactactcattggacctgatttttctcattcatgaaatgattattgtcaggatttaggaatatgcctttcctaagagttgcattaaccacttcacgcaaatgaggaatcattttgagaaacctaagaataattcttaagtgacctaatatgtcacttaatattctccattgaaacatgctgcatctgaaactcccttaaataaatacaataaataatgaggtgctacaacatgttcaaaccctgagaaaactccagtttgggagattaacattatgggcacttattccccacccaccctgactaggttttgttgttattgaattgaaagaaaatagaccttcggagagtgaatgcatattgtaaagaaaagaaatgtcatcatagggcatcctttttgtcttgacttgataaatataagttattggcaaatagcaaggtgccaaacaaaataaagaataaaattcttaagaaagtcaaggggaatagtacaaattctgcttcactgctgaaaaataatagctctcacttcgttaatgaatagagactcccattcttctctggtatctctaggcttgaatagcaagtccaagtaactattttcagatgtaatctcttaagcataaattatttaaaggcagagatctttgtcagttgtgttcaatggtgtattctatatgcctggatgagttcctgttatgcagtaagcattcaataatcttgctagcggtctatcaattttgttgatcctttcaaaaaaccagctcctggattcattgattttttgaagggttttttgtgtctctatttcctccagttctgctctgattttggttatttcttgccttctgttagcttttgaatgtgtttgctcttgcttttctagttcttttaattgtgatgttaggatgtcaattttggatcttttctgctttctcttgtgggcattt

SEQ ID NO: 472128 - DNA, 1863 bp, Homo sapiens
gccgaggcagatgctccaccttccctgtacccttctcactgaccggactgtggatgtgatggcgggagctggagcaggaaacaggaactggggggacagcaccctactgcatgggagcagcaaggaaacaggaaatggggacagcatcctactgcatgggggcgcagggaaacaggaactgggggcacagcatcctactgcatgggggcagcaaggaaacaggaactgggggcacagcatcctactgcatgggggcagcaaggaaacaggaactgggggcacagcatcctactgcatgggggcagcagggaaacatgaactgggggacagcatcctactgcatgggggcagcaaggaaacaggaaatgggtacagcatcctactgcatgggggcagcagggaaatgggaactgggcagacagcatcctactgcatgggggcagcagggaaacaggaactgggggggacagcatcctactgcatgggggcagcagggaaacgagaactggggggacagcatcctactgcacagaaagaggagaaccccaggggatgtgtgggtggtggcagcttttcagagaacaagcagttctctgaaggggaggagctgagatacatgctccaggaactgtccggcagcagtgggaaggagctgagatacgtgttccaggaactgtccggcggtttcttacagacccagagcagccccatacctcggtcaccaggactgctggctggtctcaaaaggggatcaaagtgggagaccttcgggcaggtctccataactgaccctaccaaaggcctggttggtgcagccttagaagtcaatccttcagcagctgatggggagtgggaggacagtggtcgcctgtcagcttccctgctgtcttatgtgcacatggcaggggtgccgtacagcctggaggcctggacaaatggaattcaagggctggggaaagagtgggctgaggccttaccggtcacacctacaggctgccgagcctgccaggcagcttcaattgcagggttcggctcccagagagaatggctgctgttctattctaccttggtccctgggatggaaacctgattggattgaatcctaggatatgtcattttccctctgctagctgctggtcccagcgtctcccatacctgatggtgtgaggctggaccagagccggtatctatgccaggagagtctggggcttggcctgtttctggggcactggggcactggggcagggaataggtcttggctgctaggtgagctactcctcaatgcacccaggagctttccagatccatagccctgaagagagaagagagaagatctcacggactgttgatctttcacctttccctctctgctgtccccaacctgtcatctgtgccacagaactgaggacctagttggagagacagacaggtgagatagatggctgagagagggaccaaactgccccacccccagccagcccttaagaacctccttttaaaattgctttgcatcatatttctctccctgctcagccccactggctccagcagctctggcctcctcatccatcatgctggctgcagggcacgagcgtatgtcttgcagagaaacctttctgccctaggcctccaaggggaagggctcagctgtcagagaagagggccgtttccaaaggggtcaaagcgctggaccctccaggattgatgggctatgaattatggatgtcgcatccgccagtcccaaggctccagagccagagagggtatccctgccttccttctttgttggcgtcttctctctggcatccctttagcgttcgctcatttcatattaggtgccttcctgtactgatgttacttgtc

SEQ ID NO: 472129 - DNA, 555 bp, Homo sapiens
aaatccacaattatagctgaagattgtaatgcctgtctctcaatgattgatgtaacaaataaacagaaaatagcaagttatcgaaacttagagtggttttgggaacaccctgagctttcagctggtgtcagaggttctgcagctggggccccagaaattaaactgaggatcactcaggcagctgtgttgagaacagactatggaggtgcaagggtggaagctagaagacctgttactattccagcaatgcaggcaagaaatgatggtggtagcagggaaaacagtgaaaattggttagatttcagatatactctgaagagaaacccacaggaagaaatgggtatggtgtttgagagaaagaaaggagttgaagctgacttcaaggttctctctaagtctttgcaatcttacgtgtaccgaacacttacagcaatctcaattcaggctaaccacatttctaatgctttatagcgatatttttctcacctcaaaccttcagttccatacccaccctaccagaagttcagggatagtcaaagtggctttctgagatca

SEQ ID NO: 472130 - DNA, 543 bp, Homo sapiens
ttcatgtttaattgtttgttgcccgctagctttctggtgtaaagggtgacactactcagagcagtgcccaagagtccaagaggaatcagtgccatgctactggcccattgcattgggtcggcagagggagtggcacccaggaaagcagcaagctgggtggccacagtggagcccctccctgaagtggcctactgcaggtcctggccaagggccctcccatgccaaagtcaagacatgttaaacactctgaagtctaaagctcaaagctacacaccttacataactcaatgcccctttgtgtgtacattttgccatccaaaatttaactccctatttacttaccagggttcacagcccaacatttcaggtgctgaggtttttgaggttacacatctgaaatgcaagcctccgtactatagaggcaacgtttgcctctggatatcttccttcacggatgataactatcagaagattctactttctacaggcaaaccagcttcctggaggaagagattaggttacccaggcccattttcttaaact

SEQ ID NO: 472131 - DNA, 621 bp, Homo sapiens
cagtgggaggggttacgattgccagtatggaactgccttttaaatttattttgttattagacaacgcccctggccacccagaaccccatgaattcaacaccgaagactacggtgtggagacaggtctgtatgggaacaaagtgaaagcagagaaaccagttgaggctgttgcacgggcaacaaaagtgaaaacagacaaatgggattgtaacaaactggaaagctcctgcacagccaaggaaacaatcaacagagtgaagagacaacttgtggaatgggagaaaatatttgcaaaccatacatctaataaggggcaccagacaccggatgccacccctggcatgaaaactggatgttactgttgttggaataaagtgtttcctggcttctttctttgcattactatttcctcagtcaacaccttgggtggacatgtccacttgaccaagccaaggtcacatgccttctcccttgctgcaagaggtgctggggcaatacaggaagggaatttctagagggggagggagctggaaagctgtgaatattttttaactacacctttgttttctcagctatgtaatgtgtttattatcgtaaaaattatgtattgctaggttctac

SEQ ID NO: 472132 - DNA, 639 bp, Homo sapiens
gtcccgtgcgcccgcactcctcagcccttgggtggcgccgtggagcagggggcggcactcctcggggaggctcaggccgtgcaggagcccacggcgggtggagggggatggggaagttcaggcatggtgggctgcaggtccgagccctgctggggaggcagctaaggcccggcgagaaatcgagcacagcgccggtggccagcactgctgggggacccagctcacccttcgcagctgctggcccgggtgctaagctcctcagtgctcggggccggcggggcggccggccgctccgagtgcagggcccgccaagcccacgcccacccggaactctagctggcctgcaagcgctgcacgcagccccagttcccacccgtgcctcaccctccacacctccccacaagccgagggaaccggctccggcctcggccagcccagagaagggctcccacgaaggcaccgagagcgagcgagggctgcgagggcttgccagcacgctgtcacctctcactatgatcaattgagaacagcttccttagcacattttaagtgctcaatagccacttatggttagtgacaactatattaaacagcataggcataggtcctttatgaagagttacagaatacctcatttcc

SEQ ID NO: 472133 - DNA, 933 bp, Homo sapiens
tcagtctcagcctggagccagctgatgttctggttcatttcagagatttttgtctttgtgcgacacatcatcttcatgcttcccagccagtgtctgcagttcctcgtacttgatctgcctggcccagctgtggttggcaatctcgtactggtccttgacctcagtggtgatgctgtctgtgtccgtggagtggctgttgtccatggacaggaccacagatgtgtccaagatctaggactgcagctcctggatctcctcttcatacagctgcctgatgaaattgatctcgtcaatcagcccttccatgcaagactccagctctacattcttcatgtaagctttgtccgtaaacttcttgatgaagacaaatgcattgtccatctctgtacacttattgatctcatcctcatgcttattcttgaagtcctccagcagcccctccatgttgccaagctctgcctccagcttcagctgctcctggcccagaatgtacagctgctgctgaaggttgttgatgtagctctcgagcatgttgtccatgttgctctgtgccgtcttctgctgctactggaggctacacttgctctgcagcatcttgttctgctgctccaggagctgtatcgtgtcagtgatggaggcaaacttattgttaagagtcttgatctgctctttctcctgggtacacatggcctggatttgagtatcccaaatccaaaatctgacatgctccaaaatctgaagtttttttgagagccgacatgacactcaaaggaaatgctcattggagaattttggattttggattttcagatttggcatgattaatgggcagttattgagattcacatcatgtgcctgaatattgggttgggaagtcccatattttctcttatgaattttaaaaattttatcaaaattttggactagaaataa

SEQ ID NO: 472134 - DNA, 706 bp, Homo sapiens
cctgtattcaccacagctagagatggccgaagaaatatatgtggaagaggtagagcatctggaaactttaaaaggggctaactctggtggtgccaattgcaagtcccaggttatgacctgtgattctgatgtaccaggtataaatctgggttcccacaatcccccttctcagatgatgaaaaggatccagccatgcaaagaacattcaggtagagagaagaacaagcaccaaggctctgggctggggagtatgttcatggagacccaaggaaacatgtctggctccagagaagtgaaaagggggaataaaggaaacttccagtacggctccaacactttgttagcaaatgaggtacccaggtcctgctgggcaggaacagatactgaggactcatcattggtttgtgaaaatacacaagaaatattaccatccaggaatgctcacctgagctttggtgtccggagtttttattggggcctcatcataaagacatgattgattgcccatatggttgaattcagtctccaggttggcttctaccagcgtggtatgaagtttacatttaaaaaaagttttcacagaaatctaacacatgcctaaaaagattttacaatgtagttctagatgcaagtctaggcaatatcaagaactgatggatctcatgactcaagacagagcattttaggtatcagttacttcttagga

SEQ ID NO: 472135 - DNA, 663 bp, Homo sapiens
tcctccacttctagagcctcctccactttcttcttgttttgttttttcctcatagtgcctgctagctttctggtgtaaagggtgacactactcagagcagtgcccaagagtccaagaggaatcagtgccatgctactggcccattgcattgggtcggcagagggagtggcacccaggaaagcagcaagctgggtggccacagtggagcccctccctgaagtggcctactgcaggtcctggccaagggccctcccgggaggcctgacccaggccaggccaataattccttgcccacaattttcaaactgggaccgcgaagagagtcagcctctctctgattacctgcacaatcagccggcaattgtgtctgtctataattgtgtctccttatttccatatggaggaagccaggaagctttaatggtacatgaggaaaagagaagaaaagacaagggctatagaaagtctgtctttccaattgttccttggggccagctgcatttctgcccttcctatgatttggttcatcaattcttccttgacccaagctggttaaacagtttctgtctcttgtagccaagaggtctgcccattacaaagaaaaatttgcagtgcactgtcatacagcatgtatgaaccgagccagggtaaggccccaggaaa

SEQ ID NO: 472136 - DNA, 577 bp, Homo sapiens
gccatttgaatcctctgataaatgaagtcagcctctaccttgaggtactttttgggatcagactacggtgtggagacaggtctgtatgggaacaaagtgaaagcagagaaaccagttgaggctgttgcacgggcaacaaaagtgaaaacagacaaatgggattgtaacaaactggaaagctcctgcacagccaaggaaacaatcaacagagtgaagagacaacttgtggaatgggagaaaatatttgcaaaccatacatctaataaggggcaccagacaccggatgccacccctggcatgaaaactggatgttactgttgttggaataaagtgtttcctggcttctttctttgcattactatttcctcagtcaacaccttgggtggacatgtccacttgaccaagccaaggtcacatgccttctcccttgctgcaagaggtgctggggcaatacaggaagggaatttctagagggggagggagctggaaagctgtgaatattttttaactacacctttgttttctcagctatgtaatgtgtttattatcgtaaaaattatgtattgctaggttctac

SEQ ID NO: 472137 - DNA, 627 bp, Homo sapiens
aaggttattatgtgtgtgggtatgtatgtggctatgtatgtgtatgtttgtgtttggtgtatagctactattttcagtgggaggggttacgattgccagacaacgcccctggccacccagaaccccatgaattcaacaccgaaggtatcaaagtggtctacctactcccaagcacaagattcagcctttagactggggggtcataaggaccttcaaggctcattaacacagttctctatggaaaggattgccaatgctatggaggaaaaccctgatggagagaacatcgtgcaagtctggaaggattacaccactgaagatgccattgttgttataggaaaagctgtgaaagccatcatgcctgaaacaatcaattcctgctacagaaaacttatatattatattcttgcatagtttaatacatttgttatatgctataatatatgattgtgttctgcctgtttctaaagtttatttaaatggtgtcatattataaatattctgaaaattgctttttctattcaagattattttttaatatttatccatattggtatatgtaactctagcatattcatcttaactattgactttttttattgaacgtgcttgaatttatattcatct

SEQ ID NO: 472138 - DNA, 945 bp, Homo sapiens
agctggcttacaaattatgccaagtgtctcccagcagaaaccactgctcaccacatcacctgggcctgaacaggaggcccagagtgaatgggccttcaatgtgcggctcttaaggcatcaccagaggcatcgctggtgctcaggaagccccaggtgctcaggagggagtcccaaaggcttcttggagaaacagggacttcatcgaggccctgaggaaggcggagggcagttggataggcagagacagaaagaagggcaagaaaaagccatgcagaggctccacttatggattagtgctccaggttccatgcagaccaggtgtctgcagatctcctgcctagaggcagcgcttgggttaacctgtggtgttcctcttaagatgatgggatggggacctcaactgggtgaggcccccatgggggcagcgcctgggacactccgaagttctttcctgaacaccaggtgaccttaggagaaaagagattaagtgggatctgatcagcagccagcagcattagattctcataggagtgtgaaacctattgtgaactgtgcatgcgagggatctagggtgcatactccttacgagaatctattgcctgacgatctgaagtggaatagtttcatcctgaaaccacccccacccacccacccctacttttcttccccaccccacccctgtccatggaaaaatagtcttccaagaaactggtccttggtgccaaaaaggttggggaccgctgtactagagaaatggtcacaaggaccctgctgggagagggggagcaggagacagggccccagacacacggcccatcatgacctcttgttgcaccaaggagacactgaggcataggcggtggagccaaggcggcaggtgggggtagaggtgcagtgcccctttatggggagaggggctagggcactgccccagctgtcctatcc

SEQ ID NO: 472139 - DNA, 763 bp, Homo sapiens
gccagatgattctcacgctctgtagtttgagaatcattggctggaacgaagagggctgactagtgacaagaaactggtctggaggagtatgcggacatggccagtcttctcacagcagggggctgtgtccagcagcctgcagggaccctgcaccactccactctgtctgctggccttggaccctcgacgtggcagcctgccttatctgggataagctcgtcctcatcgcagaatcctgatccagctgcctcacgagcagctgctgcagggagggagggcggtggagagctaatcccctctgctttggcccaacaccgaggcagagccatcccccagaaccagatcctactacgggaagagcctgacagccatctggctcttcttcccatcactgccagactcccttgtaccatggcactcccacctcatggtcgagtgacctgtcctgagacttgctctaagtgtggtcagaggacctgcagcatcaacatctcctgggagcttgctggaaatgcagagccttaggcctgccctagacctgctgaatcagaatgtgcactttagcaagattcctagggttgacatggtgataccagcccctttaggcactcggtacgtatttaagtgactgactgacagtgctccacacagagggaacagcaaatatgcaaagaagggcctgattcaagatgtcctgccctacaaatccccacaatcgacagaattatagaatgttggggctagagtggagtttaggagccac

SEQ ID NO: 472140 - DNA, 1008 bp, Homo sapiens
aggagatagttcctgatcttcccagttttcagagggtgcagttgcccagcagaacccagcccgatccccacgccctcctctcctatgcaggcagctcgcagctctgcatcttgtgggctaaggaagcaggtcccacaggcacgtgtcccctccttctcagactggaagaaagttgggtccttcaatgcccaagtcactgttcccgtggaaagacactgatgtttgtacagatgtgcatctctgttgctgcgtggcagcatttttatctcctgtctctgcagagccccttccctgggactgaggagccacagaaggctttgggatctactaatgaagaggtgaccggatcgtcagagggtgcagacatgcttagcaagctggtggtgcgactcagggctagctgcccctggtcacgctccccctgtgcatccgcggcagcaggaaacatttgtcctcaggaaacagcccctcgaagagcgtccggacgccgggacccagcctggatggcagagggggcgttaactcgtcccacaggtgccactgacccaacacgattttttttctggtgtatctttctgggagatgtatctttctgggagatgttggaactgggcccagagaaaagcatacgagaccacaatccccaagacactgcttggtggggtaccccacatgtctgcttcaagtgccacaggtacagcaaggaaagcctgcaggatccctccacatcagaggtaaggaagaacccagaatctggaattggatgccaggagcttgagttctgggcctgatatgaccacctgggggccctttggctaacaccccacttctctgagcctcagttttctcatcagcaaaatgagggcatggatccctatttcagtgtgttattgtaggggtagaatgaggtaacatgtgaaagacctgcgaaggcagaatgctgtggccctgacaagcagaagctttgcaggcaggcagatctggttgggatccgattctctttggacc

SEQ ID NO: 472141 - DNA, 1114 bp, Homo sapiens
ccaggtactgccaggctccaggcactggggaatgcagtccctgctgtcagggagtttgtcacacagctgggaaaccagtcccccaccatgatgagatcacagacaaaggggaccacagatgcctactgtgggcagaagccagccagaaaccagctgactcaggaccctgggacagtcagcctacaggaatcagccagccagctcccccacacagagaagagctggggaatgtctttggagaggctacaggaggctactgtgtatacgggatccctcagcatccgctgccatagccctgagggctggacccaaggcctggcattgtgcagctcagcccatcttctgactgtccaggtgtctgagtggggccaaccatggcggctctacaccctctggggcttggcccatttggcattggatcttgttttcatcttggtaaaccaaatcctggagatggaatacagctgctatctcagcagctggttccagcttgtgatgtgcctgtgtccagcagagcccacggcagccttatgaaagccctcctgagtctgtttctagaatctcctctgaatccataagaaaccgcccagagcttagcccatcagccctgctgacaggctgggccagtccagatgctccaccaaggcctggattctggctctttcactcagttcactcatctgcccctgagtcatccagagaaaggggtttggggagagtccggagcagacagcaaagcagggaatcaaggaagctcttgaccaactggcaggcagcccaagtcctggcatcccacgggagaggagaagggcccctgcctttccaaaccaaaggctcacatgagtgaaggatgggcctgaaatcctcactctggaagcaactgaccaaggtcctcccacccagccccaaccccatgcacaactaataagacaaatgcttcctgtcttgagttccccattcgggtagttttcgcaggggcctgatcttctccccagtctcccaagctttgggcaggtcattgggccctcatccctgaagtcaggcactgggctggatctattctggttttagggttctgaacgtgtgatgactcatcttctgctgaagggttttt

SEQ ID NO: 472142 - DNA, 1386 bp, Homo sapiens
aggactacagggaagcctgtgagcacactgctggaggcctggagcctctgagatgagcgaggatcggaggacacagagcacctcctcaccctgggctgggtgggaaatgggccaaaggcgagggacagcaagggacagggaggacagatgctctggttaaaatgttctgaccttttcgaaatgggtatattcagtgcattcccaaacgcaatcgcggcccctttaacagggccactgcaggaggagctgtcctatcagcaccacggccgccgcccagtgtgcccccaaccccggcagctgctgcgggcgcctcaagggcaggaagggcggtggagagcggggccaggaacttgcgactggccagttctccagaccggggagagagggaccgccgccgaatactggtgctcgccttcctttcccctcgcccccatcctgggagatcagagggagctggacagtagcccacacttccagccttgcagaccatgaatgggatggccaatgtgaatcccgccagccgccctcactacgcctccgccatcccggtgcctcgtgcctcttcccagaccaggattcctacaccgggcgcttctccccagctgcggccacgccaggccggcctggccctgagcccacagagagcagcctcccccagactgggaaaggctgcaggtccttctagaaactcctctcctagggccttccgggggagaggctctcccaagtttgctggggcggtgagggagtcagctgaggatggggaaggccccttcagctccccatggaatagtcccaggacaaccccgaaagcagccctctccagccgggctggatccggaagaattggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggacccccaggtctttggagcctgatgagggggcagcttcgtgggcttcctctccagtctgcagcccagtgcagggcaagcgcccctctccctctccgggggccattagcttctcctcagtccatcagcagagtcagccagtcacagccacggtggcccccttccagtacagctcagactgctccatacagctttagaggttgttatccagggagctgtggagcagttacaagtttcagctatgggaggcggaactatttgctaaacttccaccactgctgctccctacttctctggccaatccaggaatcactcgaggaaccattctgcacatactggttttatcaa

SEQ ID NO: 472143 - DNA, 1200 bp, Homo sapiens
tcaagccctggttttgtaatggacatccaatactggtgattgtcttttagggaggtactgggggacttggttccattcatgactttaggttccaaaatgaaagataagccatggggcagggccagcttctcttcattatactgtccttagggcccagggtggtgcctgatgtgaagcagatgttccagctcatctcaaccacgagaaatcttgcccaggacctctgctatgagaagcagggcctccccaaaacaaagccagaggatcccagcattaagttctcttcactcacccagctcttccttctctccctaccagacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggtcaaaggaaggatggaagccccgcggctcctccggcgcccagcggtgcttttgctttggtgtccggatcccagcccgcggcctgcctgcctgtcagtcccgtggacaccgcactgccgggcagcgccccggccgcactcagccagccagccagcccgagtcgaggctgcaggctgcagctccgagcagaggaaggagggaaggggaaggcggggagcaaacaggaggaggggagcgagtgtgcgcacggggagggaggtgggggagagatagtgtgtctatttctggctcgggagggggagggttcgtggttccagataggaaatgacaagcagtgaagaactggttaaaggaatggtacttgtaatgaagtcacaagccatcacttctacagtcctcatccttactcattgg

SEQ ID NO: 472144 - DNA, 920 bp, Homo sapiens
ctatttcctctctggcctgtccgtggcagagtatgtctatttcctctctggcctgtccgtggcagagtatgtctatttcctctctggcctgtctgtggcagaatgctggctatttcctccgtggcctgtccatgcagtgtgtgtctgtttcctctgtggcctatatgtggcagaatgtgtctatttcctccatggcctgtctgtggcagagtgctggctatttcctctctggcctgtccgtggcagagtatgtctatttcctctctggcctgtccgtggcagagtatgtctatttcctctctggcctgtctgtggcagagtgctggctatttcctccatggcctgtccgtggcagagtgctggctgtttcctccatggcctgtctgtggcagtgtgtgtctgtttcctctgtggctcgtctgtggcagaatgtgtctatttcctctgtggcctgtctgtggcagagcgctggctatttcctccgtggcctgtccgtggcagtgtgtgtgtctgtttcctccttggcctgtccgtggcagagtgctggctatttcctccgtggcctgtccgtggcagtgtgtgtgtctgtttcctccgtggcctgtccatggcagagtgctgggctccaggagagcagaaatggggctgattccttctctaagaaggagaaactgaagcccacaaaggctgagcggcttgctcctgggcatcggaagaagcggggactggaatccaggggtctctgcatccagccttgcacttcccttccagatacatgggggccaggaaggttcttccgaggccagaagctttacaggtttcagagctgggacaaagcccagtgaggagaaagggctccctcgaggaagcattggacaggagcagtgactgccagtgaggcctggactggctggcagccc

SEQ ID NO: 472145 - DNA, 940 bp, Homo sapiens
ggcagcaagagggcagcttgaggggaaatgggggctctctgagggcagggcctgttccttgcgtttgaatttctgcattgagcttagctgaggatgcagagggatggggagtgggcagagttctacatgtgggcctaacatgcaccccaagggcttcagtcgtccccactggcatcgccatcagtctatgtgcgtccacagggcagtcgagcttgagcgtctgttgggcgcatctccaccaccatcaccaaaacatcaccatcatctctaccagcattaccgagacaccaccagcatctctaccaccatcatcaaagaaagcattaccacatcatctctgtcatcatcaccaaaacatcaccatcatcactgccatcatcaacaaaaaatcaccatcatctctaccaccatcaccatcatctctaccaccatcaccatcactgccaccatcactgctgctgccacagttaccaccacatctgcctgctcaggacactctagttgctcctccatctttcctgagctcaaaatttatatgaatctcatgtccagccacgcttaggccattggtcatgcattttccctagaaaacccatccaaggacccgatgctgtttctcagcacaccgcccatggctctgctcaacagaggagttaggaaaaggaagcaagctgcaggagtgaccccaacacagctaatgaagatgctgagaggagcgaggtcttgttccaaagaagagaaatggaagaaaaatggaaggaagaagcaaaagcagaaagatgaatggagcatagataggtgtctgaccccaaatataagaaaggggatcctgggaaatgcaggctagcttcatctgtaagcatccagagagcaaattcagactcatgggtagaaattctcagaagacagaatcaaagctcaacagaagaaatatctttct

SEQ ID NO: 472146 - DNA, 487 bp, Homo sapiens
tgtgtcaggtaaagaaaacgggcagcatggaacagtacaatatgatacaaagggatctaatcccctcactattatcagtgaacctggacaagtcatttattctaataatactaaaagctctattttattggaccagggcatgcaataagcattcaacttttagggtacatgtgcacattgtgcaggttagttacatatgtatacatgtgccatgctggtgcgctgcatccactaactcatcatctagcattaggtatatctcacaatgctatccctcccccttgcccccaccccacaacactccccagagtgtgatattccccttcctgtgtccatgtgatctcattgttcaattcccacctatgagtgagaatatgcggtgtttggttttttgttctggcgatagtttactgagaatgatgatttccaatttcatccatgtccctacaaaggaggtgaactcatcattttttatggctgcatagta

SEQ ID NO: 472147 - DNA, 873 bp, Homo sapiens
ttcagtagatctgctgtacagacctcttaggctctaagaaggtggctgcacttggatctcttacaaagcatcatattttcaatgaggagaccattgaagtgatgtcacgtggctgttcatctgacctgagggaagaatgaaaagaaagcccctgcccctccaatggagcctgaagtccccgagatgtctcaaagcaaaactgaacatatgaaaactccagaagaggagctgcagccagaaagctctcctgctgaaacttcagcctgcaaagatcctctgaaacctttaaagatcaggccagtctcccagcccttcgtgaatccagctgtgaagaacaaggctgaggaatgtgagacgtggatagacaggttcaggaagctggaaaatgccctctacctgtgtgatctgagtaacacaggagttctggagaaggaacgagccagacgcctcattcacaactacaatctcatttacaacctgtccctgagccctcagaaaatcgaccaggccttgcgcagattccgttcgggagaaaatatgctcttggagccagcactgcggtacttaaaggagctatgataacaagcccatattgtgagaacagatgtttcccttatctccctttttacccagacacatgtttctccccagcctaagtgtagtggcggaggcattgtcagagtggaggccgatgcagctattgtagatgcttttgatttggacttagtttctggctatgatgctcactcataagcagttcaaagtgatcagaggaaacctagttttatcttttgatgtggcaagaacccagctacttagaatctccttctgttttaataaaacttattattaatattacatgtttgatttttt

SEQ ID NO: 472148 - DNA, 942 bp, Homo sapiens
gtattcaggatctcacccaggactttgcaacctgagagagtgatgcaaagcctgagggttgttttcacattaacagtatctctgatgatacccatcttccttgccttctgcacagaagaacatttatttccagacttgaactttgtgctggcagtaacggaaactccccagatgaggcttgagtgggcttatggggcctctgggcagcctctctctcctacctgtccacggggctttcgctgggcaggttggtggcggaaggggctggaagcaatggttcaggatggctttttgcctctacttcctctttccctcctcaaagatactcagtgtccatccctgtgtgaagcaatctccgctgagagaatgcacccaagcagcgatgagggcaggggagctgcggggtctccatgtgcccctatattcttccgctagtgtactgtagcattgttgcagccacatacgcgaagcccatggggagcccctcggcagggaggctttgatgatttcttcagacacacggagcagactgacaaattgactttcaagtgaaagcacatagtaagcactacacgactcttggcaaacgtcattaattttatatggattaattcattgtcctttttctacctgcctcatccatctactgacttcagatgcagtctccaaatcagatttactttctgtaagaaagccaaacttcatatttcaattcaaataaacttgttagttcacttccctttgaaaatttcacttccaaattccaatagtaaggtttgttatatgggtaaacttgtgtcatgggggtttgttgtacacattagggcatcacctaggtattaagcccagtgcccattagttatttttcccgatcgtctccctcctcctatcctccatcctctgataggccccagtgtgtggtgttcccctctgtgtccatgc

SEQ ID NO: 472149 - DNA, 566 bp, Homo sapiens
ggtttatcacatccaggaaaagtgctcataagaaagaacaaaatgtacaggtttgttacaaaggtctgctggagtgtgctgggggtacactccagaccctgtttgcctgtgtatcaccagcagaggctgcagaacagcaaagattgctgtctgctccttcctctggaagcttcatcccagaggggcacccactggatgccagccagagctctcctgtatgaggtgtctgtctacttcttctcagagcttgagcgctgtgctggaagatccactgctcttttcagggccatcaggcaggaaagtttaagtctgcagaagccacgctcacagccgccccttcccccaggtgctctgacccagggagatgggagttttatctataagcccctgactggggatgctgcctttctttcagagatgccctgcccaaagaggaatctagagaggcagtctggctacagtggctttgcagtgctgcagtgggctcagcccagtcagaacttcctggcggctttgtttacactatgaggggaagactgcctactcaagcctcagtaatggtggac

SEQ ID NO: 472150 - DNA, 476 bp, Homo sapiens
ctagtttgtctttgggacgccagccaatctcatcatgacctcaaaaatggaggcttcctttccaactcacaaggctaaagaaggagaatgtgatgtcccagcatgtttagggtcctcttggtcatctttaaagcggtgtcactacatcacgtgggggagggctgagcttgcctactttttcttcttaagggaggaagaagccggagaggggactaggatgcctgaaaacgatgggagactgcatcaacctcagcctctgacttctcttcccccgtttcgtgctccatccagcccactgagagtctcaggtaggcgtgggcttgagcagaggtgggttcagatctgtggaaacagattaaagctcaacaggttaaagctcaacagatcaagtcaagtccaggtgcccgcagaaaatccactgctacaagccctggtttctaccacacccctctcctgactccgaagctttcgttggc

SEQ ID NO: 472151 - DNA, 594 bp, Homo sapiens
tgagttgaaccatgtacctcagttggaaatgcagaaatcacttgccttctgcatcaatctcactgggagctgcagactggagctgttcctattcggccatcttggcagcaatgatagagttggataattcttatttctctctgttatcagcgatcgcatcattttcactgaaacctggtactttttcatccttctgtgtaggcacagatttaaaagtcccatttgctaccaatcacatactttacaagtctaacttcactatgggctctaggcattctgcaagtacacttagaggttcctgccactctcttgactttgtctttgcctccaatggattggatgaggcctactacccacactggggagagaaatctgctttactcagtctgccaactcaaatgttaatgtcatccagaaacaccctcatagacacacccagaatcatgtttatctgggcatcccatggccaagtcaagttgacacaaaaattaaacattaacaatgagcaaggagcctagtggctaaaaatgcagcctcaaatccaatgtgccctacttactgtgaccttagaagcacatgagagagggtcaggtc

SEQ ID NO: 472152 - DNA, 694 bp, Homo sapiens
taggctcacactcttagagatgattgctcttgcggggagccagccagggggactccaaccagccggagcgacacggatcctgagagtgctcccgggtaggcatttgccccggtgggacacctcaccagagcagtgtgtggcacgcccctgtggaggatcaacgcagtggctgaacaccgggaaggaactggcgcttggagtctggatatctgaaacttgcataagcggctggcagaggcaaggaaagaccagcagagagaaagagaggaaagagacagagagaaaaagaggcaaagagagagaggaagagacagagagacaaagaaggagtcaagaaaagagagaggcagagagagaggcagaaagagaggaagagacagaggcaaaaggaaagtcaaagagagagagagagagagagaaagtcaaagaaagaaagaaaaagagaaagagaaatatacaagtagttaagaaaaaaacagtataccctattcctttaaaagccaagcggcagctgctttgctaacgggaaaaaaaagggccatctatactaattctaagttaatttagactaaacgaggtcttattaatagcaaaggataactgaaatcccaaacttacaaggttttcaacaaaagtaaagtttgctaaagttaacagtgtaacatgtattacagtaacttctaatcttgtggcc

SEQ ID NO: 472153 - DNA, 718 bp, Homo sapiens
tgcagtgagcggagatcctcaagcctggaccttctgggccatcatggtccagggcccaaagcctttggtcttgtggggctttcagctgggaggagatggagtgcagcgtaggcgtttgggttcacttttggcttcaacttcaggagagccgaggcaccaaccactgtgcggatgcacaagcaagcatgcaagctctgcttggcaaggcttcctcccgcggctttctcagcataactgcaggagtgagggtggcatcacggggctgtgtgatttgtttattttcttatttggggcttttgcaaattccaatctgtccttccagcccacaccagcccacctgctttgcataacctgtgaaactgcacacaacaccttcttgccatatataagacaaactgtggggctacaaaagaccccagatggctgctgtcccttaaggatctatgaccaagaggctcctcactacgctgctaagtgacatcctcaaacctgcaaaaccctctctgatcctcctctccccagggaggttgcttgtcctttttcccttatggtggtggccctgctgctgtatctggaaggtctcctgatgatcttttctattgtctcttaaattttacccactcttcaaatcccttaaaagacccacctttccaatgtccatacagaattcactcttctctgaatttctatagcatctattatctgtgcttgtttcagc

SEQ ID NO: 472154 - DNA, 899 bp, Homo sapiens
agtggttaccctgaaggactgatggtggagctgcctgccagtcccggtgctgtgcgctcgcactcctcagccgttggggggtcgatgggactgggcgccgtggagcagggggcggcactcgtcggggaggctcgggcggcacaggagcccacggagagggtgggaggctcaggcatggcgggctgcaggtcccgagccctgccccgtgggaaggcagctaaggcctggcgagaaatcgagcacagcggcggtgggccggcactgctgggggacccagtacaccccccgcagccgctggcccgggtgctaagcccctcactgcccggggccggcagggccggccggctgctccgagtgcggggccggccggctgctccgagtgcagggcccgccaagcccacgcccacccagaactccagctggcccgcaagctccgcacgcagccccggttcctgctcgcgcctctccctccacacctccccgcaagctgagggagtgagctccggccttggccagcccagaaaggggctcccacaatgcagcggtgggctgaagggctcttcaagtgccgccaaagtgggagctcaggcagaggaggcgccaagagcaagtgagggctgtgaggactgccagcacgctgtcacctctcagtgtgagcttccactccttagagcaagcacccacatctctctgttgtaaggctacttttaagcagtgatgacccacttttcctgctagtgcagacagcaggaagtgcctggaaatttatttaatataagtggccatcactctcccgacccagggtgcctcatcttaagggctgatggacaggaggaataattaccccagctccctggccccggaccagaacatggtctccaaagactgaaagactgagc

SEQ ID NO: 472155 - DNA, 462 bp, Homo sapiens
cacttccctgctgcagccggcatgatggcagcagccactgccatcaaaaggattcagtgtctgatggagagcagagatggagagaagggaattctgaccgcagaaaatcataacccaaagagagcaggtagaaaccagggagtgtccagcactgagcagagaagaaagcggttcttcacactggtgcaaggatctgttgccctgaggttcatgcctctatggtggagacaaagccccaggctcctaatcacctctgatcataaaaccattgccccttgttctaactctgcagtcaccaaacaatcttaccatgtaacttttacaatgtttattcattgtaaactctacaacaaggtatatgaggccacacacacagatccaaatgcagcctccttgaccattcttagctctttaatccctacccataattaactgcagcggagatgaaggaggctaaatctt

SEQ ID NO: 472156 - DNA, 698 bp, Homo sapiens
ggggatgcgatggcttggcttgggctcagaggcctgacacagtgctgtttgttacataagtaaatgtgcggtttgatgtgtggtttgatgtacagattatttcaccagccaggtattaggcctagtgatatgattttcatactcattaattttgggccaaaattcatactacctatgtggtctagaaaaacaacaaggaacatatttagttttaagagtcctgtattgcttgagcatctaagatacattgtagaagcaaatgcaaatagcttctgggaaaatccacattcaaccaagaccctgggagacttcaaaattccaaggaatataaggtcattaacaacattacttacacagggacatgatcccttgactgacagtcagcaggaacaatggatgacagtatcagaaccacagagactggaaaacttggtcaaattgctaaggaaggcagaggagaaaaggggaaaaggtttggttcaagaaggcagtactgaacttcagcagtcctgtaacttcccactccaaaactcctaacagaggagatcctccttttttcttgtggtttaaaccagtttgattggattttatactgatagctagcaatatctcaacagagagggagaaaaaggaattgaattgaggtgaaggctggcaagatggctgaataggaatagctctgatcttcagctcccatc

SEQ ID NO: 472157 - DNA, 824 bp, Homo sapiens
ggaagccatgactgccacctggccacttggggctcctcatgtgcataacccatcgagcacataaagtggctaagcttgttggtatattgaaccctaattcctatgaggtgctggtattgctgctacacaatgggggggatgaaggaatttgtttggaactcagagaagccatggagtttattcaaacctctagatcaggagctgtcaaacttgttcttgaagggccaggtctgctggagtttgctggaggtccgctccagaccctgtttgcctgggtattaccagcagaggctgcagaacagcaaagattgctgcctggtccttactatggaagctttgtcccagaggggcacctgccagatgccagctggagctctcctcgctgtgctgggagatccactgctgtcttcagagctggcaggcaggaacatttacgtctgctgaagctgtgcccacagctgccccatcccccaggtgctctgtcccagggagatgggagttttatctataagcccctgattggggctgctgcctttctttcagagatgtccagcccagtgaaaaggaatctagagagacagtctggccccaggtgctttgccatgctgcagtgagttctgcacagtctgaacttcccagtagtttccttaatactgtttggtccttggtgccttatttagttcatttggtgaggtaatgttttcctggatggtgttgatgtttatagatgttctttggtgtctaggcattgaaaagttaggtatttattgtagtcttctcagtctgggcttgttttagctgtccttattgggtaggcattccag

SEQ ID NO: 472158 - DNA, 904 bp, Homo sapiens
tacaagatattggtaccggcagagtgggggagaaccgtctactcaagcctcagcaatggcagactcccttcccccaaccaagctcaaatgtcccaggttgacttcagactgctgtgctggcagtgagaatttcaagccagtggctcctagcttgctgtgctctgtgggggttggatccactgagcaagatcacttggctccctggcttcagccccctttccggaggagtgaatggttctgtctcactggcatttcaggcatgactggggtacggaaaacaaacaaacaaacaaaacaaaacaaaactctcctgcagctagctcggtgtctgcccaagcagctgcccagttttgtgcttgaagcccagggctctggtgacataggcacccgagataactcctggtctttgggtagtaaagaccatgggaaaatcatagtatctgggctgaatagcaccgtacctcacggcacagtccctcatggtttccctttgctagggtatggagttccccaaccccttgcactttctggagatcttcacggcagcctctaccatcaaaggcctggaggcctaggaggaaaaaatgatttcatgggctgggcccaggacctggctgctctgtgcagcctcaggacttggtgccctgtgtcccagcagctccagcttcagcagtggctaaatgtggttaagatacagcttgggccattgcttcagagggtgcaagccccaaaccttggtggcttgcacatggtgttaggccttcaggtgtgcagaagaaaaggattgagctttgagagcctctgcctgattttagaggatgtatggaagtgcctggaagtccaggcagacgtctgctacaagggtggagccctcatggagaccatctactaggccaatgcaaac

SEQ ID NO: 472159 - DNA, 887 bp, Homo sapiens
cttcttgataaaagtcattctcattggtggcttgctgcagctgctgtgagggatggggttgttattctcaggccaatggatttatgtttccagggagattatggctgcctctgctgcatcatgcaagtcaccaggcaagttccccagtgaaggtgcatgtttgggggcagaagaactccattgcaaactttgggcactcacagttcttcaggtgtctcttggagcatgcagtggcaacccacttccttcaaaggcaattctcaatcagataatctcagaatgcttgttaaaacacagatctgtgggctttgatccagatcaactgatttataattacttgtataagtgtgctatgaattactgcgttcctcagctctcagaatgtgcctctagccaagagaagcctcatcagagtcttcttggggactggtctgagcagtgtaggagtccaaggaccaccctcatagtccctagaggaggcagtgggcaccatgagtcacatttaccatgcatttctccactataatgccctgaatgcacacagccaagaaggacttaacagaggattggcaattctattaataaatgtacctggatagaaggatcaatagatctagggtctttgttatataaaattaagcaagttattcagtcattagagcctcattttgctcatataaaagagtagtagtgacgagagggctgctgatttttccccaacttaaaatgaaagaaaaagcactgagaaattttgaaaagcatgtcagtattaggaaatgcacactttcatggtattgactcattgttaatgtatcatttatactgaaatgaggaagttgggttttacagttggaatcaggaactagtttacatcctttgcagggttt

SEQ ID NO: 472160 - DNA, 492 bp, Homo sapiens
ggctccgccagaggggaggagtagatttcctgaatctactctcagaaacagcacatggtggtagaaaatgcctggtgcttagttggcagctgttaccagctctgctgccatctgtccatgactgtcatcaataaccacagcaatgacaatgaccccaaaagcttctcagaaaacgtgatgtttgagctgagcagagagggatttgtggaaataagtgaggcaaaaaggtcctgcatacagcatggaaaacagttaataaagatctcaactgttgtgaaggtcgctttccagaagccagaggagatagtcttgtttctctccagtaagtgcactaggaacagagcttttgaagtcaactctgtgggtgtacagcatttcaaagctgcaaaaacagcaaagaggaggacaggagggacattttacccaagagaagttcagagttccaatattgttcctcatggctattgactgatttaagggttatcagggcat

SEQ ID NO: 472161 - DNA, 667 bp, Homo sapiens
cacagacacaacagaaagtcatggaagagtgagaaagaaagttactgcacgcaaatgtacacattgtgatgggccccagagatacaaatccagtaggccctggtcctgcccccaggttcctgtggtgtacaggggagagggagctgagtgacccgagcaagtttgatgtcctgctgggggcctgggcctactccaaatcacgcacatctgtcatgaaccgccgatcagcaggagtctcctgggactataaaaatgaaaaagaaatgtctttggataagtctaaagggaaggctcagaagaaatattttagcaaagacctaaatgaagtgatggggaagccatgtgaatacctggggaagagcacgccagcccatgggaagagaagcacaaagtctctgagacaagtatgggctggcgtgtcagagccacagaaggaatccagtgatggggagaaaaagtcagcagcccatgagagcagcgcacagagctaactctcctagggagcagccagtattcattcattcactcaaccaaggtttgttaagctccactatgtgcacacaacggtgctgggtccatgggagaaagaagtgaggaagacagaggagtagtcaggaagacaagtaaagatccacagaggaggtaaacgcacgatgttatgaggacc

SEQ ID NO: 472162 - DNA, 675 bp, Homo sapiens
ctacaagaatttcacctctagctgcacaatgccaagcatccccagttcttccttgcgatgggttcgaacatcctcctttagctcagagaagtttgttattgccgaccttctgaagcctacttctgtcagctcatcaaagtcattctccgtccagctttgttccattgctggtggggagctgcgatcctttggaggagaagagtcaggtcctttagctgcaggtctgttggagtttgctggaggtccactccagaccctgtttgcctgggtatcaccagcggaggctgcggaacagcaaatattgctgcctgatccttcctctggaagcttcatcccagaggggtacctgcctgagctctgctcctggatgaatgcaggagttgaagctgactctgcttccctgcccgtgcttctagagccttttgtgggctcctgtgttagcagtgccaatgccccagagaaatcaatcacaagacctgaatttgagtcctcctgtttctttatgtggtcctgggaggtggcaactctaaactttgggacaaaggacaatctccaactaccgctgaccttggactgctaagtttcaagggcaagatacatagaaaatgaacctgaacaaatggtttcttttcattatcagctgtgatttgaacctaatttctctgtagagctctt

SEQ ID NO: 472163 - DNA, 593 bp, Homo sapiens
cagttcccctggggctaaagtctcctatggaacccttcctgccaattcaagtgtccatggtggttgaggggtctcctcctggtggggttccagaggcctatggcaagaatgtgttgctccttgcaagttcaactcacccatgccctcagagccactggggtcaaggaaagagtccgggtgcacgactcgctaccaaaaacgtaaagaaagccctcttcggtgtgattgtttttcattatgggaagctcattcagataacgtggaagttgaacctgatgaaaagggaacttgaatgtcatgaaacacaggaagaatatgtccaagtgattttccagcaaatctttggggggctgagagccatagcccccacaccagtaaacacaggcaaaaatatatattgacaattagaaagacgtttttaattttattttatcaacaattttaaaaccaattacttttttaaagattaagttacatgaactaaaaaaattaggttaattactatgtttttgtgtgagtgcccatctatttaaaccaatcagattaacatttcttaagggatttttggcctaccacactgaattttattatgt

SEQ ID NO: 472164 - DNA, 697 bp, Homo sapiens
gagttttggagtgttttgttatgatgaattattgagtcaactgacatggatttgtgtcctggttcccatgattacttgctatgtgaccttagaaaggacgatacctaccacatatgcagcctatgggtacatactagacatctctgtgaatggggtcaacaaagtgcttggttcacggaatgccctgagtaaaaacatgcaaggtgaacaaggcccgatcgttattccttctctgtttgaggctggaaacaatggaaaatcaacagtcatcccagtctggttcttacaggttcaagaagaagaggaatactctgaggcaattactgtggtgttactcactctccatcccctcatgaacaccccagcagttgctcctgagacacaacctcggaagccagggagaaagaaccgaaattctcccattactgtatttcctgtgggagtctatgtgggagatttttgtttcacaccatgtatttgtgacatatggataaacaatggcaacataaaagatcttacagaaatcttcaatattggtttcctcagaacacacattcttaatgggggacaatgttgccgccacggaggtgaaagttggttattaggaaggttaaaaaaaatcttaaatataaaaatgttttgtggcccctcatcatacgtaaacagatataaggcatatatgtggtattaaaatttc

SEQ ID NO: 472165 - DNA, 734 bp, Homo sapiens
ggaggcattttccccattggaacctcgctgagtggattggattggagcaagatgtgctggcaagaaagggccccccaaaaacccaatgaccccaaagatggaaagagtctctccccgagaagcactgcttggagttgggggaggggtgatacaagcactcccttggccaccacagctggtgtctcacgtgcaccccaagtccactggctccaagcccagcatagcaccaggacttgtccaaggccgttttgccgttcaaattcattcaggaccccagggcactttagtcggaggagccctggggtcttgaacaaagtagtggagctagctggaactgagattcctactgctgcaatggaggatttccctctggctagggctagtctggctgttccctccaagggcactggtcaagtactgccctgtgttgtgttccgctgtgacagggcagcattgaattcctacgcaaagtcccacagtcacttcactttccctcccccatgcatacagattctctctccaaacactgctggggggctggcgaaggtggtgattgcaatgcaagaatgtctttcttaccctcttcagtgcctctttccctaatatgatgttaaaactaggtactgtgattgctcatttgatctttggttcttatgaaggtgctttcttgcgtggatagttattcaatttggtgctcctgtgggagaggggcgatcactggaggattctattaa

SEQ ID NO: 472166 - DNA, 675 bp, Homo sapiens
tgcagcctttggatatggtgccctgagtctcagctgcttcagctctaaccatggttaaaaggtgccaatgtacagttcatgccattgcttcagcaggtgcaagccccaagttttggtggcttacacgtggtgttgggcctccaggtgcacagaagtcaacaactggggggcagaaccctcaagagaacctctgctggcacagtgtggaaggaaaatgtggggctggagtccccagagtcctaactggggcactgcctagtggagctgtgaaaagagtgccagcatcctccagaccccagaatggtagatccactgacaacttgtatcatgtgcctggaaaagctgcagatgctcaatgccagcccatgaaagcagccacgagtggagccatacctgccaaagccaaaggggcagagcttccccaggctgtgggagcccacctattgcatcagcatgacctggatcttatattttcttcccatgggccacgactctgggagtactaacaatcccagatcacttactaccatcagatatttagatgattcaaaggtagtcttatgtctctctgggagtcgttcctaattcatgatttcccatagggtataaatcttaactcagctgcttttgaaattgacaaatgtcttacgagggtacatgtgcacaacgtgcagg

SEQ ID NO: 472167 - DNA, 561 bp, Homo sapiens
ccaggtacctcagttggaaatgcagaaatcacccatcttctgcatcagtcatgctgggagctgtagactggagctggctgctgcaattcgctggggattcacttccagccctattcatctgattcacttccatgcctggaaatgtcactcagggaggctggagagtagcaaagatggatgcctcctgcttctgagacctctgacctcaaggagcatcaacctgatgtcagtaggatgctcctgtgtagggtgtctgacaaaccgtgttggagggtctcacccagtttggtggcaccaggagcagaacccatttaacaaagcactttgtgccttggtggagatgatatgtttcgctgaggtgaaacccactcatctgggcttcctggattcctcagaactaccaggaggagaggctaagtctgctggttcacagagactgcgaccacccctcccctaggcctagggagatcctaattctgtccctgagcctctggctggagttattggagatcctgcagggaagccccactcactgaggaaggatgggtcagggttagagct

SEQ ID NO: 472168 - DNA, 945 bp, Homo sapiens
gagtttgaaaggcattgtctgatttcagaagccttttcctgtaaacactgggtggcatctcatactatccctgactgtggtgggggcgctgctggagggtggggtccaggggtgaatggtcatgcagggggaggggagacttacagtagacttacactatctccgaggagttgtcaaggaggttttaatcggccgctcccagccatctgtacagctcttaagatcggcaaacaaatgttctgaagaagctgaagatgttcattacagagctgtatatgcccttaaaggaaacttgaaaggagagatgcaccgatactctgggtgggccagcatcagctgccattcaaacaccgtgactgcaggggtgtcaggctggcacaccacagtggatgctgccctaaggaggtgtcttgtggggcatgacttgcacgttttagaatgcagcttgtcttcctaccctctactccattgtcccagccatgaaatgccaaacacatgtggtgcattaggcttttctcctccatttgtttttctggatgaattcaaatcttggactcagtttgagcggagttggactgccctctaatatcacgaagaggcaagttcctctgcaattgcagcacttagggtagctttgtataaattttgacttgttcacaaaacaacatgatagaaaaacactgactaaagttcagcctgcaggctaagtatatatcccaattggtagccattaaaactcaatacctatgtttttactaactccactgggatctgcttaatattacacaactccatatcaaatgtaactaagaccacaactactgtctaccttaactggcagttatattacattgtttagccctcatttcatattacctttattcttaaaaattgattaatggcactttaaaattttggagtgtgtttttcttgctcatcccttat

SEQ ID NO: 472169 - DNA, 493 bp, Homo sapiens
ttgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaagg

SEQ ID NO: 472170 - DNA, 1116 bp, Homo sapiens
tttctgaggggcaggccatagatggccaaccggacgtgcaagattgaaggctgtcacgctctggcaggatgtggaatggagacccctgcacagctgaaggggcgcagcaggacggcaggagtgctggggggcactgaagccttgaaagccatattctgctttcagctgctctactgggcatctgtgcctggagacatcgatgtctacttacaacttaggagagcactgggcagtagagcctgtggggagcagcactggctccacgtctccaatggaacctcacaaggactcgcagagctcagcttgcccaggactgagacaacccccacggctcaagaagtgctcagagtccatgagtgtatcacggaatatggtggggagaagaatggtcctaccctggactctctgaggtggaggaagatggccataagttccccagagtggcagaactttggttttccggcccatccagataaatccaggataatctctccatctcaagatcctcaactcaatgacgcctgcaatgtctcttttgctatattagggtcatttatggattctggagactggaatgcgagcatagttggctgttattcagcctgccacagatgagatgataaaaggaagaggaggaggagagagatttagggctcaataataaaactaaatttggctttaaaaaaggtaaaacctttttttacacatctgagccatacgtataatttttgtatttctacatatatcaaataataaatataaaagatacaaaaggattaggattagtagggtgaaaacaaaataatacaacatagttaagatgaatcaaaaagtgggtacactatatgccataaatgtcttctcagttatgaagtgggcttcagttttggctctgaacttctttgcagctagaataagaagagaacacaattagtcacaggtgtcacatttttagaaggtgaaagaaaaatagttgctctgaagaagatttctagacactgaagttggggagaccatgaggtgcttagtgatgcattagacaaataacacctgtgggaaacaacttgatgggaatttgttaattttttcaagaaatatttatagaatgtgcacatt

SEQ ID NO: 472171 - DNA, 665 bp, Homo sapiens
catggccaatgaagactcccatgcagatagagataaatgattgccctaagagtgactgtatttatgctaggttagagcccatcgtgctcagaggggctctcagtccactctgcggactgctgactgagactttgcagacctgctccccttctccctgctacctgcctgccggaagagttgagtcaacacagcccacctcctgcacccagagctggaccattgtgccttggttcatctccattcgtctatgtggaaatcatgtctgtaattttgaacttgaattcacacctgacatatggacacttcaggttcctgctggggggaatttggatgatgtcatgaagcagagacaggtctaatcaatagaacttactttagaccttcaatctagttgagtctcctgtttttcctcttgatgggtacttctattgtgacttttcaacatttgctcgtacagtgagggcttgagtgaagatagaatcagttaagggaccatttactaagtgatatgtagtttgcaaatattttctaccaataagtaggctgtcttttaattttgttggattttcctttgctgttcagaagctttttagtttgatgcagtaccacttgtttatttttgcttttgttacctaagcttttggtgtgatattcaaaaaattatt

SEQ ID NO: 472172 - DNA, 2088 bp, Homo sapiens
ccagttttcaaagggaatgcttccagtttttgcccattcagtatgatattggctgtggagaaactcctgtttttaaaaccatcagatctcacgagacccattcactatcacaagaacagcaaaggaaagacccacccctatgattcgatcatctcccactgggtccctcccacaacatatgggaattatgggagcattaactcaaaagtccgcagtccaaagtctcatcttagacaaggcaagtcccttccacctataagcctgtacaatcaaaagcaagttagttacttcctagatacagtggggttacaggcactgggtaaatacagccattccaaatgggagaaactggccaaaacaaaggggctacaggccccatgcaagtccgaaatccagcagggcagtcaaattttaaagctccaaaatgatctcctttgactccatgtcatgctggtgtaagaggcctcgaggcctgtgacgggagaggctgctgtgaagacctctgacatgtcctggagacattttccccattgtcttggggattaacattcagctcctttttacttacacaaatttctacagccagcttgaatatctcctcagaaaatgggattttcttttctatcacattgttgggctgcaaattttcctaacttttatgctctgcttcccttataaaactttataaaactgaatgcctttaacagcacccaagtcacctgttgaatgctttgctgcttagaaatttcttctgccagataccctaaatcatctctctcaagttcaaagttccacaaacctctagggcaggggcaaaatgccaccagtctttttgctaaaacataacaagagtcaccttagctccagttcccaacaagttcctcatctcatctgagaccacctcagcctggaccttattgttcatatcactatcaacatttttgtccaagccattcaacaagtctctggggagttccaaactttctcacattttactgtcttctactgagccctccaaactgttccaacctctgctgttgcccaattccaaagtcatttccacatttttggatatcttttcagcagcaccccactctactggtaccaacttactctattagtctgttttcacactgctgataaagacatacccaagactgagcaatttacaaaggaaagaggttcaatggagaactcacagttccacaacattctctgatttgaaccacccactccttctaaaaagtctgcctccccaagagactcacagcagcttgccctggacaagaccaaaaaagacaatggatgtggtccgccttgggagtccccaagggctgtgcaacaaagtcaagtcaccgtccacccttcagctctgagctagaatctcagcagacacatctgggccaggtccacaaggacaaggactgtggctggcttcactaaccacggtagtgcaagcaccacacctgggcagcaggaagccccgcaccaagatttgttgagtgaatgaatgaggtagtgaatgaagcaggaggccataaacgctgagggtgtacacctgcctccctcccgcatctcctacccaccctatgaggagggaggggaggcagcaggagagctgggctacctggggtagagtccaggttctgctacttactaggtaacctgtgcctctgcgtcctccgctgtaaaacggggtctgtggggttgtcctgagaattaaatgagttaacatttgtaaagtacctggcacgcagtaagcgctatatgtgctaaacagataaggaagatacccccgccccccaaccctccactccccagatcactctgtgggcagagaccgttttctcctctgctcttccaagggctccctttgggactttgcaggcagtggttgctagagtctaggtctgcctggatgccctagcccttacacatggcttagcacctcagtactgccaatagctttgataaggagccatcaccctccagctcaacagggaggctagcgcagtgctgagggaggagggaagagctagaatatgatttcatcagggagttgggaaaggcttcacagagacagcagag

SEQ ID NO: 472173 - DNA, 893 bp, Homo sapiens
acaacaacaatatgccaatggttagtcctgcctccaaaatacacctcccttcagattgtatttccatccttctagggccttccgtcttcttcgccaaccccgagtcattgcttctcatccacacaaggtgtctgcagggcagccccggcatggtggaaatgctggcaaattgtgtcctgtcagaggaagggctgagacagtggcccttgcttctccacgacctgcatgaaggactcctcgaaggggctgagtgtgtgggaaaatctaaaaatgcttatggggagggggaggttaagctccccttcttgtccttgtcaagggctctctcccactacttcactgggggtgaaaggcgcatccgcaacaagggcccctggtcagctaactactcctccatgaagccatccctgattcctactccagcccccaaggaagaggagccctgccttcttgtagtggaggatggtgtttaggaaccaaaatctgagcccttagtgtgcttcttgttactgaggtgtcattgcttctaggcctgttgagtggacagatctaggaaatatatgtgtgcatatgtacactcacaggtgtatacacacatctacaactatttccatatctacctgtgtttatatatcagaaaacattatgtttctctggataactctgattaatatgcatagtcttataatgaattaataaaaaattaaacaggaatgagaaaatgaaataagcatccaatggaagtagttagaaaaaaggcaataaatgtcaagaaagcagaaaggaattaataaatgttaaaacagaaatcaattaattaaaaaacaaaaatattttataattgataaactgatacataataaatatattcaaaataaaattctttgaaaaaa

SEQ ID NO: 472174 - DNA, 606 bp, Homo sapiens
caggacacaattaccacggggttgcccagggtcctggactggaaacatggagtcacttccacccatttgtgtcctcagaggtctggccgctgccactgcacctgcctcagacccagtgtcacctcgccagggcttcagccagcctgaccttccagctgccacccagcagctcagcttagggactcagaaccttctggcccagaccttcatacccaactcccgcccaggggcaaatgcagaagcctctgctggtgcagccaacacggagtgggggcaaggcggagaggaaaagcaacagctcagggtgtgtatgactgatggcctcatgaaaaaaggaaatttggacacaaagccatgcatgcagggagaacaccaaatgaagactagagttacgcagccagaaggcaaggaacaaccagaagataggagggaagcctggaacagatcctttcccagtccctttagaggcagcatgtttctgccaacacttcattttgaacttctggcctccagaactgtgaaacaataaatttctgttgttccaagccacccagtttttgtggtacttttaaacgactacccttggaaaccagtacaaggtggaac

SEQ ID NO: 472175 - DNA, 545 bp, Homo sapiens
tgaaattctacacatgctttatataaaagggtctataagacagggttaattcacttgctggctggatggcaatgaggaccccactggtggaggataaagacaaagacacaaagttatgtaatgtgctgacaagacagttgctggcgagactggctgtgggtctgagcgggacagtgagaaaatgggccaagaagaggagagggaaaacaaaaaaggaaagaaaaatccaacatctcaacaagattggaaaatgggctgtgaaaggaggggcaagacaggaaggaggtaatgttagaaaggggattcatagaggagttaagattcagcagttgcttggctctccttgcaccctaggacctgagtgcccactgggcctcaacgccatgctggcgctgcctgctggctgtactcccattttctccctgaaagacatcagcctgccaaagctgcagcagcataaagcagcccacctctccagcttcacagaagcctgatgagaaggctaatcaggaaatcaagtgcccctccctaggcaggcttagcac

SEQ ID NO: 472176 - DNA, 712 bp, Homo sapiens
cggcgttcaggtctcttcgggttgacgccgctgcaccagccctgcagactctcctggaggtgatgcccccatcacaggctcctgaactgactgtgggtgaggggtggtcccccagaaagtttccccttatcttctggtattccagaagaagcattgtcatcataggaaatgacagctgcatgtgtgttattgccgctgaagaccttccagtgggacaagatgtggaagaggaagacagtgatattgatgatcctaacctgtgcaggcctaggccaagaatatacagttttagctggcaagctgctgcccagcccaaggcaactttttccagattgcttgcatgtgggtgtgaccagttctctagttattcccaacgggaggtgaatggaagttataaatgtcagttttggaccaaggcttttgagaagcagtcatgcttcttttacactctttccccttctgctggcttacatgcagaaaaggaacaggccctgggaatctgattgggtgacaggtagatagatccctgatcaatggtagtctatggctattctgcaatctgtcactcaggtgggctctcactctgtggtatttaaatgaagcaacttggaaataatttgctagctgttaaggaacaggaaaaagtggatgggtggcctgtagatgagtcatgtttagagtgacttatcagtaataaaggtattagtgcttc

SEQ ID NO: 472177 - DNA, 812 bp, Homo sapiens
cgtaaccgggtatgagagtcacttctggaaattctggcttgtatgggtgtgtcaatggggctgatggaaaaggtgaccagtccaaagcatttatcaggggaacttgtgtacagagtgggctgcagcaatccttcccatgaacagcgagaggaaagggatgttctacttagaatatacagttttagctggcaagctgctgcccagcccaaggcaactttttccagattgcttgcatgtgggtgtgaccagttctctagttattcccaacgggaggtgaatggaagttataaatgtcagttttggaccaaggcttttgagaagcagtcatgcttcttttacactctttccccttctgctggcttacatgcagaaaaggaacaggccctgggaatcccaactacccctcaacactcacaaaggcagagactaaatactgatacacaaaaatcttccctgccagcagaaaacagcaaacagcagaaagacagcttttgcccacttccacgttttacatttctgatgagtgcatctaattgacagaacctaagtcatatccagtctcctaactagattccagaaaatgttgtgtttatttatttatttattttacttccagcctctgcagcattggaaagcaccctggaaatgggtggtttgtaaactgctgatttatggccaatgataagcaatgttagtctatgtgtgaagatgtgagacaagcagaaagtgagtgtttgcaggtgtgactttatagctagggaatatagatagcagagcattgtcatagaatcttaaagaaacattgactcaaa

SEQ ID NO: 472178 - DNA, 507 bp, Homo sapiens
aatttggatttctaacaactttccaaagatgccagtgttgctggtctgggtactgcacttgacaactattggcttagagtattgcttctcagattttcaaattatggcacacacagaaaataatttttgtatggaataccagagtaaatggaacccagggctctgccagactgcccaagggctgagggaagaaatatctcagcacatggcagtgtacactagccaaacaggttggggaggtttggctgagagggataaaaggggaaaaggtcaaataccaaaatgtgagtggatcactaggctgtcaaaacaacagaaatggattttgctttcaagaacagggactctctttcatctttgtacctccagcaccaatgaagagggattggaagacatctcagactacatagagtttatggtacatttacactgacttatgataaactgcatagcttttaaactgcgtatgtcctattgtctggtagaggataagaagatctgaatatt

SEQ ID NO: 472179 - DNA, 500 bp, Homo sapiens
tgtggcacctagtaggcacacagcagcgggtacaggcgcagccatgcgagtttgtcccacatcctcggagcatgtcatccttcctggggaggcggagtcctggtcttgcccacaactccgaagacaagtgttgctccatcccctgaatctgccgaaaggagaacacaccagtgactctgtggagagacttgtttcagccaagaggacacatcctcatgcagaggggcagcatctgggcctgctctgcagccatggagacaaacttgctctgtcaagggagcagctgctggccacctgctcaccagtccaggctaagcccttttctgagcaggagtgtaggagcctgatccctagaatacagggctggaggtacagtaaagaaggccaggctgaaggaagatctgtggccttgggaaagagtgagactcctgtccctgagcctgaagggactccgaagaggggttttataggccctaccacgacgtaaatagacacagatc

SEQ ID NO: 472180 - DNA, 631 bp, Homo sapiens
atctcctgtccatatcatctgtatgggtgaagttaatttcttgcagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatgcttgttgattgctcactctttactgaacaccggttttgacattggatatacaaaaaacaactatgacgtgctctctatttctaagatcccacaaactaatgaggatggcagaaaagacacaaacaaaagttaggaagtgtctcaggatgataggtgctatgggagaatcaggcataggaagtgtatttagacaacacaactccatgaaaaccgtatgccttttggagagggggtggtcatggggttctgggggccaggagaggttttctgccttccc

SEQ ID NO: 472181 - DNA, 555 bp, Homo sapiens
gaggcctattgactattttctgtatatgtgaaatgggagagttccctgaccccccctctgcagaaggtgcaacaggggtgtggctcatctgttcggctgctgcatgctcaaaccccttatgggaggaggggcacgcagacaggcaggttcaggagccagggcaagtgcttttgggctccggccccacggtagcttctacagagattttactggatgatggaggtggctctcagcagaatggatgcggagctgaaaaagggatggagtggggagatgatcttcccctggagtttggctaccccatggctgatcttctttctgactgtccccagctgaactcctctcaatgttctgatgctccttctctcctctccttctctgccatgccactcttctgctcctctgctcttttgtttgtctgtccatggagcctggggcctaggggtggggcctttgccagggaactgccctcgcctacccagtatttctctgtctactgttgatatcattttccccctctgaagaggcacatctaactgccattagaatatggac

SEQ ID NO: 472182 - DNA, 1101 bp, Homo sapiens
attccatgttgctcctggggagcttgagccatggagatccatggccgacgtggtcctaggaatacctgttggctaccctgttcctgaagacctgagcagcaccatggtggttggtaagaaccagcatcttactaaagatggcaaaaagggagccaagaagaaggtggttgatccattttctaagaaagattgctatgatgtgaaagcacctgctatgtttaatataagaaatattggaaggacactagtcaccaggacccaaggaaccaaaattgtatctgatggcctcaagggtcatatgaaaaaattcaagatgattactgaagatgttcagggcaaaaactgcctgactaacttccatggcatggatcttacccatgacacaatgtgttccatggtcaaaaaatggcagacaatgattgaagctcatgtcgatgtcaagactaatgatggctacttctttaatctgttctgtgttggttttactgaaaaaatgcaacaatcagatatggaaaaccacttatgttcaacaccaacagacagcattggaagagacatagaaaagtcttgccaatctacttatcctccccatgatgtctttgttaggggagtaaaattgctcaagaagcctgagtttgaattgagaagactcatggagtttcatggggaaggtagtagtttgggaaaagctactggggatgagacagttgataaagttaaacgagctgattgatatgaaccaccagtccaaaatgtgtttaaagttcagacttacagtagtagcaaataaaaaaaaagttttggtgcataaaggagtgtttttcaagttaactgaaaaattttctcacatgtacaaaacctaattttccaggaatgttctataattgaagaacctaaaacacactgatgtttttgtagagatcatttcaatgtaatgaagactgcttgagctccaaatgtttgtcagcactgtgctaggcacaattgctgccttgaggaacttatggtcttgtaagtgtgacaaacccataggagataagtacatataacagaatgattgttgacaagacatctattttgtggtattgaatgattctctat

SEQ ID NO: 472183 - DNA, 1796 bp, Homo sapiens
cttgcatttaggaatatgaatggaagtcttggtcaaggctttcaagaagcgggcctagtttggggaaagagaagttgccagcatgtaagaaaagaaatgtgcacaaaatacaagtatttttttttgcaacaaaagaaactatttatttggaatatgcattaccagtacaaattaggagactgtaaaacctacaccgtgttagtatcattagagaacacaaaagttcagttggaatcaaaagggacagaagcctgtgctctcacagaagcagaaaagcttaaactttcaaaaccaaaacagagcagagctttgcaggtttatattctgaataataagaaaaggggagggaacattcattatcaaatgttcatcatcaatactacaaagaacgagacacaagtcgcaagaaacaatggaaaatgttaataaagctgaaagaatcgttgagtatttttttgtttcttttaaagttttttttaaatttgagtttctgtagtttcatcttttttggtatcgaattacaacaagaaaaccatttattgtccctagatggcatgaacccgtttatttcagggacattacttcccctgacttcgcatttacagattggatatgaacaaaatcaacttctcagtctctcacaagactcttagtaagccaggcataacagttcccatctcacagatgaagaaaatgaggcaccaaaatatttgaccacctcccacttaatcaagtgatagagctgccatctttataactggtagggttggctatgaagatggtgagctcaggtgacttttgagaatagctttcatatacatgctattttctcatgtatttttagtacacgctgtgttcccagggaataaaaatcactgtgatgatttcaatgaaaacattaccttccctttccccatgattctcaggtcctcaaatgaagctagcaaaagttcacatgagccacgttcttatacaactctttcctccagagcaataggtcaggaccaagaacatagtgtggtataacattttggaaaattaatacagtgtgcctaatataaaacaaaaaattaaacagaatcaagtccattaaagacattgtaagtactgtatggggctccctgagtgctccagaggtggtgggaacaagagtagtttacactggaaacctggtcttcctcatgatcaggtcctgtgtatgccattctggtaagtgcacgctagtgggcctgcaggtcctggaagccccagacacatactgcttctctgtgtcagtgaccttcacttagagtcactaattccctctctcgggctcaaaaggcatagtgctacagttattaatgtaggtaattgtatatggcatctcgggaaagtgaagatgtgagatggtacatgtgcctacatgtgcatgaacgtgtgtgtctatgaaggcatagttgaggttgaagggtttcacgataagaactttctattccttgctgatgcattcatcaccatgcctaactcaggcccagttttgcaataggttctaaatattgctttctcagtgctgaatggtctccaaagactgtgcctctgaaactgagagctattgctagcagggtaagaaagactgtaggaattctccacctgctgttcccgtgtccttccctgctgcctgacttcctgcccgggaaccaacctagtggagatgaaactgaaaaatgtggcacctttagaatcccagctatgacagtccccagtgaatagctggggctaggaaggaagaggaggaaagtgttccaatcagtactgtc

SEQ ID NO: 472184 - DNA, 623 bp, Homo sapiens
catctccctgctctgcgttggtgtttggacctgaatttcatggcacctcactttaggacacccgagtgaccctgccccatcatggacaggtgggatggggtcttggaggaaacgtcaggtctggagattagcatttcccagagccttgcttggagttctcaagatatctgctgttttgccaaatctgcatcccctgggaacctgtggggagcctcgcctcctgtgacccagacactgtgctcggtgctctgtgtttattatctcatttatcctccaggccagcacattaaggtaatagaagagtggaataaagccgaatgcattactaatttctgtggaaaagcagaaggcctgaccctagctgttttcttctttgcattctggagacacagttgtatgatgaaaagaggcacatcctcctttagggctacacccaataactgctcctcccggccccctgccgtgcacctaactcaccctggacctcacagccccgcagagcctcgttcagccctttctttcaccttaacaacatctagcaaacagtgatagaggaagtaccatgtgccaaatactccactaatggctttatgtacattatctcatttaattctgtgacaacc

SEQ ID NO: 472185 - DNA, 816 bp, Homo sapiens
cacccatcacctacgtatatagagacaaagccctttgagtactctgctcattgccctgtgagttatgaggttttacactctgtccggtgggaacagacacaacttccagccccacacttcagcccggtcatacatagaattgagtagaaaatcaataaatgaagctcagtggaaagcaggacgattgagacaaagatttcagggtgaaataaaatttgaatgttatccaagtattcccagtgtaatcaatgagcccttaatagcagaagaggaagacaaaaaaggaaaccagagagctgcagcagaagaggaagttaagactccaaggaaagagaaggatttaatgcaccatcattggcttgaagagctgaggttgcacaacaaaaatgaacgagtggtaggtgccaacaagggtcatgatgaagacccagtactttctcctgctgaagatcatgaaatgatgatgaacacaatgatgatgaagatgttaatggtgatgctcaacatttattgaccccttaatacctggaacagggccaagctcatgacatactcaagcctcacaataaccttataagggttattaaggaagttgaggaagcggaaggaaagattgcacccatcggtgctcagcattgagtgtgtacccattttcttactccctaactaacatgaatggttttttagcttaaaaaattactactagtttaataagcaaaatatggtatcttgttttaacgcgcggttacttgattaatattgaggtctgacattttaatatctatactgactaattgtacccttcttttgtaaacc

SEQ ID NO: 472186 - DNA, 499 bp, Homo sapiens
aaccagacggcagagcatttggagactcaactcttcagtcgaggatggtgtacctcagggcttggggagaggtactatggagaatgaagttttcgaatctgaccatttgtgatattgatatgcaaatcagatcacattccccttcccatgcccttcaatggcttctctttgctcttgatgctcttgggataaagaccaaacacactatctgtcccacatgctgttccttggtcctcatgacttcccattccagctgcatcttcaaccacactcctccaggctctttaaacctcaacgatgctggtcttttgtcatttccgccaatgttccaatctctccctcaccttggtctaactcaccaccactacccctctgccccaaaatcaccaccacacacacgctgtgttagtctcattaacttctgtacactgtttaggcctctgttcaaaacttacttcctcagggagcctctcccaagccccagtcaactgtgatagaa

SEQ ID NO: 472187 - DNA, 1233 bp, Homo sapiens
gaacaaagcatgatccttaccttcaaggagctcatggcctgctggagagagcggctcataccaaagaagaaggaggaggaggaggaggaggaggagaagaataagaagaggaagaagaagaagaaggagaaggagaaggaggaggagaaggaggaggagaagaataagaagaggaagaagaagaagaaggagaaggaggaggaggaggagaagaataagaagaggaagaagaagaagaaggagaaggagaaggaggaggaggaggagaagaataagaagaggaagaagaagaagaaggagaaggagaaggaggaggaggaggaggagaagaataagaagaggaagaagaaaaaggagaaggagaaggaggaggaggaggagaaggagaaggagaagaataagaagaaggagaatgagaaggaggagaagaaggagaagatgaagagcagcaggaagaggaagaggaaaacaaggggtcaggcaggcattcattttgctgatattatggataccaagtgggatgggttagacattctccctgctaagaaggttttagtttagtgacaaaagccatttaatttctccaggtgttggtgtcttcccttgtcaaatgggaatgattatgctaatcttgaagtattggtcacaccacgccttgtttggacatttttcttagagaagtaaccattcttgtgtgcattatattttgacttttgatacttcttttttatgtatgctatgccacaaattccagtttgtgacatttacaacaaaattttggtgagcgataaaagggccaatgtttgctttttcaaaataaatttacccagaaaagagctggtcagttaaatgttttcttcctgctatttcaaacgctttgtttttgtttctttgcttttgcttgatgttcagcactgtgctaggtactactggggaagcagaaaaatgttttatttttctattttttatttgggatctatatgtaaatacatgctgtaagtctgtgggtgaatttgagagtgtgtccgcgtgtgaaagagtatgtgtaagtatgtgtgtgtgtgcttataagtgtatgtatgcatactgtggaggacaagacgtgtgggtgaatgtgtgaatgtgtgtttgtgtgaaagtgtttgtataagtgtatttgtgtgatatcgactgtgggttagtaagcacagatgtaatatattactgtatctcctatatttccttagaaatata

SEQ ID NO: 472188 - DNA, 578 bp, Homo sapiens
gggtgattcccacccgccgccctttcgctaaggctggggagagggaagcctccgcgtgctgggttagggccaagcccgcgcacatagggtggccgcctggaaggacataaatagattatggcatgtaacagagtaatgctagcaggcctacttaggaatagagtaactctggctcagctgtacactgcattcattaactgtcaggttcaatgtcctttctggactcaaagactccagttgcaagagaaaagtcaagtcgactccgaaagcaactcatttaaagatgggagacataccatcaccctcaaaccaagaggcacagagagctccatccccaggataactatatgccaggaagtaagaggagaaagagacgtattacacaatgagagtggcaagcgaggcatttggatcttccaaatcaaaacatcctatatcccacagaaaattaggaggaagaaggattcacagactccagcagatgtgaggaatcttctttctggcttcggtgagaagaaaagttacactggaagttgatgcttctttgccaaggacatcagaggccaatatgaacagga

SEQ ID NO: 472189 - DNA, 880 bp, Homo sapiens
aataaacctgagagcacaaatttgtatgtaatttaatcttacaggatgtgcagacgtttgcgagcatacctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagcccaagagacacgcccagcgagcagaacttcccttcagcgcagtcgtgtacattgcccctcacgggaaggtggtagggcagagatccgcgcgggtgcgcgcagcagtggcccgagtcccgcagaagtgcgcgcaatggctgtcctccacgccttggaatccctcgagcttggtctccctcttttaccggggtgccctgcgggttgccagtgaccccgtgtctccttgctggttctcaccccatgttacccaggtgtccgcgccagcgtcgcgcctgtgccttgcggcttcacgttgccttgtagttcccggtggcagccgctgccgaggagacagctgcctgctgttcgctcacacataaatccctggggagaaataagagctaagtggttgttacaaaggggtgatgggtttgactcccatagctagtcacagaaacattcctgcctcttccagaccacactttctcatcccgagacacctttctgcccctaatctctgtgcatgttttggaatcacagggctggaagtagactctgggggccacctacctgtttccccactgcttgtcacttcctcatccaagcaggcccaacccaggagagctgtccatccctgtt

SEQ ID NO: 472190 - DNA, 497 bp, Homo sapiens
ccagatggaatggggtttgtccctgtctctgcatgggtgcaatgcgggaatgctctccctaactctgacaagtttacaggaagagaatttatttctcagtgcaatgataaatcattaaaggactttaagcatgggagtaatatgatcaaatttgtgatttataaataccgttttggttattttgtggctaatggaatggaggtcttagcagcagaaacagggaaagaagctgtgcactccggagagcaggaaccatttcttcaacttctttcatcctctggaccagcacagtacctggcaaatggtagttcattaaaccatatttatagaacctatcggaaaatacaaatccttaacaaaaaggaccattctactgctccacagcatgtagagctggctcaatgcttaccaccccctgctgttgttaagattgatgacaggtccagataactgcagactgttgacagccatggcttgtgcacatttgatcttacact

SEQ ID NO: 472191 - DNA, 641 bp, Homo sapiens
tatcacattctatcttgcatgatggttatttacaatgtgcatcctttctcccctaccagaatcagatgcatggaagaactacggtgtctgggtcctggaaccacacctattagtgtaggagccaaggaggcctctctttcagaaaacagtattgaacccgccagttataaggggaaatggttcttttcttggtcttcaggagggaccccagttctgcccagggctgtgctgcaggttcccagggccttggtgcccccaaaggagccaggccatgggcaggttgctcgagcccctgtggcagcttgctcaggaaccttctgggctgactggaggggaccaaatggaggtataagccttgaactgggaagagcacctcctctgtcctgtgagactgaagagaaggaaacaaggatcctcatgcacaaacctatgagaatttcaagccctggcactggcttctacctttgcctttctggagctccacttactcattgcccagctgtcatgcaatgatggcataagccaggggtcagcaaactacaacctgtgggccaaatccagcctgctgttttgtaaacaaagttttattggaacacagctttcccatccttttgcatattttctaatgctgccttcacctt

SEQ ID NO: 472192 - DNA, 993 bp, Homo sapiens
gctgccgccatgaacgacaggatgccgctaatgaatgctacatgttcagaggaggaaagagaaatgcaattcgaatgttctatggcacacaatcaagggtgtataataaggccccaggaagagtcaaagagggtaagggaaaagaatcttctgtatgacaacgttatgacattatctcttcctgttcccaaatggggctcctacacctgcggatgggactgtgacaccaccatcactttaggtgttgccatagctgcacacccgtgcagcccccagcccctgtcaaagtggatgcacaccttcctctcacctgtgtcaagacctggtaccaggccacaaaacacatttggcttgggctctgtttcttacagagccttcaataacacagggctttattccactcattgtttattatgggtgtctcatatctgtggctttggctgtggactctggcgaggaggacatggctctttcaaggatacataggaagagttagcctgaaaaagggaggagagaggttgagtgaaggagagagagggcagagaggtagcatgagcaaattacctagggcaggatggggtgtgtttgatgaacacagtgcggatggctgccttctccctgagtcttcacatggtcttctctttctatgtgtctgtgtcctcatctcctcttcttataaggagccagtcatattgcattagggcccacactagtgacctcattttaacttaattaccttttcaaagactctatttccaaatagagtcacattgtgaggaaagaaaatctattaattaagagctcaaatatttaacagagaaaatacagtgaaaggaaacaataatttttttcaataacatgagaaaataaaatcacatgatctaaacatttcctcccagctgtctgcatggtaagtctagtacctttgtggacttaaaggagaagctttaagactggactaagggctgtgctcactgggcaatctgggcaatc

SEQ ID NO: 472193 - DNA, 1679 bp, Homo sapiens
cattttctccccttctgtttgtcaaagatcagatggttgtagatgtgtggtattatttccgagggctcttcagggccttcagctgcaggtctgttggagtttgctggaggtccactccagaccctgtttgcctgggtatcaccagtggaggctgcagaacagcaagtattgcagaatggcaaatgttgctgcctgatccttcctccggaagctttgtcccagaggggcacccggctgtttgaggtgtcaagtgaccctaagagtgactcgtggatctttgccctggctgtgcttctaagcagcagctttgtctacaacagcatgggcaccatcaaccaccaggccctggagcagctgcagtatccttccaggaactacgtgactgagctaacagagctaatcagggcaaaatcgtgccccagacctgatgaagttgaggactccagcgagtttgtgagtttctttccagactttatttggactgttcgagattttaccctggagctgaagttagatggacaccccatcacagaagatgagtacctggagaatgccttgaagctgatttcaggcaagaatccccaaatccaaaattctaacaagcccagggagtggatcaggcatttctttccaaaacagaagtgctttgtctttgaccggccaataaatgacaaaaaactcttactccatgttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaagaatcttatgattttacacaagatggacaaattaatactcattggatatggtgtgattgtggttatcatattggtatacattgataggggtgataatgatggtgatgatgaaatgaatggttcatagacattgagcattcattttgtatagtatgaacattttaacaatattaatttttccagtcaatgtacatggaatatctctccatttattttatgtcttcttcagttaatttcatcagcattttatgattgacagagtacaaatcttttacctctttggttacatttatttctaagcattttataattttgatgctattataaatgtgattttcttattttttcatatagtttgttcttagtgca

SEQ ID NO: 472194 - DNA, 858 bp, Homo sapiens
gtgggaaaagcatggtttcccgggtggggttgcacagtcactcaccgcctcccctggctggggctgcttgcctattcattcccgatgcgagaacctggatatttcagttaaaggtgttgaattcacttgccccttttaattcctctccagaaaaattggaaaaagtccacgctggtctgatgtgtcatctagaagaggttgcagacctggtagtgctggatactagtaactctcgaacaaaagctatactaggggcattgcttatcctttatgttcactgcagagatatagtgataaatttactacttaaaaatatcttcaatgcagaggattttgagtggacaagctttacttatggctatgagtacttgggctgtacctcaagattggttattacgcctctcacagaccgatgctggctgactctcatggaagcactacacttgaatctaggaggctgtcctgccggtccagctggtacaggaaaaactgagactgtcaaagatctagcaaaagtctttgaggaatcgccacactgtctctcacaataatggaactaatttacactcccaccaacagtgtataagtgttccttcttctctacaacctttgtgctctgtttgcatttaaatgtaacacagccttaataaagcttccaaactcacttatagttttaacatgctttggactagagaaaacagtgctagtgatgaatactgtaatgtcttttaggtttgtactggaaggaaaagaaattcgtatcaatatgtcttgtgcggtatttatcaccatgaatcccaggtaggtatctaggcttatgttattaactgcagaggattcataagttcaggcctgaag

SEQ ID NO: 472195 - DNA, 1933 bp, Homo sapiens
tttgctataacaagggagtcagccaccatcacttgtgttttggcagagcctcaaagacaggcagaggagtgggaaaactttatggtggggaataggggaaggcttcagttaatttctcttttgttttttaattactgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctccccgtgccctccccacgaggcctgggagcgggtcctgcccggctgcgcaagggtgggggtcgcgcagttagctgcctttgggatgcagagcacaggggacccaccgccgccactgctgctcctgcagccgctccagctgctactgcttgcaccttcctgctgcagctcgcgcagtggcaatgtgttcggagtttcctccttccggtgggttcgtggtctcactggctcaggagtgaagctacagaccttcgcgctgtcacagctcataaaggcagcgtggacccaaagagtgacaaacagcaggatttattgcaaagagcaaaagaacaaaccttccacactgtggaagtggacccgagtgggttgccactgctcgctggggcagcctgcttttattctcttatctggccccacccacatcctgctgattggtagagcccagtgtggattcaccacgggggctgcaggtggagctgcctgccagtcccgtgccgtgcgccggcattcctcagcccttgggtggtggatgggactgggcgccgtggagcagggagcggcgctcgtcggggaggctcgggccgtacaggagcccacggaggtcggggaggctcaggcatggcgggccgcaggtcccgagccctgcccggcgggaaggcaactaaggcccggtgagaaattgagcacagcagctgctggcccaggtgctaagcctctcactgcccagggccggcggggcccgcggggccggctggcagctcccagtgcagggcccgacgagcctacgcccacccagaactcgcgctggcccacaagcacagcacgcagccccggttcccgcccgcgcctctgcctccacacctccccgcaagctgagggagccggctccggccttggccagcccagaagggggctcccacagtgcagcggcgggctgaaggactcctcaagtggcgccaaagtgggagcccaggcagaggaggcgccgagagcgagcgagagcgagtgagggctgtgacgattgccagcacgctgtcacccctcagtgtgactggctaagcacataaggaagatagttgatgagtattttttttcaccttaagataactgagtatgtaatgaatattctgatagagatatgtacaagaccttcacatagctattgttcaaatttctacttaagtgtcatttcctcagcttggctttctctgatcactccgtctttccccatccccttccaagtacttatgactgcctgtcattagtatatttattttgtc

SEQ ID NO: 472196 - DNA, 4190 bp, Homo sapiens
ggcacagctgcaggggtagggggctgtcaaggccccaactctggggcagaggcagtggcagggcagccagggttgtgccagagcctgagcaggttgaggtggggtcaggcagggctgggagtcagggcaggggcagcagcagtggacctgctatgcacacatcttcttctccaaggtttgtgtgcagaacatcctgcccatgctgccccagcagcttcagttggcacctgcctcagtccagcctctgggaaccatgcagcagctcccagcggccctgcacccaccaccagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccaggtgaggtgcggtcaggacccccacagggctgggagtcagggcaggggcagaacaaaccttggaggggaagatgtgtgcatagtgggcctggagggcggctgtggcctagtggacaggaagaagcagtgggcctggaagagctgcatgatcagggccggcactggtccagggtggatcgggggaccctgggggctcaggatccagcaaggggcggcaggagtaaaggaggaaggaatgacaggtgcaaataccttcccaccaaagcccttgttgccctctggctcctccccagagttgtccccactctcagtcggtcacccactccttgaacttgagatcggtgtcggtggtgctaaagccatcatcagcaatgacatcatcaccccctcctcctcatggatgacctgcctgacggtctatttccctgccgtccaggctgtgtaccccgctgtgggagaaggcttgggccaggctgagccaggttccctgactgtgtgcagccgttctgccccacagaagctgctccttggtatccgagctctggagtgtttgggctgcaactgacaggagttcagaggacaccccaggggcagtggcagtgcccgtctctgatatgctccgctcccacgagcccttgttacactcctgctagcccctggcttgtgggcttggcctctgagctggacttctttcggtccttgttgcaagtgggccaccttcacctggaaggccaggttgtatttctgcatctcattgggccccagggtgtaccaccgctcgctcagcatctggctgacggtccggttatcctggttgggatgaccctggtgcgccccgccagggcctggtgccgcctgctgaagatcatgagcgccactcatgggccaccggatgtggtccttgtctgatttgttggggctgcgtccatccttctcagaagatgagtcctgttccttgcgcagggcactgagggactgggcctgacatcatctgagtggtagaggcaactgggtgtcaggagacatgatggagaggaaagcatcatcatggtcattctctgtctcactgtccagcagggactcccctgaggggcccagggctcctcctccatggtgggaggacagctttgtcagacatagtattagttgctggcagtttttttctttcagcactttgaatgtattattcgattctgtcctgacctgcaaagtttctttaacttttgactatttgattatattgtgacttgattttataatttgggggaagaaaagttttactaaattgtcttttaatggaaactctacaagaaccagaatctttgctttgttcacttatgtatccattcctaggcctagaaaaatgtctgacacatagcggcaattattcattgaataaatggacccagcgatagtacattagctatgctatatgcatacattaaagatgtagattatcgactttcaaaagataattaatgtaacttcttactgcttctgaacatgtttgtgagttatattgctgagggacctttatcttctcattctttcatcttaacccagtgttataaaattgaaatcaccaatattattccatatctaaaattaatatctaccttgtaaaaaatatcactctgctgcatttgagaatagactttttaggtaataatgatgcaatccatagggttttttgggggcacagagggattcatgctaacagaacattttattttctattttcccagagctgtaaaacatgaaattacggtagtataaggcatatttttactctttttataattttttctaaaaaaaaattagtgtttgttccctatataacttttaactttataggtaaatatttgtttctttcagctccagttttatgtgaaatagagttttcagatttatgtagcatggaaagttttaatacgtcagagttactgatttttgccaatcattttctcaattatttcttttttatctttagttgatttttttgtagtgacacattttgtttctagtctcatttccttttgtttatattctatatatatttcatttttggttactatgagaattacatataacatcctagagttataacattttaatttgaatttatttcaacttaagttcaatcacataccaaaattctactgctatatatatagctctactctttttatgttattgatgtgacaaattatatctttattcattgtataccagctaacagatttacaattacattttatgcatttgccttttaaattatgtagaaaataaaaagcagagttacaaaccaaaattacaataggactgtttttatgtttgtttatgtatttacctttaccagagagctttgtatattcatacagcttgcttatttacttacatagttattgcctagagttcatttatttcaacctgaaggacttaacacttcctgaatgtcaaattcagggataaatggatttttttcagttttaaaaaaaaatccggaaatgtcttaatttctccttcatttttgaaggataagttttccagctatatatttctcaattgacaggtttcttcattattttaaatatataatccactgcctactggccttcaaggtttctgccgagaaatcagctgctaatgttatctggatccctatctgtgagagttgctcttctctctgagttttcaacattctcccattatcttttttttgtttgtttttgagacaaataattgtacatattcatgggatacagagtgatattttgatacatgtatacaatgcccaatgatcaaataaggataattagcatatccatcacctcaaatatttgtcatttatttgtattgtgaacagtcaacattctttcttctagttttttaaatttataaacatttaaattttattacagaaatttaaattttttgattctgaaaaagtcatatatgtatgcaacattttttatcatttatttatatatttatgcatctttccttttagttttgacagagattttctattttatcattatttcaaaagaactcttacctgtatttatttatcaagtatatttcccttgttttttcctagtatattaatttatttacttatcttctaaaaatcctccatataatctgtttattttgtttcctttctataatttcttcaataattagttctgttctattttccattaaaatatttaaatcttgtatgaatttttgtcagattagaaatttagggcgtttcttaatttctctatactctagcttttgactttttttttctgacctaagaggtatttagagcacattttagattttttattttgactaatcatttaaaatgtatactaatcttcaatttaaataaaaaactggtctatagtgacaaaaattacaaatgagcctaactaataaattatcagctgtgtttatatgtataagcatgcacagattttggtaaatatgtacatagtatattggtgagcttatttttatcattcttaactcattgtgtagtctaaacgttggggaaaaaataaaatacaataatcagatggtgtgaataagaaaattgttctaatgtttgtaaaccaagcaactgttttaactgctcccctcttcctgattgacttctaaaagggattgatctattgggtcctatcatatatgtcac

SEQ ID NO: 472197 - DNA, 1189 bp, Homo sapiens
gggtggagattaataccagagtttaatgaagcggggtttgatacagctggtgcatacaatgccttattttaaatcaaggcttcgaataagtgaaatagaaaatacactaaccgaaccaaccaaagatggtgagctcatcttttggactcagttaatcagccctcctcccagtgagggctttcatgactgtctcatcctgggagggtcaggggataaggtgactatcccttgtgtgaacttcagccagagcaccagtgcatttgatttcactcatgtgctcgtagagggtcaagcagaagaaaacatggctgccaaagtgtttgcgtccatcggcaagtttggcctggccttagctgttgcaggaggcgtggtgaactctgctttatataatgtggatgctgggcacagagctgtcatctttgaccgattccatggagtacaggacattgtggtaggggaagggactcactgtctcatcccctgggtacagaaaccaattatctttgactgccgttctcgaccacgtaaagtgccagtcatcgccggcagcaaagacttacagaatgtcaacatcacactgcgcatcctcttctgggccgttgctagccagtttctcgcatcttcaccagcatcggagaggactatgatgagcgtgtgctgctgtccatcacgaccggcatcctcaaaagcgatggaagccaaacaggtggctcagcaggaagtagagagggcgagatttgtggtggaaaaggctgagcagcagaaaaaggtggccatcatctctgctgagggcgactccaaggcagctgagctgattgtcaactcactggtcaccgcgggggacggtctaatcgagcaggaagctgtggaagacatcgcgtacctgctctcacgctcttggaacatcacctatctgctggcggggcagtccgtgctcctccagctgccccagtctgtatttcagcaagagatttacattccatagatcctttcactctcattcaatcagaactttttgtaggcatttatgagatggctatttggggtgacagatataatctatggccatagaactgggaaacactgacttgaatcatgtaagctacagacaaatgaataattcattgatttagtcactctttaattaatttatttattcattctactattatggactgagcactgtttt

SEQ ID NO: 472198 - DNA, 571 bp, Homo sapiens
cacccatcagtaaatattgccttaagtgttcctgaacaaattgtgatctagatggagtccagcctttttgaatctggctacaatgctagtgaactgtcccaggttaaaggaatttggatcaacccctggtatcaatttggcaccaggaggaatccaatgtcttctagcttcttgatcctgggattccttgttactccagggggctctacctcacaggacccaactcaatgccatgccagctttctctaccaaggcatccaggagacaaatcagagtttctttcctcaaacaaaactgaagtatgtctggctgtacttggacaaagtgtcccttcacgggatagggaatctgggaaacagtgtgaattctgctagcccctacctgtatcttaatctaagaactctgtttatgtctccactgtgcgttgttcttagtgtttgtctttaccctgattctgtctttccataaggttgcgtttaagaaattggacaattatgaatacatatttctttcatgagccttacagaaggtaagaagtctaaacaccaatttgttattagttggcattcct

SEQ ID NO: 472199 - DNA, 752 bp, Homo sapiens
gagtgccaggtaccacagctgcttctaattggacatcttgccctgcctgaagactgtgtatggcccatgagctaagaagaggttacaatggagaagaaggaaagaagaaaaaaaaaatcaaacaaggaaaaacatggggaggaggaataggaggaaaagaaggggccttcagtccaagaactcgcaaggaactgaatcttgccaacaactacctgagtatgcctgggagcagatccagcccagacaaaccttgtgatgactacagcctcaaggttgatgaaagcattgttagtcagaggacccagctaattcaggtccaaattcctggcccacagaaaatgccaactaataaatggttttttaggccactgaattctggggtaatttgtaaacatcaagatagacactttgtttgctacccccaggccagtgaggtaaaccttgctggattagagagcccaataccagcatgccttcttctgctgctgctgtaagaggagctcttctcctcaccgtttctctaaaactcatctccctggcatctagggagttcctccgcatttggcacagggatgtggcttcctgagagccaagatgtagtgattgttatctcctctggatctagccacccagcaagtctaccaggctctgggctggtactgggggttgtctgcacagagtcgtgtgatgtgaactgtctgtgggtctctcagtcatggataccagccagcacagtatttggggtgtcttcc

SEQ ID NO: 472200 - DNA, 581 bp, Homo sapiens
tatacatgcaagtcacaggggatgcgatggtttgacttgggctcagaggcctgacagtacttagatcagttcctatcacaaaatgggttcacttctaacccagccaaccctccaagtcagcccagcagcaatgctggcagaccttggaaaaatggaacactgggctgttcatgggctaattggagcaagtggagaagaactacaaaagggacccaaagaggggcaatggccctggaacaggggctatggggatgccatgtatgtcaaattgataccatctgatggccatgaatttattgtaaaaagagaacatgcattaatatcaggcatgataaaagccatgttgaacagccctggtcaatttgccgagaatgaaaccaatgaggtcaattttagagagataccttcgtatgtgctatcaaaagtatgcatgtattttacttacaaggttcgctacactaacagctccactgagattcccgaattcccaatcacacctgaaattgcactagaactgctggtggctgtgaacttcctagattgttaaataaaataaattacattttgaaaaaaaggggccc

SEQ ID NO: 472201 - DNA, 1170 bp, Homo sapiens
gccgccgctgccgggctaggcaggtcctgccccgccgggcccgcggcgatgtcgggctacccgcgccgcccgggcgccaccccgctgtcccgagcccggagcctcgccattcccgacgatgacaaatttgaagatcttgaagaggcaaatccattcttctttaaagagtttctgaagaccaagaacctccgcctgtcaaaagaggacccagccagcagaatttatgcaaaggaagcctcgaggcattcactgggacttgaccacaactcctcaccctcccaaaccggggagtatggcctagagtatcagcagccatttttcgaggacccgacaggggccagtgacctcctggataaggaggaggatgaggacaccagatggagtggggcctacctgccgtccgccatcaagcagactcaccccgagagggtccctgccgccacgttgccctgcagcacatacctttcctttttctccaccccgtcggagctggcagggcttcagtctctgccccccgcagactttgcggctcatggagagtctctgggagacaggcacctgcggacgctgcagataagttatgaagcattgaaagatgaaaattctaagctgaggagaaagctgaatgaggttcagagcttctctgaagctcaaacagaaatggtgaggacacttgagcggaaattagaagcaaaaatgatcaaggaggaaagcgactaccacgacttggagtcggtggttcagcaggtggagcagaacctggagctgatgaccaaacgggctgtaaaggcagaaaaccacgtcgtgaaactgaaacaggaaatcaatttgctccaggcgcaggtctccaacttccagcgagagaatgacgccctgcagtgcggccagggcgccagcctgacagtggtgaagcagaacgccgacgtggccttgcagaacctccgggtggtcatgaacagcgcacaggcttccattaagcaactggtttccggagctgagacagtcactcctgtggccccagagggcggtccgtgcggtcatggcccgagtgcgcaggggccaccgcgtggctgctgctgtcctcccccaggacccacggggaccaaggtcacacattctgtgctgtgaagctgtccagatgcgcgtctttggctgggggttctggtggac

SEQ ID NO: 472202 - DNA, 1651 bp, Homo sapiens
tctgcggcaggaggagaccggctcacaggagcagcagcattggaagaggcacccagcagcctcccagctcagacctgatgctggaacctgcagagaagctggagggaaggggcttggggctttcctccctccacttctctctccttaacatgcatggctgcttctggcttcaccagtttgctgctgcctggggcgaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactgtcctggaaatagctggttatggtggtgagaataagaggtgagatgttgtgagaattgaattcactatttcagctgcctaacagattgcttatctgcagtatgaaacagttatagttgggcatttataatggagaacatataacttaatttacaaactagacaaggtagactgtacagtctgcctgaatagtggactagggaactgttttaatgggttagaaaatggtaagta

SEQ ID NO: 472203 - DNA, 1161 bp, Homo sapiens
gtcagtgccatcttctactgcaccaactgggagattcacaggtggaaattgtgagtggagaaacctgttcctaatgcctgtgactatgtgctcaagtgtggacaggagctttcggatgttacagcctagtgtgaagacagatgttccctacccaactcttccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaagtacgtggtgcgctacacctctgctgacgaccaagagaccagagaggttctggtggggaaggagcagagcagcactgtcctgacaggcctgaggccaggtgtggagtacacagtgcatgtctgggcccagaagggggaccgagagagcaagaaggctgacaccaacgccccgacagatattgacagccccaaaaacctggtgactgaccgggtgacagagaatatggccacggtctcctgggacccggtgcaggccgccattgacaagtacgtggtgcgctacacctctgctggtggagagaccagggaggttccggtggggaaggagcagagcagcacagtcctgacaggcctgagaccgggtatggagtacatggtgcacgtgtgggcccagaagggggaccaggagagcaagaaggccgacaccaaggcccagacagatattttagcatatgtcagacaccagcccgtatgattccccaagctttgggctttctcacccttggcactattgctatcttggggtggataattctttgctgcagaggtctatcttgtgcattgtaagatgtttagcagcatccctgatgtctccccctatcccacactgagttgtgacaaccaaaagtgtctccagacattgctgactgcccctgg

SEQ ID NO: 472204 - DNA, 1553 bp, Homo sapiens
gcaagcaccatgtgcagccctggttcccgctcacgcctctccctccacacctccccgcaagctgagggagtgggctccagccttggccagcccagaaaggggctcccacagtgtagtggtgggctgaagggctcctcaaatgctgccaaagtgggagcccaggcagaggaggtgccaagagcaaacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattcccaggatgccggtcatggatgctccatagagtgtttggagccctatttcttctccacccatggaagagaggagttttggtggcttgtagctgtttttagagagatcccaatgttacaggaaaggggtccccatccagatcccaagagaaggttcttg

SEQ ID NO: 472205 - DNA, 1147 bp, Homo sapiens
aaaaatctaatgcctcccttgagatttctgcaaattgcaagggagcttatactatcctctcacctctggccccaattttctgcccttgcagaattcttattctctgttctccataattctgcaccttcttcacccaaccttatcctctcacctaaaagcaatcatttttacaagcgttgcacgttagcagaatttttattgatggttttgttccagccagcaggcaacaggtgcaaggagcacagctgcactgagtgcccctccaggaggaccacagggttgccctgggcagagaacttcccagctcagcagcaccggggcatggccttccagggcagtgaactctgcaagtttgtaggccctctgggcgcagcaactgctcctctgtctcatcaggcagtgtcccctgtgttcctgacctcctgaggagctgctggatggcttagccccttgacactggagggctgaccatgagctaggcaccaccaatcaaatgcacataatcaagactttaaattggaaactagtgatacatcaaagcagaagtcactcgcaatgggaacaactccatccagcttgctgatgcatcagtggcagcagattcaagggtggtttccagcatctactgtcagtgtggcatgaggacaagcttcagtatctgcacccagcaggagcagcactggattttcaccaggccagttctccagcacaatttgcatattgttcctggcttcgtagcccctgagcctggcccctggacctttctggaaattctgtgagccagggccagcttcatagctatgcaacctgtgccatcacacaggaccccaggttcagcacggccctgtgcttggtttaatgctctgctgttgccatcttgcaattcttacagttcttttaacaagaggcctcacctttccattttgcttggatcttgaaaattatgtaaccaatcctgctacgagctagctaatatgctttaggtcagggagttcttaacctcttatgctcatgagcccttggtagtctggtgaaacctataaagcttaggaggaatgtttttaaatgaaatgcacaaaatgaaatacataggaaaccaattatattaaaatatagtttaaaatttaaaaaaacaaatatagcatca

SEQ ID NO: 472206 - DNA, 877 bp, Homo sapiens
ggctctgcaacaggcgcaggctgctgtgcaagctgctgtgccacttgagcgatatgacccagcagatccaatggttcttgagaaagctgtgcatgctctgaatcagcatccaatatatggtactctttctcccatagccaggattcacaggtccaggaatcaaggggtggaagtggcaccactcaccgtcacccctagtgatccattagcaaaatttttgcttcctgttcccatgacattacgttctgctggcctagaggtcttagttccagaggaaggaaccctgccaccaggagacatgacaatgattccattaaactggaagttaaggttgccaactggacactttgggctcctgctacttttaagtcaacaagctaagaagggagttacagtgttggctggggtgattgacccagactatcaagatgaaatcagtctactactccataacagagaagcatccctggaggaggaagaccttgtgagagagcgagcggcaagtgtgcctttacagtccagtgggtaatacaaaaaagtaaacaagcagttattatccaggaagatatatgctgtgatagggagttatccaaggagctgtaggatcacaggagggggtcttggaagtgtcccaatggagctattgaagcatgtgtttgcttcacaaagttcttgtactgtggttttcagctccatcaggtcattgaagctcttctttacactggttattctagttagccatttgtctaacctttttacaaggtttttagctttcttgcaatgggttagaacatgctcctttagcttggagaagtttgttattaccgaccttctgaagcctatttctgtcaactcatcaaactcattctccatccag

SEQ ID NO: 472207 - DNA, 652 bp, Homo sapiens
tgatcaagaaactcccacatttttattttgcaccgggcccccacaaattatccactcaacaattgatggtcatatgagttgtttccactttttggctattctgaataatgctcccatgaacattcatgcacaaggttttttatgtcgagatatgtttttctttctcttggaaacttaccaaggagtggaactggtgggtcatatagcagctaacaatgtttccaaagcagttgcaccattttgcaccaccagcaatgaacaaaggtttcaatttctctacatactcaccaacttttcttattgccctgcgttttttataattgccatagtggtgggtgtaaagtggtatctcattgtagaaatttacatttccctaatgactaatgatgttgagtgtcttttcatgtgttcactgcttgtatatcttccttggagaaatacatattaaattatttgcccattattaattgggttttttttttgctgcactgagatccttaatcctaagagttgcagagggatgaagatccatcgtctgtagcttctttatgctgaacagaggcaatgatattcccatctaatcattagggtctcttgtattcagggtatggaggagctcagtcagaaagcattggtatggtgagggtctttt

SEQ ID NO: 472208 - DNA, 664 bp, Homo sapiens
ctacaacggcactgcgggtacctatggctcctgagcagaccccaaggacagtgggcatgggacaagagcccccagattctaggcgtaagctgcctcaggaagcagcagcacccacagagttccagcattcgctgctggccagggagaagaagggccatgccactgggaaccactggcactggtcccagctctccctgaccagtcacctaaaagcaactttgcaggacttcagtttaaaaaagatgcaatgtgaagatgaagaaggattgttttctttgtctagattagtcactatgggctcttatgcagtgagagcagaatcatctactgtctgggtagaaatctcccatgcaatgacatccaggaaaaccatctttgaattagtgcaaatcatacagatgtcacccctctctgagatgcccctaacaccccaccctgtccatcagcgaaccacatagacggtcaggttttctgtgtagatttttacagcatttctaccaaacagaacaaccatcccatcaagcttggttgcattagtagttttttcagaacataacacccagtctgcttcttgggctttgccaatctgtttcccatgttctattataacacatttcacaaaacctgctttttcaaatattctaatgtttgatacttggcatta

SEQ ID NO: 472209 - DNA, 578 bp, Homo sapiens
gcagtatatcttatactgatatgtatgattattctgtttttcgagtggagaaattgtggctcaacacagttaagcaacttgcgcaaacccatttctttagtaaaagaagaggttgcagtcacattcctgagagagagcactgtctttccacattcccaattcttcttcggtttgcaaagatccgtaaacattaagaatcaggtgacgttcttcttctgcctgaagatcaaagcagcttgctgccttttggcaccaggagctcttttctcccaagggctctttcatctctctggcttccctttttattcctcccttctctccacccttgcctcttctgccattcagtgcttcccacaaccattttacctactggtgcgacatactgtggcaaccctaagccccaggtcaggcatgggaaaaacagaacttggatagatcaaaatgtattgaccaaggtattgaccaaaaggaaggacttcagaactatggctattgatatttgtgttagtctgtttagatgtctatctcctttgcattccagactaatcctgcattggggtgggggtgggtatactaat

SEQ ID NO: 472210 - DNA, 548 bp, Homo sapiens
ccaacaggccccggtgtgtgatgttgccctccctgtgtccatgtgttctcattgttcacctcccacttatgaaggtgcagccaaagaactatctgggcagccacattagctgtcatacttttcaaaatcactggcaggcagccgatagcacagtctgccaaaacctctacttccattttaaccagagcacaggtcttcaaggacgttctctcaactctcatagccacttagaaatggctccagcgcctctgccagtttcctgcctgaatgcaagttcctgctgctttgaaagtttgctaaagggaaacatctgcttctctatgggcttagttcagtttccattaaggcaggcagaaggccagtgtgacagctttctgtatcccaagctcttgtccagcatcctggaaaaattggggcacacatggactcgaaggatgaatgcgaggttttattgagtggtggaggtggctttcagagggatggatgaggagctgcaaagggggaatggagtgggaaggcgatcctccctcagagtcgggctgcccagc

SEQ ID NO: 472211 - DNA, 1905 bp, Homo sapiens
ccgccagtctctttgcattgcaagaatgatctttactgcagtttccaacaatggtcccatgcctttcctggcaaagaaagggaacttggctggcaaagaaagacctacacttacacaatgccaaaataaccagaagatccctggaaagtccaggcagaagtttgctgcagtggcagtgctctcatggaaaacctctgctagggcagtgcagaaggaaaatgtggggtggaagcccccacacagagtccctattggggcaccacctagtggagctgtgagaagatggctaccatcctgcagaccccagaatgatagatccaccaacagtttgcaccatgtgcctggaaaagctgcaaacactaaacaccagcccatgaaagcagacagaagggaggctgtaccctgcaaagccacaggggcagagctgcccaagaccatgggaacccacctcttgcatcagtgtgacccggatgtgagacatggagacaacagagatcattttggagctttaagatttgactgccctgctggattttggactggcatgggcctttcaacattcaaaatggcctgcaaacaataagtttattaaatttattgtccaggcatcaaataagcgtcttgatttgctcacagaagttgaaacagaattgcaagccagtctaaagcttattaactactatttatactaaaaatttcttcttaaaaacattaataatttagtatatggatcacgttgatgtatcaatatttgaagtacattgaatgtcaatgaatgtaaaataatcaagtgagaagtttggaagtataggaaggtatagataaaataaaattggaagaaacattgatgatttattaaagcagggtaatgggtacatagaggtttgttatattattctgtttaatgtgtatgtgtttgaaattattcatataaaaagttatatatactttcctataataaagaaaactgaacaaacactatatagtgcctatttatgtctatatacaaaaatacaaaggtactctttaaaattcatgtatctaagttgctttgttatgtcttagaggaacactttgcctttacattgaaaactcctaatagactgttttgaaacactcaagattatttcaccaaagccaaagctccagtagtcttcttttaacctaacctcctcctttcctcttataatgatgcccacttttcacctgcactcagtaagccacagtaaacaatcatgtagaaaatactgtgcttttctatcatcaatgttttattagtaaaaatgtttacacttcacacaattaaatacagccaccacaagaagcatattaatattctgaataagttgtataaggctcattctgaataagttgcaaggcttgctctgattacaattatatgtgtattggagtatatgaaaagtgaaaagtttgtgtccatttttagattacttaatacatatctttagatatgggcaacttacttaattttctgagacttcatcttttcatttttgcctggctatatatagtgaatgtaaacccatttggcaaaagttttacctacaaaacaaatatagattagatatttgttacctctgattttcctttcacacttcctatctggttctttatgcactcaaatgaggattggattatggtttgctaattgatattagaaacaaaaaaaaaaagcagtgctgatttggagtactctcattaggcttaacatttttctacttgtttggatttgtctcgctgcttaggtagcaagatgccaaacaggtatttttctcgatttgtcattttatctcaggtctcaaaacaagaaaatggatttcaaatatccaatataattattgattgtatgtgttaatttaacttagatacagaatctccagagag

SEQ ID NO: 472212 - DNA, 645 bp, Homo sapiens
ccccatctgtaggtcaccatcatcaaagacaaaggtagataaaaccacaaagatggggagaaaccagagcagaaaagctgaaaattctaaaaaccagagcaccccttctcctccaaaggatcgcatctcctcgccagcaaaggaacaaagaaggatggagaatgactttgacgagttcacagaagtaggcttcagaaagtcggaagctaaaaaccttgaaaaaagattagacaaatggctaactagaataaacagtgtagagaagaccttaaatgacctgatggagctgaaaaccatggcacgagaaatatgtgatgcatgcataagcttcagtagccgattcgatcaagtggaaataagggtatcagtgattgaagatccaattaatgaaatgaagcgagaagagaagtttagagaaaaaagagtaaaaagaaatgaacaaagcctccaagaaatatgtgactatgtgaaaagaccaaatctacgtctgattggtgtacctgaaagtgatggggagaatggaaccaagttggaaaacactcttcaggatattatccaggagaacgtccccaacctaacaaggcaggccaacattcaaattcaggaaatacagagaagagaacaccacaaagatactccttgaga

SEQ ID NO: 472213 - DNA, 626 bp, Homo sapiens
cccctcgcttctgcccttctgctttctgctatttgtcattcaatgcttacattcagaatctatggtgatatggtttggctgtgtccccacccaaatctcatcttgaattgtaactcccacaattctcatatatcatgggaggaaccagaagaagacagaaaaatgtgggaaagtttggaacttcctagagacttgttgaatggctttgaccaaaatgctgataatgatgtgaacaatgaaatccaggcagaggtggtgtcagatggagatgaggaactttttgggaactggagcaaaagttactcttgctatgttttagcaaagatatgggtggcattttgcccctgccctagagatttgtggaactttgaacttgagagtgatgatttaggattccagaacagtagattcaataacagcttgcgccgtgtgcctggaaaagccacagacactcaatgccagcccatgaaagcagccaggatgggtctatcccctgcaaagccacagggacagagctgcccaagaccataagaacccacatcttgcatcagcatgacctggatggcaacttcagcttgctggaggtgtagttaaagcactcagggtctttgctccttccccaatct

SEQ ID NO: 472214 - DNA, 606 bp, Homo sapiens
agtcttccataaactagaaagatgatactacattatccaactaacagggtcgtatggaccgtcaagaaatattctctccctggttctggctgccagtttactgaacaggagagttccctagcctcctcacaggactctagaagaatcaggtcacacacagacttgaaggatggtgaatgtggggttttactgggtggtggagatggctgtcagtgggatggatggggatctggtcaggggatggagtgggaagatgatcttcccccaggatttggctgtccaacagccgattcttccaccatccacagccaagctcctccagactttcagatgctccttctcttcgctccttctctgccatgtggttctgctgttcgttcactcatctgctcatttcctcatctgcttctggagtctgggaaccatcaccggacgttcctagtgggagggggagagccttctaccgccctgctcatgcctgtctaactacctttaacaagatgataggaaacaagttcattatcctgaaaactggcaaatgtatcaaaaagtacctaaggggaaggaagatccccaaagcgggagaagcaacgcctggttgtgtct

SEQ ID NO: 472215 - DNA, 648 bp, Homo sapiens
agggggtcaataaggggctcgattataggatttcaaaatgtggaagcgactttggaactgggtaatggacagagattggaacagtttggagggctcagaagaagacaggaaggtgtggaagggtttggaacttcctagagacttattaaatagttttgaccaaaatgctgatagtaatatggataatgaattgcaggctgaggtggtctcagatggagatgaggaacttgttgggaattggaataaatgtgactcctgctatgctttaccaaagaggctggtgtcattttgcccctgccctggagatctgtggaatgttgaacttgagagagataatttagggtatctggtggaagaaatttctaagaggcaaaacattcaagaggtgacttgggtactcttaaaagcattcagttttatgcattcacaaagatattatttggaattgaaacctttgttgaaaagggaagcagagcataaaagtttagaaaatttgcggcctgataatgcaatagaaaagaaaaccccattttctgaggagaaattcaagctggctgcagaaatttgcataaataacaaggagtcagatgttaatcaccaagacaatggggaaaacgtctccagggcatgtcataagtcttcatagca

SEQ ID NO: 472216 - DNA, 640 bp, Homo sapiens
ttgagggataatgagggaggttgtagaagagagtaaaaagaggccgcttaccagatttgaaattgttacttcaggccatctgggcatatatgtgcaagtcacaggagatgcgatggcttggcttgggctcagaggcctgacaatcctgccttcttatattaataagaaaaataaaacagtgttgaagtcttggggtggtgaaaattttgggggggtgatatggagagagaatggacgatgtttctcagggctgcttcaagcgggattaggggcggcgtgggaacctagagtgggagagattaagctgaaggaagattttgtggggacggacttaccttccactgtgagagttactcgaagctcagcgtctgtgatgatctatggggctttcgaggtgatcgggcagcgtcagtcttcagctgctaagccgagaaggagtcagagagccttgggccagaattccaggggctctgggagtgcctgccagaactgtggggctttcactacctatcactaatgagaaggatttttagatccttataaaatttttttttacattgcaaaatctagcggaatcttgatcatttttaaataacttgataatcaataaaatttatcacaaaataagcaaatttaaaaa

SEQ ID NO: 472217 - DNA, 813 bp, Homo sapiens
tatattaaaatctcttaaaccatgaaccctggaaaattctctctacggcactatgcagacttggaaaaggaagaggggtacacagtcagagtgagactgtttctcctatcggtttcatgtgatttttattccattctgtggaccacagaacagactcaagtttatttgcaattttggaggtttttaccaagagctgtaacagtcactgcgaaggtctgcggcttcactcctcaagtcagggagaccatgaacccaccgggaggaacaaacaactcggacgcgccacctttaagagctgtaacactcactgagagtgtctgcggcttcactcctgaagtcaaggcgagaccacaaacccaccggaaggaagaaactccagacacatctggacatctgaagaaacaaactctggacacaccgtctttaagaactaacactcaccgcgagggtctgtggcttcattcttgaagttagcaagaccaagaacccaccggaaggaaccaattccggacacactaggagacctcagtcactcaggtgtttagagcactgcagagctcaaatcacacagataaatgatggtctctagatgaatgggcacacttaaagagttgcttccttactatatttgaaaatttaaagcactatgagaggggaacaaaacctgaaatagacatttcccttgcgaaaatgagacagaaaaatacaaattatatatattttcaatatataataatactgtcttatcttttatgcttgaagaggattttaaattaatcaagaatctgaaaattatgtttaagctggcatact

SEQ ID NO: 472218 - DNA, 450 bp, Homo sapiens
ttatcaactcaatttcagttccctgaggcctccctggtcatgctttctgtacaggctgtggaaatggaggaattcaagcaggctgcagaaatttgccaaaggatggaggagccaaatgctaatagccaagacaatggggtaaaaaccttaaaggcacttcagagacctttgcatcagtctcttcagtcacaggtccagtggcctaggagggaagaacagtttcatgggttgggcagagggccccactgccctgcacaaccttgggacactgctccctgcatcccagctgttccagctcctgcagtagctaagagggccccagatacatcgcaggccactgctgcagagggttcaagccataagcattggtggcttccatgtgttgttaaacctgcaggtgtgaaaagggcaagagttgaggcttggaagcctctgcctagagcctgaagg

SEQ ID NO: 472219 - DNA, 552 bp, Homo sapiens
gcaagctgaaatcaactgctgttactgaggtgaaaaaaaattatggctgacacaacggtaacaagaacaggaagtacaaacaggctaagatctgtaattacagtcaggccagagattgccttgatgatgtcaagaggcagaacacaatatcccctgacctttcctagaaacattactctgctatgccagcagtcaagttttcttatgtcagtaaagcaaaaagactgggctgggagaaatagaaataacaagactgcttcttgccaacctgcacagcacagcacagtcaagctgcacaaccttcattgtgtcctagaagaaaaaaaattcctttacttggacagattaacatgttcagtaaacaaatctaatgttcaactttgtgtctttggagaacaaaggaattttagtgtaaacaatgtagacattggtttaaccaatcagtgtcctctcacgtgaactgggaggcaaaaccaagacactgttcactcacctgaacattcactgatttattcactgccaacagtctgtgggtgttttaactgtcgtgta

SEQ ID NO: 472220 - DNA, 1009 bp, Homo sapiens
tcaattttctacaggtattgcccttatgatgtcaacatctgggtttttcaaacccacagaaagtttgttgccttttccaaaaccacctgtggccctgcctggagccatcctgtgccaattaaaaaaaacccaaactcagctggcagagagaggagaagcatctggacgtcagcgactacagttggacattggagagaagcggcttgacttcagagggacagctggacagtgtaacttaggagaagaatttggccagagacgttcagatttcaagggaaaattaccttccctcccgtctcctcttcagttccccttcccactgagagccacctccatcagcaataaaatctaccacatttaccatctttcaattcgttcgggtgacttcatttctcccaaaagctggacaagagctcaggtaccaggagtgcggatgaaaaaggctgtcacactgactctttgccctcacaggcagaaggcagccatctcatgcgaaaaggcaaagggtccactgagctattgaacacttaagccgtccacggacagcagagctaaaagaacactcgctctagggcttcaggggtcgcgggcacctccgccacatgctgctgcagggctggcacggagttggctcctgccggggcgcttgccccagctcctgcacttgctcacctgtgcacccctcccgtgaggggtggaacacagcggtccaagtgaatggagttcattcctgcaggcaccagagcggccagctgacttcagcgctcctgtactccagtttccgctttgttcacacactcccttctgcgaggagttgagagctgcgggctcagtaaatggggcacccgcttgatttagaattaaagttaattttttaaaaaaataaagtagaaagtcttagaatccttatgctaatatgaatcagaaatctctgagatgaggatgcaatagcatgcagaattttttaaacgtattgtattcgtttcctagggctgctgtaacaaaatac

SEQ ID NO: 472221 - DNA, 681 bp, Homo sapiens
ccctcaaactatggcaagcatgataatcaccagtgattctttagatatatcccaaaaagtatgcaagatgaagggaatatcacctctatcatacttagaatatccatcttatgaaaaaatgattacttgtccatcattctgtcaccagtaccccacattctctatccttcttaaatacagtggcccaggtacacaagatctgactaaatttgtccctggaccaggaaaacagaaagctctaccctctcaatcccctccactcatctatcagtcatctgtcaaacatccacataaacatccagtgataaacaacagcaagtggaccatgaagattgagaaaaacatccctggaattgcaggccccagcacaaggagtcattacagacatgagactgaaggccccagcacaaggagtcattacagatgtgtgactgaaggttgtggtgctctcaagagaaaggcagtttatggtgcctactgaccctcctacctactcacgtgacagatttgattggtctctcacaaatgacttgaagaaatttgatccagtttttccgtaaaacttactacaaggaaaatatcagctgtatgagttcttcatgacacaatgtactaagagaagatagtacattttaaatattattttttccccaataaggtggattagaagctcttagtgta

SEQ ID NO: 472222 - DNA, 635 bp, Homo sapiens
ctaaagagcctatttgagggtagaaaacggactgataactcttcttctcaaccattgcaaggttcatggctgagacccatatgataaagcacagattaacaagagaaaagcatacacatttatttaataaatttgatgtgacatggaatgcacttcacagcaagacaatatttgaagcagcagaaatggccccgtataatgggctgggtgtggaattaggcagtctcattgcctacactggaatcccggtgtggacagagcagctggtggagacccacgtcattaacttttgctccaagaactaccacgagaacataccaggaaagccaagagaatccacagaccctttgaaggaggtggattgctgctccaagctccgtgaggcagccgaggagctctggtgcgctcctgaaagcgccatctcctggctggaagccaaccaacacaaaaccagcacacttaacaaaaatacaaccaaggggtcttacagagtccacttctcttccctgctacctctactggagcaggttctggtatccacactgagagacctgaagacaggttacatcacaggactcttggcagacagtccccagaaccaccccggagcctggtagctctgctggatggctaga

SEQ ID NO: 472223 - DNA, 887 bp, Homo sapiens
ttctacaaggattggatcaggaaaactcaaggcacagaaatactcacaggccttgtgcagatccttccaattgccaagagtgtggcccagcgacttggtgcctggagtgcagcatcaaaccccaagcatgggacatacttccgggcatggatccctgtgggactgtgtggttcataagcccacgaaacaggccgtgactctagatgattgttgtaggaagatttgtgaggaagaggtgagtaggagaagggatgatggagtgggtatggtgattgaatgtccatcagcccagcttcatgatcttttggagccatttagactcctcaacaggctccatcaatggaaggtctgctgcagccacagctgctactctttccactttgaaggctgctttccatcgcattggctggatcacatcaaaggcactttaaaacatgggagcagctgctgtaacatctgccacaacctgacagtggacctttcccaagaaggctcatcaattttaaagcactttcacagcaaaatgcagaacaaaacgaagaatctgagagcagaggtggctgtactagatatccaataccttaaaaatctgtgcctgcttgttcagctttcgggcggccctgagccttaacaaggcaatggggaggagtctctaaaactaatttggttaagtggctccttagagtttggttcattctatatactcttcctgatgaagggtacatgtgcacaatgtgcaggttagttacatatgtatacatgtgccatgctggtgtgctacacccattaactcgtcatttagcattaggtatatctcctaaagctatccctcccccctccccccaacccacgacagtccccagagtgtgatgttccccttcctgtgt

SEQ ID NO: 472224 - DNA, 702 bp, Homo sapiens
aagaaaaattcttctgccttgggatgctgttaatctataatcttacccccaaccctgtgctctctgaaacatgtgctgtgtccactcaggccaaggttggtctggacctccaggactcaagcagtcctcccccatcagcatcccaaagtgctgggattacaggcatgagccactgcacccagccctttttttcctcctttgggaatgttattcatcttatagaaatagatgtgaacataattaatgccaacattgctttcacttatctcacaggccagaggaagtttctagttgttcattgtggagcagtagaattctactttcccaaagaggtacatagacagactgctggcttcggtactggaacactaaatagtcaagctggctttgaattctcacgctgcccagcaacacatttgttttctcagagtctatttagcccagcacgagatgttatgataccactgagagccaagctgctacccagcaatgcaggatgtttgccacaacttccttaattacttcagttgtgcatatggctgagcatttactgtgtgcaaagaagctatgaggtatgaatcattttgtggctggacctacattttagtcttttttatgagcaagggaagtaggtaaagacatggtagatgagggggaaaaaagtaaattcacttaaaagggaaacttcactcaccaagaggt

SEQ ID NO: 472225 - DNA, 768 bp, Homo sapiens
tgaaggattcacatgctattatagttcttttcgaaggggtcttctgatcacagctgcttccaatgacatcatggattcatccttcacctgccggggacagatctgctggtatcagaagccaggcatggatttagatgccatcaatgatgttatccttctggaagcatgtatctaccacctgctgaagatctattgcatctaccacctgctgaagatctattgccgggagcagccctattacctgaacctgactgtgctcttcctgcagagttcctatcagactgagattaggcagaccctggacctcatcacagccccccagggcaatgtggatcttggcagattcactgaaaagaggcacaaatctattgtcaagtacaagacagctttctactccttctaccttcctgtagctgcagccatgtacatggcaggaattgatggcaagaaggagcacgccaatgccaagaagatcctgctggggatgggagagttccttcaggttcaggatgattaccttgacctctttggggaccccagtgtgaccggcaaagttggcactgacatccaggacaacaaatgcagctggctggtggttcagtgtctgcaacaggccactccgtaacagtaccagatcctgaaggaaaattcaggcagaaggaagccgagaaggtggcctgggtgaaggcactatatgaggagctggatctaccagccgttttcttgcaatatgaggaagacacttacagtcacatcatgggtctcatc

SEQ ID NO: 472226 - DNA, 1366 bp, Homo sapiens
cacagactaaaagttggctgatgtggtctgggaatgggtgggcaccatccaatcggctgcctcacggctagaccaaagcaggcagaagaaggcattccgacttgcactgagcgaacaccagcttctctctttccccagcttgcagatggcctatcatttagaggacttcatcttagagagaagaagaagaggaagaggaagaagaggaggaggaggaagaggaagaagaagaagaagaaagaagaagaggaagaggaagaagaagaagaaagaagaagaggaagaagaagaagaaagaagaagaggaagaagaaagaagaagaaagaagaagaggaagaagaaagaagaagaggaagaagaagaagaagaaagaagaagaggaagaagaagaagaagaagaagaggaagaagaagaagaaaaagaaaagacagtcattaacaaaaccctcctcccttataatattgtggatctcctaagcttgatgctactcagtgcgacacaaactgactgcgtgcacgtcatccatctgggcatgttcaacattaccctttccatggaattggagggcaaggaagatcatgtgaacatgatgtttatgttgcttgctgtgcctgtaagaattccaggcaatgagacagcctggttggcaaaacaaaaaacaaaaacaacaacaacaacaacaaaaaccaaccagtcagttattgatgtttgttcatgttttccttgcagtaactttttgaaaaacaaatgcttgatgctagtgggtaaaaacaaccattacgaattgatgaatcagggagacactgagtatccactacattgtcagcactgggtggatgcttatttaaaatccccctgattgattaactgatgatgcttgtttctatccactagtatcagtaagtgattttatagttccttaatatttttctgataaggaaataaattaaaatttgctgaaatttaatacagatataaaataagatagagtgtcgatatttaacattttatacttccaaattgtcatcaaaactgttgtgaataatatatcactagggagttcaccttttagatttgtgaaatagctaattgatgtataaagtacttcaataggcttcatgttatttatcttatttgctttgtgcattaactgtgctataataggatcaaggttcaactacatttgaatatatttcaaaaattcagttcataaattaacttcaatagctaaaataggagccattatatgtgacattgttaacatttaaatttgagggatggtaccaggatcttttttttttcatgattagggcaaactgctgcactgatcattttaaagtacattttaacattcaggaatcacc

SEQ ID NO: 472227 - DNA, 675 bp, Homo sapiens
agagaagagtaacaactccgaaaataatgactaaagtattgtctaatgtcaatttgtttcctggcactgctgcttctacatcttcctcttcatcatctggcactggtgcttggaatataacagtaaacaaagcagacaaaaatttgaccttcatggaatttacatatttggaaggggaagacagacttatctgcactgaacctccagaaattcatcaattacagttcaggttttcctacccaggtactggttttcatggaggtttctgcctgtgcatttctgctccagatgaagtgacaatttccaagctcctccctgacatgccagatcagaaactgaaagtcctaagcctcatattctgtgcgtgggtatgttcacatcctgcctgctccagtgcccccacctcacactctctttcccttccttgtccccttgtgagatttctagtttaaaataatctaaatataattattccttatgccctgtttttccctcacttttgtatccaaatctcttttcagacaacagaacaattaatgtctgataaggaagacaatgatgatgatcacttcaaaatgaattcaggattgtaatgtaaaattttagtactctctcacagtatggattctaacatggcttctaacccaaactaacattagtagctctaactataaa

SEQ ID NO: 472228 - DNA, 501 bp, Homo sapiens
agtgccacaataaacttgggaatgcagacatctcttcaatatactgattttcttcttttggagagtgacctttgtcttgtgatagtttttgacttaaagcctattttccctgatgtgagtgtagccacccctgctctcttttggttgccacttgtgtgtaatatctttctccacctgttcactttccatctatgtgcatccttaaatctaaaagacagagaacaagaacaagaagaagaggaagaggcggaagagaaagaagaggaagaagaagaagaagaagaagaagaagaaggagaaggagaaggagaaggagaaggagaaggagaagaagaagaagaagaagaagaagaagaagaagaagaagaagaagaagaagaagaaatactaataatgaaacaggagagtgtgtctgtgaaggtgtttttagcatgtgaatcagcagactgagtaaagaagatcctctctcaccaatgtgggcagacatcattcactgggaca

SEQ ID NO: 472229 - DNA, 623 bp, Homo sapiens
ttactactcagaagagaaactgcctgatactggacagcaaggatatttttttctcaaggaaaatgcttcagcttttgcccagtcagtatgatattggctgtgggtttgtcatagatggctctcgttattttgagccctttgaagttaagaacttgctgcattggaggggccaaggtattcccagtcccctggtcacaacactccaatgggtagtggtagccaaaatacttcatcgaggtgatggcagtggaatccatgttcattcacatgtgccagcagccatagcagcatggcagagtggtgcaaaagtaattgtggtttttgccattgaaagtaatggcaaaaaccgccgttacttttccatgaacctatgtgcaatgttaagaagacacttgacacaacagtattgctgtttgattaccagtattgtttctgcaaaatttgtggtgtgtatcacagtgcatgcaaaatggatttccacatacccaaaacaacatagaggcatgtcaaagaagacaggacattttaataaggaatgctgatgtcagtgtacactgaatcattgaagaaattcaaaaagagaagtgtcacatataaaacgaatatgaatgttgtattagtct

SEQ ID NO: 472230 - DNA, 1398 bp, Homo sapiens
catcaacgtgacctggatatgaaggaattaagattccttctacatgaagatcaaggaacttgcccagagcacagaggagatctaccacagccagagtttccacaactttatagggaaactggaaataaagaactttcaacataggatcctggccagcttggctgggagcccctccactgagcataacactgggctgaagatgtggaatggggttgttcttacccactgcttggcagagaagacattccgcttaactgtgctatctgcttgccaaggttaccacatcaggaaggtcagagagcctgttccagggatgtgtgctgaagtttgtagcagttgggtaggcatcagcctttcaacccagacaagagcaggaaaatggagtgctcctgagagttatttttcagaaaaggagcagctctctctgagagttctgaaagtggcttcctctagtctgatgtcacagtctccaaagttatcagaaatctatatttaagaacacctgttcaagtcctatagctgattataaaccacctttcaaaatggattaaaacaagacaaaaatggtctgtggatgacaaaacatcttaggacaaccacagtcaaaaacacgattgacaaagaaatttagttacctctgtggcacacaataatttaacacaacaattataattattactgatgacatatactgaggcatatcagaactatcagagtttttataattttggaacacataccaataacacatttatacaaatacagcccaaagaaaaacaccatttcatatttgacaatgctccatgtatgatttttatgccaaataagccaaatgtcactgccgcacttgtgcactattaatgttataaacccaattcttaaaccctatagacaaatatatttagtcttaatcagtttgaccataaggtaagattcttataaacctttataaccctttacaattttttgttaaagagcagatcataagcaggtttttgctgtaagaaaagcctgttgtacttttattccagtgtgtactttagaaaaaaaactgaataatgtccatttaactttagccaatatgttatgggcagaatttcttttacaaaaattttttttagaaactttccacaacttgcttaaaccttcagctttattctatttaacttaatcctttaaatctctacacttaggcaagaaatccgcattcccaattcccatgctttcttatcttttaccaaaagcacattctactgtccttacatgccttgtgccttgtgtgtaaaactttttttctttttttttttaatagtctcaaacacatgttacactgttaactcttactaaggttttcaccaaaagtaaaggttgctaagttcaggattttaattatgtact

SEQ ID NO: 472231 - DNA, 541 bp, Homo sapiens
agaaaggacaaggaggaggggcgagagagatttcctcccctggaacagtcatgcctcaggtctcagccaaagatctattggaaaggtgctcccctctatggcattttcttgccagtcaagaaggaaacctcaccctggaagacatgccaacgtttttccgtgttgtgattgctatataccattctaaggaagcaaataggacaggcaccactctcaggaaaggcaaatcagcagctgttagtcaatgtggaacaagagtgtgcctacatcagcataaacccaaacattcccacccaaaattgcctaagcagaacgccttactgatggtagatcaggttgttattttcttatggaacttgactttattaacccaggcaaggaatcttgagcagagcaaagaaagtgctactctacatgactctgatgggaaaactttgccgagatttgatgggcaaatttcagaaaaatccttccactcacactgcagctaatcccatatctcccagtacaggatttgcagtactatatttaaggcatctcc

SEQ ID NO: 472232 - DNA, 959 bp, Homo sapiens
cagcagcagcgccgatagagaagggctacctgagggccagttttgtcttttccagaatgccgtacagttgaaatcatacggtatatagactttgcaggtttttatgcggacatgttttttgactcctttgggcaaataccaaggagcaagattgctggatcatatggaaagaggcattaccatatcaaagcctttagccttcttgcatcacgacaaaaattcgaacttggtgtttgaagaacatgaaaaatgaggaggaataaaataatcatgagtctcctggtcattaactgcatgaagttgagctggtcacttaagccattcctaatatgtaacttgagagtatagtattagatattcagtaaattcccttcaaaattcatatttaatgcccccagttgattgaatggtgcccgcccatactgaggacagatcttccccactcagtctgctgacacacagactaatctccttcataaacactctcacagatgtaccagaaataatgctttaccaattctctaagtggtccttaacccagacaaagcacagagaaagggcaaatctccaaggccagggtgataagaaaagtttcacagagtggctggaatttcagctggaccttgaagagaagtttgttattaccaaccttcggaggcctacttctgtcaactcgtcaaagtcattctccatccagctttgttcctttgctggcgaggagctgcaatcctttgtaggagaagaggaacctcagctgcaggtctgttggagtttgctggaggtccactccagaccctgttgtcctgggtatcaccagcagaggctgcagaacagcaatattacagaacagcaaatattgctgcctgatccttcctctggaagcttcatcccagaggggcacctgcctgtatgaggtgtcttttggctcctactgagaggtgtctcccagttaggctaca

SEQ ID NO: 472233 - DNA, 939 bp, Homo sapiens
tggcccacctccaagaaaaggcaggctggcctctgtttaggtgttgtctgtgcttgcattcccaacgttgacatgaggaattatcaatgggttccggacataatcagccacacggcagagtgaattccaggagtgtaaataacaagagctgcctataaatctacctcagaagacaaagggaaaagcaaaactctgcccaggaagaccttactttacaaaccaggtgaccaaatttctaaaacatcattcccgtaatccctgatcaacagaaaggaagctctggaagcatgaatgctcaaccatatttaccagccttcctgtggtcatttgtctgagctccagctagtgaagtatgagtagaacggacatgcaccacttccagacctggcaccggcaaaccccccatggcaaccctccaaccctttcctcaacaactggaccacgctggaaaggactgaggatctagaggaggacagggctgtaatatggaaggagtttggtttctgaaggaccatgtagcaggccacctgcagggcgggaacatctttaataggtttggaatagcaagaaataaactgatggtaccttctggctgtcctcacaaggtagagggcaagtggtctctcttggacctcatttgtaagggcgctaatctcattcatgagggctccaccctccctcacctcccaaagtcccaatctcctaatacaataatcttagaggtgtgtgaatttgggggatatgcaaacatccagatcacagcaggctccctggagggcatgccctgggttagcataagcaaaggcacgaaggtgaaagaccataggactgttgcagaaacttcacatctcagtcctgttggagtatcaagaaatccaaccgaacaggtaagttgaggtcagattacagacctttcatgtcttaatgcttttaggtttt

SEQ ID NO: 472234 - DNA, 881 bp, Homo sapiens
caataactctcccaaacattgagttaagaagcatagtgccagaatgattttttgtgaggaaaatttggagcttcctggagacttgttaaattgttgtgaccaaaatgctgatagtgatatggacaatgaaatccaggctgaggtggtctcagatggagataaggagcttgttaaaaactggaccactccagctccagctgtggctaaaagagccccagatacatctcaggccactgctccagagggtgtaagccccaagccttggtggcttccatgtggcatttggcataagtctactgcaggggtggagccctcatggagaacttctactagggaagtgcaaaggggtaatgtggagttggagcttccacacagagtccccactggggcactgcctattgaagctgtgagaggaaggccactgtcctacagcacccagaatggtagatccactgacagcttgcaccgtgcacctcgaaaagccacaggcactcaatgtcagcccataaaagcagtcaagggggttgtaccctgtaaagccacagtggcagagatgtccaaggccttgggagcccattccttgcatcagtgtagtctgaatggagtgatgcagcaagtaggccctaactagatgctagcccctcaattttggacctcctagcctccagaaccataaaccagtacatttttgtatactataaattatcactttcagagatcagtttaagttgtttgaagagggtagaaggtagaagtgacaggctaaggagaacgtgtgtgatgaggaagttgaaggctttgattttgattggcagaagtaggctgtaattggaaaaaatatttagggtgagtggcagtgttttaaatgtaacttaatatca

SEQ ID NO: 472235 - DNA, 618 bp, Homo sapiens
taattccttctactctcatcaacttaattatgtgcgtcggagccaagcgcacagcatagcagtgttttctgtactgctgggaagcctgcaataagcagccgggaaaatgggcagggtctgtgaagcctctcaggatgatgccagaaggagagggagagatggggcatgtgcagcaggtagcaaagttctccgggaagacagactactggcaaatatctgggaaacaggggtgactggagggatagaaacaggggtgactggagggatagaaacagagagactggagggatggtttttggaactctggaaaactgaggctgccatcaaaaacttcagtccctactacagtcgtcagtactctgtggctttctgcaatcacgtgcgcactgaagtagaacagcaaagagatttaacgtcacagtttttgaagaccaagggaaagactatagacagagaaaagaaacagtacactggccccttcagcatttggagatcagaaaaaggagaaggatccagcaaaatggactaagaagaaacggtctatggagtaggagaaaaatcagaaaagcataatgtcccagaaggcaaataaaaaaggggtttcaaaattaagacctc

SEQ ID NO: 472236 - DNA, 715 bp, Homo sapiens
ccggaatgaaggacatgactgagtaataaggggactgtgtgcttaacagaagacatgactgagagtcttctgggtgatgcggatgaaatcacaggctgagatacagatagaattccaactcttcagtgcctcataccagcttggagccacatgctgctctgtcactcccatcccccagggaccagccttcccaaagggaggcagctggagatacaagactagacatcagtgtgatgttgatactagaaacagaaatttaggagtcattaatgctgaggtaaagatacaaactacaagaatggatgagctcaccaagagccatagtcttgtgagaaaactcaagggccatggcaaagctggcttccacatccatttcccttacaataaaatagagttgttactagggaaggggtccccagccataaactatattttccagctcctctggcatctagaggtgaccatatgtgctttccctattctctttttctcctggatgcagtaagaaagccacctgcaaatgggaaaaccactgtggactaatacatgattgagaaatagacttcttttgtggttgggcctttatcatttttgaatctacttgtgactaaaggtcagcctacaacaagaactcttgaagaatgccaggttgaaggtgaatagtacggcaaagaggatagacaagcaagatattacgttacggaaataagatggg

SEQ ID NO: 472237 - DNA, 1215 bp, Homo sapiens
atttggtttgaattgcttgacatgaccggtcttgggaacttgcccactccatttgagtggaagcgtggcctgatcacccatgggaatccagaccagttccggtacgtagacacttggttacagccagaccagttccggtacatagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacatagacacttggttacagccagaccagttccggtacatagacacttggttacagccagaccagttccggtacgtagacacttggttacagccagaccagttccggtacgtagacacttggttacagccagaccagttccggtacatagacacttggttacagccagaccagttccggtacatagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccggtacgtagacacttggttacagccagaccagttccgggcgtatcccgaaagcactgaggccttcctatcaaaaatccttaacccagtaacccgcggatggcccaaatgcattcaatctgtagcagcaactgttttgctaacaacaacaacaacgacaacaacaaaacacatgtaccacccctaaaatttccggtaaaccagcaccagcctgaagatcacgttctcatcaaagggtgaaaagaagaaaaactcgagccagcctgggaaggaccctaccttgtgctgctaaccaccaagactgctgtttgtacagcaaaaaaaaaaaaaaaaaaaaaaaaggatggactcatcacacccgagtcaagaaagcaccaccccctccagagtcatggcc

SEQ ID NO: 472238 - DNA, 528 bp, Homo sapiens
tgaaaggttactcatagacactatgttctttctcatacaccataagaaccgaacctctccctctatgcagttgcaccatcaatccccattacaacctctaatggctgcttcccttgctggatctctaggattttgggtgcaggactcctctttcagtacaccctctcaccttttcactttatatttccggttctgcctgacactaggtctcttctttttatgtggctcttccacctacatgtgcctacctgccaactggatggacacacgtactctagtcttccttacccccaaaatccagtttgcagatgggaatgaaaaactgcctgtccccctcatgacatcaacacaacaaaaaaaagtcatcccactaatccctttacttgtggaactgccggggcctcgatttacttgctgctgaaaaaggaggactctgtatatttcttaatgaagagtgttgtttttacttaaatcaatctggcctggtatatgataacatcaaaaaactcaaagacagctcaaaaactc

SEQ ID NO: 472239 - DNA, 550 bp, Homo sapiens
ttatcagactgtatagaggtgggaaggccaactgaggaattatgtctgacagaagggaagaaatgactgcagtggccttctcagaccctgtgggaaaagcctctacccacccagtgaaagtgtctacccagaccaagaggtattttagtttcctgactgaggcatggtttatcaataaaccaatagtgaacaggaaagaaggaaatatggggaaatggagtgaatgtcaggtggatcagagagatacagtcatgggggtcaggtgtggtatcaggaataatgtgggaggccggattgaagtctgggccaggaacaatggaactgtgggagattcaacaatgaagttggggagttttaagaggtttagaagcctggttgtcaatacccacaacagttatggagacaagggaaacaggcccttgaaaagcactattcacaacagccaagatatgggatctacctaagtgtccatcaacagatgaatggataaagaaaattcagtcttaaaaaagaaggacatcttgtcagttatgacaacatagttgaaacc

SEQ ID NO: 472240 - DNA, 920 bp, Homo sapiens
ctcatcatagtttcacaaaaggattattttctagtcaaaaagataaccacccaggtagaaatcaagagtgcagcagccatggccagccacattgtgctcaacaatggcaccaagatgcccatcctggggctaggcacctggaattcccctccaggccaggtaactgaggctgtgaaggtggccattaatgttgggtactgccacatcgactgtgcccacgtgtaccagaatgagaatgacgtgggggtggccattcgggagaagctcagggagcaggtggtgaagtcgtaccatgagaagggcctggtgaaaggagcctgccagaagatgctcattgacctgaagctggactacctggacctctaccttattcgctggccaaccagcttcaagcctgggaaggaatttttcccattggatgagccaggtaatggtaatgtggttcccagtaacagtaacattctggacacatgggcgggcatggaagagctggtggatgaagggctggtgaaagctattggcatctccaacttcaaccatctccaggttgagaggatcttaaacaaacctgacttaaagtataactcccccgacaggccctgggccaagcctgaggacccttccctcctggaagatcccaggatcaaggcgatcacagccaaacacaataaaactacagcccaggttctgatctggttccccatgcagaggaacttggtggtgatccccaagtctgtgacaccagaatgcattgctgagaactttaaggtcttcaactttgaactgaacagccaggatatgaccaccttattcagttacaacagaactggaggcatccaaagagcagatgaacaactgcatccattcttggtaacatttatgggaaactgagacttagaaatacttataattttttggaa

SEQ ID NO: 472241 - DNA, 891 bp, Homo sapiens
aaggttcatagtctcgtgggaagcccatagatgtggcccagtggtagcacctggagttgactaggaagtcagcaagcaaagggagggaaggaacgtgagcctcaggccctgtcgctcacccagacgccctctcccggcagaaacgtgcgggtttggtgccccctgctggcccttttctgacaaagacggacacccaaccacggagggcctgggagggccactgcaaagtgagcctctcaatggtcgtggacaacccaaaccacatcctctggcttgcattttgcatctccagccaggctgtgttcagtgctggcctgtggtggaatgaaacaactctcctcctttcccccttgccccttctcccagaggacaaagccagggaggaaggggacaacctgttaccatcagacctcagtgccagggaggcctggtgtgtgctgagccaggacagagataacagagcctctcacgggggcagttccaaggggaacatccatagacttccctcagagcccacgggaagcagactaagaaaaggaaggcctgaagcccagaaaccagcagccaaaggagcttcctctatggtggacagctggggctcgcccctgggagacactgacactgtcgcctgcagctctgaggagggaaggaggttgcaggattgctcctcaggcctggacaccaccccagcatgcactcagacttcaggcgaggggggcacagaggtgccagagactgagcatgggtctcatcgtcaccagcctggcacctcacacttctttttgtttggattaatcttgtagccaagagggagctgtggaggatctcacctggggagtaacatgatcagattgaggtttgcagaaaaaccactctggcagctatttgggg

SEQ ID NO: 472242 - DNA, 687 bp, Homo sapiens
tccccagcactgaggatggacgccaccctcgccctccggtgctcacagtctgcagcgcctgccaggagttctcaaaacccaatgcgtcgggctgccctggcgggaaccccgcatggccaggaactggcctctgcctacggtcggcaagaaaccggatgctcagccctggccttcaaggactggaatcctgccaagggccacaccaaggaaaggaccctccctgggagcccagccttgctcgtgggcttcgggactccagaatgtggctatggttctgtgatggccgccgagctgacggaggctgtagagtttcgactccggtctgggggctccaaggactgtcccgctccatgccctgcccccaccctggatgccaggaaggaagagaaacgccccgagctgcagagaggacagagagagggaaggaagaggaccagcatgttcgcacagggcacacagtggaggctcccgcccaggatggagggcaggtattccagggagcggcccccaaagcgactggagattttccacggctgctgggatgagggctgcgggggcctcctgtgtgctgtgcactaaatgttcttcaagagtcagacgccaggagcagctggaaacgtcaaattttctggttgttggaccagttcctcttattcttctgtgcatttaaaaattatcactgaattc

SEQ ID NO: 472243 - DNA, 1011 bp, Homo sapiens
gaagacagcccagatatcctcagacaagcacctccaggaggagcaggcctgaccactgtgccatcatcaaattcccgcagaccactgacaaattcccgcagaccactgagtcagccatgaagaagagagaagacaacacacttgtgtacattgtggatgttaaagccaacaagcgtcagatcaagcaggctgcgagaaagctcactaatactagtgtggtcaaagtccacaccccgatcaggctgatggagagaagaaggcccagcgctggcaatgctgtctcagcggggtgccagggacacagaccaggtcccgaggtgctccgccgccctcagagggtcgaccagatgcaccaagaagctccggggcttgtgtctgttgggtcatcctggcccaacctatggcggggccctggttccaggagggcacccagagaagagagcttcccctggctggtgcagcatttctctcgtgcactgttgtaccgcaacatggtactgacacctgatttggggtggttcttagagcaaaggcctactcagtgtgaagatgatgaggatgaagacctttatgaagactcagttctgcttaatcaataggaaatatattttctcttccttatgattctcttagtaacattttcttttctctagcttacttcattgagaatacagtatgtaatacatataacatacaaaatataagttaattgactgcttatgttatcagcaaagcttccagtcaacagtaggctattagcagttaagttttggggaagtcaaaagttaaacttggattttcagcaggaggagggttcattacccctcacccccatgttattcaagtttgcactggtccctacacacgatgtcactggctccatctaagcggagtcttattgtgaaaagagccgcacgcaagtgagtgaggtctgtccatcgtcagggcagttactacagtctgtcaatgagaagactcagaatctcatctcattgtgcagacagatgggag

SEQ ID NO: 472244 - DNA, 644 bp, Homo sapiens
ctctctcctcctgttctgacccctgcatgtcgaggcttcagcatgaaggcttcagacattcgctgcgtggcctcccagcttcatcattctttgatgatgggcattgaggcatcagaactcatggatatcacagttcctgtgtggagaggaagcttcagatggtgctcttgcacagacgggactgccattcccattttagtggatctcttaaaagttcgaatggctcctctaatgcctgatgtgaatggaacctttctctctgcttcagtcaagaatctggtgacaaagaagcttcatcctttcaatcttacaatttcaatctcctatctcaagaaagctcatttctatgtattaccagtgcatcctccacatgctcttctgcagttgttccttctgcgggaaatgatctctccttttaaagtacagaaagttcccaaatactccctcatcccttccctgacagcttcccttatcattaatatcttgcattagtgtgttacactaatgttgtaattgaagagccaatattgatacagtatggttaactaaagtccatagtttacattaaggttcgctgattgtgttgtacatttcatgggttttggcaaatatgtaatggcatatatccaccgtcataatatcct

SEQ ID NO: 472245 - DNA, 725 bp, Homo sapiens
acccgaaggaaccagtggaaccctttagggagtctttgatgagcatctgtttagcaaaatcttgattcatggtcccaaagattaaatggctgggcatagcaagtgctcaccaaattctgaacctttgcagtttagcaggctcatgtgacaagttctggtcagtgggctatgagcagacaggacctatgtcacttgtggatgagacagggaagactggctgggttccccatgagctcccttcctgcctgcgttcagaaggcgacctgtggccggcacacagcattggagaagtcgccggtgtgatgagaatgcccaatgtgccccaagcagccagggaatctctgccctacgcagttagcggctggggcttgaccacaatgcataatgagcgggcagcggctgagctgcagatgatgcctgctgctctggagtccacgctactgtccctcttttcccgggtaaagctggaagctgaactgggaaccccggggcaatcatcaagatgcagaatgtaaaaactaaggtacaaaaggaaacagaggttcagtcaaagaaagtgaccttgttaacgttagtgacctgcaactcgaaatccaggttgactaaattcaaaccctatatacctgttagaggcaatagtcactgaggaggacatctcaaagtctgccccccttttccactgaaggtgggatagtagcaacatttttctgattcaggaagggaaa

SEQ ID NO: 472246 - DNA, 697 bp, Homo sapiens
tgccaaaattgatataagctcatcagttaaaaaggtgagtaatgctgacagtaggcttcacctgctccttccccagaagtaactggtgttcagaggtggatctgtgtggagccctgtatggagtgggcatccggtacttcctagctggcctttgccagctgtttggctgccccagtttctgcccttcacagacatggcggccacctgaaaatggccataagagcaacacgttaacttcattcattcattcattaactgttgatgatatgcctagtacgagccccccattgtgttcagtgatggggacacagcaagctatgactgtctctgtctctgtggggcctctccccatggagacaccaccccctactcaggatggaagggaagacaaggagggtgatgttgtgagatggttactgattcctctaaagactcttaatcaggatctatagtttttccagaaagggatttttccgtggatataattttaagataaattggtaataaagattcatgaccaggaaacctatatagtaaagagaaataccatacattaaaagatgagtttatgaaagtcaaaggcaaactgaggttccttgtgtagaaagactttcaataaatctacaaagctcagttgagaacattcctctttggttatgctcttatttatctgttattttagaggttgataggcacc

SEQ ID NO: 472247 - DNA, 1777 bp, Homo sapiens
tttttttttttttttttctgagacggagccttgctctcggcttagcactatcccctcggtgaagactgagttttcagttcatgcgagatctgattgtttaaaagagtgcagcacttcctccaccttgctccctctcttgccactgatgtgcctgcttccccttcaccttctgcctggattgtaagctccctgagaacctcaccagaagcagatgccagcaccacgcttcctatacagcctgccaaaatgagctcctgaatttcacagacaaatccagacccctgtgtggaaagcctgcggtggtgttctccgtcttcccacaggactccctgcagccaggaattctaggggagcacctgacgcgaggtatacgcccagatggcctgaagtaactgaagaatcacaaaagaagtgaaaatgtcctgccccgccttaactgatgacattccaccacaaaggaagtgtcaatggctggtccttgccttaactgatgacattccaccgcaaaagaagtgaaaatggccggtccttgccttaactgatgacattacaccacaaaagaagtgaaaatggccggtccttgccttaagtgatggcattaccttgtgaaagtccttttcctggctcattctggctcaaaatcacccccactgagcaccttgtgacccccactcctgcccgccagggaacaatccccctttgactgtaattttcctttacctacccaaatcttataaaatggccccacccctatctccctttgctgactctctttttggactcagcctgcctgcatccagagctgcgcgaccatgcgagcggtgggcagaaggaaaggctcagcagcagggaggcttgcagacctggagccaacagatgctcccaggaactcgacctgcatagtagcaacgcaatgaggagccaggcccagcatgcagaagctagcctgctggggatgggcaggaggcacatgcaggaaggtttgtgcagcaggcagcagccgccaggcagcggggtggaggaaggagcagtacagaaagaagcagcacagacaaagcacagcgcctaagcaggtgcaaagtggctgccgccctggggcctgcctgctcagctctccagctctccggcctgtggcaaaattttgtgtgctccttatgtacaagcgacatcccagattaaatgaagaaaataaccctacaggacccacagccccagacaatgcaccttccttggacaacacaggccctggacagaatgctgaagaagacaagatccttatctgcagtagcgtgctttatgaaggtggtcgctttgagggtgacagaacattgagtttacataacgtagaaagcttacctgtcccagggattgccagtccaaaccggcactgccgatatacacgtgctgtttgtccacgatccagaaggaggactgcagccggcccttgttgtaagcggtcatgttcattggcgggcacatgtttctctgcctccagccatcctggaatagtaacatccaaaaaagagttgcagatcccagaggaggaacttgggtatggcagaatctgaatatctaaaatgggtagttaccctggcagaagcttattgttatctctaggttaaacactagtttctaggttaaaactagtttcataactagtgttatcaaaatggaatattagattctgaagaggtttaacaatggcgtgttcacatttacacattacacttgcacacgaggaagatgggaggaaatgagcaactttaaggagacaact

SEQ ID NO: 472248 - DNA, 610 bp, Homo sapiens
accacccggcttcactttatcaccaaagccacatgatttcctaagaatccaaggaaactcccaaactcagagtccagataagtttgatgaactatgacctccaggacaaatgcttctcgggcaccatcaggcttaagtccactccccgctctaagttctgtgtgtgtcctggagaaacagcagcactgtaatgaggccaaggctgtggatatcccacacatggacatcgaggtgctgaaaaaattcaaccagaataagaaactggtcaagaagctggccaagaaagtctctgatcaagcagatcccgtaagtcctcgcccaggcctacataaggctggcacgttcccttccctgctgatacacaatgaaaatgaagtggatgaggtgaagtccacaatcaagttccagatgacgaaggtgctgtgtctggctgtgactgttggccatgtaaatgttacagacaataaacttgtgtataacattcacctgactgtcaacttcctggtgtcattactcaagaaaaattggcagaatgtctaggctttatatatcaagcgcaccatgggcaagcccccagtgcctgtattaagacacattcgaataaattcta

SEQ ID NO: 472249 - DNA, 582 bp, Homo sapiens
agagctgaacacttaaaaataattaaaatggaattctccactttggcgctgctgacatttgaggcagtgctttgtgttactgaactggactcagcgggaacgagcgggaacgagcgggaactgactgaactcttgacagctgttcttattctcaatttcttcctgaggggcctggagtcacgcccacaggccaaatcttcacctttgcagccagttgcaaatcaaacaattgctgaagcttcaagccgctgcttcaccatatcctgccttttgaggccaaactactgtacaagccccagagagcctctttctgttgttcaggatgacaaaacctataaggggcttctgagcccccattcagaaagtaataagtgggaaggaaaccctatgtccctcatttgcctgaccatgtatggagctcagtctggcgttccagctgagatgcaatgtcttgtcagttccaataaaagaactctgagcccctacctaaggaacaggggctgaggaggttttgttaaatattttattaaccatgtaaagaagatttaacttacagaaaaatcattttttaaatggaaatag

SEQ ID NO: 472250 - DNA, 1000 bp, Homo sapiens
ttgagaaatcggatggttgccgggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagct

SEQ ID NO: 472251 - DNA, 1260 bp, Homo sapiens
gcacctcctctacttctctccggcctctccgtatttctgcttttcacccttcctctctcccgccggaccgaccgaagcagagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctctttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgtt

SEQ ID NO: 472252 - DNA, 1199 bp, Homo sapiens
gcattgtgaggttccatggtgtaatggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcagctgcctttgcatttattaaattttttctctattgtagaaagcctgctgtgctcagctccattggcttttctgggcaaccagcaagataaacctagcaggcaattacactaataaaagaaaaacacaaatggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacct

SEQ ID NO: 472253 - DNA, 1160 bp, Homo sapiens
gggcacatcaagaaagttgacaagatgattcaaccacaatgaagtggagtcagaattcacagcccctgagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggagctttgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaagacaaccactaatctactttttcaatatacagatgcacttgttctgggcacttcttctatatggaataacaaagtgtggcattttgcatctggttcttagcatattgttctcaagtttttttagcctgcattaatactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaacttttt

SEQ ID NO: 472254 - DNA, 642 bp, Homo sapiens
cttcaggaggccaaggtgggtggattgcttgatatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtatagtaatttgttaaagccaagagctcctatggaatgaagttagatgggaggggggcattgagtagtaaggt

SEQ ID NO: 472255 - DNA, 867 bp, Homo sapiens
actgttctctaaaggaggcatgcagagtactgtgagtgcctgtcaaagagagaattccacagatgtgaccctgagcctccaaagtttacagtctgatgaccaccactacctggaatgcagatacagataacagagtgaaagctcagtatcagttgatacaacactgggttgtatcaagctcatttcctaccaaggagtcaaggatacccaaacagtccccagaaaagaacaacttatcacagataaggccagaaggagggctgtttgggaaacattcctcctggggaaagaacaccttcccatgggctgtggaaaatgataagggaaagggctggcacatgcatatgtgggcagggagagaaggcccaaggggagcagcacagtggggagcaacccacagccttggggaaggcacggcaggagaagagcatggagaaaggggcaggggagctgtcagagcattgaccatcaccgtggttttcctggttcacaggcttcctgagggctcctcagaaacatgtgttagaaaagaaaagctttccggtctgtccagtctcctccatgaccacagtttctcacccacataccattgtctggcttggaatggatcctggaaggaggactcaagagaaaccatagaaacagacaacaggaagtaagtgtttctccttaaaaaaaactcaccaaaattcttacttgcttacatatgcataaagaaactctggaaacacgcataagaaagcataacagtccttatttctggacagggagaaagtggaaactgagctgatgggagacatagatgagggaaacgtttcaggctgtgcatctttgtatttttctggttttaaaaccatgtgaatgtat

SEQ ID NO: 472256 - DNA, 1108 bp, Homo sapiens
ctctcccctgagcacttgacaatgcacataagtctgatgaccaccactacctggaatgcagatacagataacagagtgaaagctcagtatcagttgatacaacactgggttgtatcaagctcatttcctaccaaggagtcaaggatacccaaacagtccccagaaaagaacaacttatcacagataaggccagaaggagggctgtttgggaaacattcctcctggggaaagaacaccttcccatgggctgtggaaaatgataagggaaagggctggcacatgcatatgtgggcagggagagaaggcccaaggggagcagcacagtggggagcaacccacagccttggggaaggcacggcaggagaagagcatggagaaaggggcaggggagctgtcagagcattgaccatcaccgtggttttcctggttcacaggcttcctgagggctcctcagaaacatgtgttagaaaagaaaagctttccggtctgtccagtctcctccatgaccacagtttctcacccacataccattgtctggcttggaatggatcctggaaggaggactcaagagaaaccatagaaacagacaacaggaaagatgctgtcatttctgagttatctttggagcatttctctccagtgtgtcagggtttcagagaaggctttcctaacattcaggctggctgtcagggtttcctaaaaaaacctccattcttggacatcgtggggaaggggcaatccatctaacagcaagaggaagagggggcctggagctttcattgtttcctgaactgattttcaatgcaacttactgtttttagccacaacttcacccttatttccaaaagtacctggtgccaccaattgctgagcatttgggggattctgaaatgtaaagtttctccttaaaaaaaactcaccaaaattcttacttgcttacatatgcataaagaaactctggaaacacgcataagaaagcataacagtccttatttctggacagggagaaagtggaaactgagctgatgggagacatagatgagggaaacgtttcaggctgtgcctctttgtatttttctggttttaaaaccatgtgaatgtatcactt

SEQ ID NO: 472257 - DNA, 595 bp, Homo sapiens
cctgaatcggttcatggcagattatggctgaggtggtctcagatggagatgaggaacttgttgggaactggagcaaaggttactcttgttatgttttagcaaagagactggcagcatttttcccccaccctagagatttgtggaactttgaacttgagagagatggtttagggtatctggcagaagaaatttctaagcagcaaagcattcaagaggtgacttgggtgctgtttaaggcattcagttttaaaaggaaaatagagcataaaattttggaaaatttgcagcctcacaatatgatagaaaagaaaagctcattttctgaggagaaattcaagcaggctgcaggaatttgcataagtaatgaggagttgaatgttaatcaccaagacaatggggtaaacgtctccagggcatgtcacagaccttggcagcagacccttccatcacaggcccagaggcttgggaggataaaatggttttgtaggcaggccccagggtccccctgttgtgtgcagcctagggacttggtgctctgcatccagctgctctagccatagctaaaagggtccaaggtataaatcgggctgtggct

SEQ ID NO: 472258 - DNA, 1098 bp, Homo sapiens
agatttacaagggggagaaaggatgccttcaaagccatcctgggccgcattccaccctcaggccgcgggttggacaaggttgatctacaccattggctctctgttctcaggtcttcaaactgtaccgctggcattcctccgtcttcagcttgcagaaggcaaatcatggggtatctcagcctccataatcatgtgttatgtgagctagagagtggacacccacagctggatcagcagtgggagaagccacaggagggtccaggagaggatggagcagtagcaggcccggccactacttccaccaatgaagtgtgtgtgagttacaagacggctgttgcttcacttccatcctccaagtctcccaccagaatctctctcatgggccaccttcacgggaaatatacacagaagggaattccaggacaggttgttcagctcagccaagttgacacattacaaggccaccacacctacattgaaccaacagctctggcccctgtgctgtcctattgcccattcagctttgggcagtccctggtgcctcctcatgcagagatgcaactgctttttgcagcttctttttgtgtcttagctctccaagagggaggatttgatgaattccacaccgctggcaaagagcaactgaaatcaccagtgcaacatcctgagaaattgaacttgccacctccttacacctgggggaaaatgtcaaatgtcctctgttacaatatctgaacagcttgtgcaattttatcaatagagaacagtctgcaatcggtttttttctagtttcctttctgttagctatttaagtgaattcattgtgtgatggttcacaataaaacaagaactctaagaacaatgtagtcagttcttcaataaaaactaaattattatacagatgctccttgacgtatgatggggtatacactgatgataaacccatcataagttgaaaatattgggattcgctatagtggtaaatgaaaatgatactgtacagagagtttgctatgtgtaccctgttatctcacccagcattcacaacctgtaaggtatgtatttttacccttgtgtacagcttaggacattgaggct

SEQ ID NO: 472259 - DNA, 556 bp, Homo sapiens
acttatcaaatgcctcaaaatatgtgtatttttgacccaatagttctatttatggagttttatcctaagatcataatttacaatatgccagataacttggatagaagaagggtcaatgtgctgttcttaatacctaaagaatggaaacagatccacatgcccatcaatagggaactgtttagaaatgttacagtaatccacacaaacgaaaactgttggcgacatattgagcagcttctgactcaaaggcaggacaagtcctccaaggaggcgagaatactcatcctgctatgtgactttcatcatggaatgagaatcttgccacatgggtgtcagcactccacagaaatgcctttcctgggttatgcttttatgttttacccttgacttccttctgggtttgaaatgaagagaccttttctaatgggtgcagcacaccaacatggcacatgtatacatatgtaactagcctgcacgttgtgcacatgtaccctaaaacttaaagtataataaaaaaaagacttcaaaaaaaaagaaaaagaaaaacaccttttct

SEQ ID NO: 472260 - DNA, 1250 bp, Homo sapiens
ctctcgtgagggcaacagtgaataatccttaccaatgcaccaccacccccagactggagagtgtgggaagagctgcctgggacgctgtgggtcgaggaacttgctggaatctctgccacggggcccagagctaccccgtgcatgacagagaaggacttaacgagtgaaggaggctggtctcctgcgtgtctttggacctggaaagggagaggaattataaatgactcagggagcacaaagaggggattatggccctggccgtgaaagggagcgagccggctgataatgcactgctgcagcctcggctcattccgctcatgcctttgaagatttccctgcagccagtggcgcaggaacacaaccccgtggacacggaagggcaccaccgcggcccctggcaggcctcacctgtagccgctgcgccctccccgcgggcaccgggctctgcatccaggaggctccaggaggcccaggggcctgtgattccccgcagctcggtccatgttagccgccccaggccctcctcgtgattccaaatagaggggagcgcggtgcccattccttgtttctttctgattgcttaccgcccgggccagttgcacagcatgcggccgaactgcggggtggttaaggagggacagcttatgaaaaagtatgagggcactgaaaaccaggaggttaaaggatttgcccaaggtcacacagctggaaaagcagaagagctagactgggaagggagggaaggagggagggagatagaagaaaggaatgaagagagggagggacagagagagggatggagggagaaggattttactccagatacaacagttggatgcttttggctgcaaaatggcttcccccatggtacccagatgactaccaacagcaatgggggaatgtactcctctgtttacatccagatggagagagtgagagaaagcatggatcaggggtcctgtccttcaggccgattggtcaactcggttcatactcgtgtgcctgtccctaggctaacacagttggtgaagcacacggcacggagcccgtatgtatcccccacacgagaagccagtaggcagtatctcccaggtgaagcacacggcacagaggccatatgcagcagatggtaaatgaccagcccttggggccattcttattatttgttaagccctgctgacatgtgggactaactataccttttaaactttacctgtgttggagagggaggggatgaagtgggaagggga

SEQ ID NO: 472261 - DNA, 625 bp, Homo sapiens
aagttcccttgtttctgactatttagggagagcgctgacaagtgaaatgatctggcctgttgtcatggcaatagcagcccttccgcagacatcgacggagagcccgtatgctgtgctagagactgtgaaaaaacgaagaggcaagccaaggcagacacgaagctcttatcggcacaaccccagattccggtcaagaaaagctcagcaagatcagagaggagttgtaatctctgataaacagatggggagacacggagggctgttgatggtggggcctgggaagagcctaagggattggatttggagaatggaattttctaggccaggtcaggctgcctcacagtgtgttagtccaagaagagcttttatgcgagaccagggatggatcctggcctgggggccaaagtttatagaacgtgtgtctatgtatgtctgtctacacatgtatgaagaactttacacgataagaaatgcaacattgctgagcaccctcccagagcctcagaagaatcctcaagtgagggtccctgaatcttaaacctcatttgctccatgctacctctagctgtgtaccagacacctcatccaaggccaaatgacttcactttgcttggcatggaaaaaa

SEQ ID NO: 472262 - DNA, 614 bp, Homo sapiens
tctgctgatcatacggttcaagcagcagggctgcctgcatcacaacctagacctgacgcagagccctttcttgctctgggccccactcaaagctgacagccttctatgtcacttggaaaatgtatcaaagtcatatttccaaggaggaaaatgctaccttcagaacccaaagaggcttaccaggtgatatgctgtcctcttatgttgggacagcagccgtgggccactgtgtccggccagagttttcctacttaaccttcactactacagtagttatcactccacaaactcacaaaccaagaaatcaatgtggggttctgccaaagaccaagtatatccattccgatgattcactgagactaagaaaattaccatttggtattaatgtgaacacagaccttgcatccaacaatcctgaacatgtccgagtatccctcttccccaaccagatgattacctcagacccaggttatccttcagttaatggattccaggtctgaaaactggcgcacatgtagaaactaataagggatcatgatgttttaatgggatggccgcccttggcctcttgatcactcattcttaatttcttttgaggtacagattgagcaata

SEQ ID NO: 472263 - DNA, 2202 bp, Homo sapiens
acagcttcgacacgtgcagggttatccaggagcagtgaggtttgggtccacatggtggaacagggctgccaactgcttctgcatttacatgccttcattttcagacacccagagagagactgacttcttttgtcagttgcagttcccaaatcctggggggagggctatgattggcccgtttggatcaggtgcccacctcttgaccaatggtcggtgccaaggcgccttgaaagggaacctgaagggcttgctgagtttactgccggctgcgatgtgttcgttcactggtttattcctgcatctatgcatccactccctcaacaaacacttcgagtgggcgaggcattgtctcgcaccgcgaacactgagctgaacggaaatgtggttctcacctcatgaagtttactaattctaccaggcaacccgccctctctgagctcatgaattttctggttgcactgatttaatggcttcactctctggctttgacacccccacagaagcgtgaagtccctcagattccacggcggtggggctgggagagcccaggtccggtgcgggccagagatccctgcgcgtcggcacgtgagcagcccctctgcggtctcccgtcctcacggagaggctattacagcagaagctccctcggccccctccccaccccctcgtagttgaggaggaagtgagaaagggcttggcttggtgcctggcacacagcaaccctccgtaaaaatgccagctattactattgctattgttgctattattctcacgacttctccatcttctgcaccacccacaggctgctttgctgtgaacacggggatgtggagaagagtgaatgagctagtgggatgggagcgactgagtgtgaaggttagggagggaaataaaacagcccacagccctgctgcactcagcaccttctccctgcctgcaaagtccttcctggcatctctggaaatcctgactgccccacgagtctcccacctcctcccctgtttctgcaccgccactgggattggtacttgcaacttgaatggctcttctcgtgtgctgccttctccagggcccactcatgcctgtggcttaactgcttgtccggcaggagtaagtgcttcagaaatactgagctcagtgaacctgctaaacacaggcaccccggtgagactctgccggatgatgacaaatcgtgttcacattaaccttgtgccctgaaggttgcctttggtgggaagaggcagagaagacactctatatcccaccaatttccttgaagtatcatcattccccaaacacatgagtgtgttcctagaccacagggtagcctgtaccaagtggtgatgggaaaatagttcttggatcatttcatctggcccctttggtttcatctgactttggttgtgtggtcttcctaagaaaggcaagtctagtttccaagacactagacctctttattatttctaggacatcaaggccatacatattccttgttactctaccagtcttgaaaaaaaatgaccctcctggaaattccagaaagccaagaaaccagaatattcctgttctgatgtaacttctaaacaattcataatatcaaattaagaaagacagctttttttgttcctttcttcctttcttttttttagtggaaaaagccccaacaaaatatccaagaatgtgggtttagagccatgtgatcttatccagagcacttgactacttggagtctccatttcctcttgtgtaaaacgaagataataattctgtcttggcttccttatggggacgctttcaagatgaataggataatgcatgtatctcccatagccctgcagccttatgcttcatcctgtcagtgcaatctttttaggcagggcccttggtagacacaaaagacatgtattgataaacattggcaaagggtcacaaaagggaaatactaggaaaatatggaataacagctctccctgggggcagatcagttggtagctgttacgaggtggatttcattctaagactggcaatggggaccatttggcaggaagaatgggaatgtaaagcacagaggggagaattccggggcctacacccgtccactcctccttcctcctcttacagagatgcctggtcccaggaacccaccctctcctgtcttattgtgtcataggaccctgcactatgcttgctacctctgtattc

SEQ ID NO: 472264 - DNA, 567 bp, Homo sapiens
aattactgccatcactacagggatatgaagtcagaggaggaagctaccagtggaggggctgcagttgttttattagcaacagctggtggcagtcccctgcctgaaccacccccccttctttttaaaaatgctatgcttgtcagatccagcttcttgagactggatggcaaaggatcatcaggaagtttgttgcgaagaaagcgcagacccctgctgttggctgccatgaaaaaagcagaatctggaacagtgccttcaacagaatacattaaactgaatgctcctaaacctattcaattcagccaagctggtggagatgcagacttgataccttaccatgaactcatcattaatccatccgctggctccctattgctaatcccttataggcaagactttgagactgtcccttcaagattcagagggtcatttctggccctctcctccactttttctacacactgatactctttcctattattcataaagcgatagatcataaacatgctcttaagcaagagtgctaatcaaccaagcagcactgccggtgagttggttcatattttg

SEQ ID NO: 472265 - DNA, 660 bp, Homo sapiens
tgctgtgaagatggaacccacgttatggtttaaaggacaatctatgtgcttaaaacattccagaaatgccataattaagctgttaaaaggatatcatatggagaatgacttatatgtgagaatgtataacatgggcttcatgggcagaagacatcaaaaaggtggggcttttgaatgggtggatggatggggtaagtggacaatgatggaggatggatgggtggataaatggatggatggatggattgatggctggatgcatggatggcagcagaatgctttgggaagaggtcgtgagcggcgtggaggaggaagtcgatctgaaatgcttgaggaggtggagaagaaaagccagagagagcggagagaccttgggaagagacggctggagaagccagacgtgagaatccagcgccccgctgccacctcggccacacggaggcatttcgcggagcctcggttccctcattagaaaaaccgaggggttgaactgcttcgtttttgaagttccttccagctctaaaatgtcttagttgtatgcaagccaaaataaacaaaaaatggtatcactttatgcatatgctcttctaaatatcccagtgggaaagcacgaagcctgtgtttccagctcgctgcttcagagatgccagttcacaagtc

SEQ ID NO: 472266 - DNA, 588 bp, Homo sapiens
gacaagtgggctgtggacgggacaaatggccacaggctatgagcgtaggcagtggaggagaccgtggcacagatgtcactggccattgggatcccacctgtatccagcctctgacctcagacaaaccgcctgctgacctcagcctttttttccccaaaatcatttatgtcagtgcctgtttgcaccagagcccaaaggagaaatcccctttctttaccccaaacctcttgagcttctggaaggcaagagcgcagcttactccatgcaaagccagtgccatgctcacgcgggcattgattaatgccgccaacactgtctgttctgttgtgatttctcttcctcaccaatctgccattcatgctcatattcatctgctttccctctttgaatttcagggcttagaggaaatctggaataaggtggttcttgggtcctgggaagtcaaactctgtgctgtctcatcctatcctccctggcttggagggcaggttcagtgtggaattgcctggaggccaaagatggactgggaccgtgcttctcaagcactaacggccacttccaccactcagggagcttagaagctcagac

SEQ ID NO: 472267 - DNA, 549 bp, Homo sapiens
aaggacaccagtcattggattaagaccacccgaattcagtatggcctcatcacaacttgattacatctgcacagaccttatttccaaacaagaaggtttcatctctcccaaatcttttcacaaaccttgcttataccccaatccaacccctgtcttcaacttgccccagcgtgaggtattggatcccagggcaacgtgcttccagagacccctcagtcagtgttacacccgatttaagccagaaagcatgagcactggagacaccgtctccaaatgcaatggatgcttttacaaagaggatcctcagaatggagaacactccatagagctaccagtggaagacacgcattcccctttctcatctagatctgggttcgtgtctcacaaccaggaaaaattagacacacagacatcaaagaagcaccttgctgtatccatcaaaacctggtggcagattaactgagtgtgaatgatctatctcagatagaatttgagcttcaaactagaagcaaaagcaagaaataaattgctaaactgtggaaagcattc

SEQ ID NO: 472268 - DNA, 582 bp, Homo sapiens
aataggctctggcaccatctacctcttcaactggctttaatcctcctctttcaatcatcacttcctggaggaagctttccctgagaacaggatgcaaacaactgctgctctctttctagactacagctccagactgcacactggaagcactaacataataattccagagcctggtagagtgacccagtgctctcttacacttcgatgctgccaaacatccacaaagcaggacctaactctacacaacaaagggataagtacagaagggaagtggatagagccctcctatggaagtggtgtagctctggcagaaagtgacaggttccccggatgtactaagacaaatacaatccagagagtggaagataaaccctataaagattcagagacctcccacattcatgagtttttggggatccagtggtctggggcatgccaggatattttctcttccaagataaagaatgagtactacatcttgcacctcctaccactaagaaagaagtacaattcttgggaagctttttcggatagtcaagtagcatatacccaacttgagaatactactccagctcactgatt

SEQ ID NO: 472269 - DNA, 659 bp, Homo sapiens
gaggcaaggctccagatgtgtcctgattggaggctcttgacatggggaagctgcaggagggcttagcagaagctgaatattctattttcctgctgaaacatggtgacaccaagaaagctgaagcccccaaactgacagagggtcccagtactggagtgactgtgtcagcagcctatgggtggagccacaccccagtgttgctggaagtgggcactgcatttgcctttggaaagaacaagatgcagaaggtggggcttggtcgtcagacagatgcagttcctagccctgcgcagaagatcatctggggccggtccctgatctttggtgaactgggcagaggggactcacaagcccacatctcccactgtggcccaagacacgaagacgctgcatggtgtcttctcagagcaggctgccatgggttactcccgctccttggtgatgaaaatccgtaagtggctgtcttagtccatttggcggctatcacaaaatatcataaactggaaagtttatagagaacagatatttatttctcacccttctggaggtggggaagtccaaaatcaaattgctggcagattgggtgtctgatttaagtttttggattaagtttcaaaaaacacagaaaagtacaaataataatataatgaatactgtgt

SEQ ID NO: 472270 - DNA, 537 bp, Homo sapiens
agtcccagtgcatggtagccccatgcagtgttcccagctgcctcccgcttcagcccagcttctgtgtcttccccgtgcccccagttcattctcagtgccttccctctgaaggtcttttaggagtgcgccagtcaacccagtcccttggtggcagctcttccacctggctgtgtctagttggccatcttgccctctctccctacttatttgtttgttctttcaacaaacacttattgaacaatgtcaggcagtgtaattataccctaccctccaaagctcttgcaaaggctcaggaatcaccaagatcaggtgcctctggaaatgaggtcgaggtgaaggttgaagcattggttgatggaggtgcacagtcagagaacaaaagccacaccctcattcttcacagcagcaagtcaatagataatgccaaaaactgactagtcatgatttattcagagatacagaggtataggatgagccccaaacatgtaaaatatgatgaagcgtgtgtacttgacaagtgtattggttataaacaac

SEQ ID NO: 472271 - DNA, 559 bp, Homo sapiens
agaaacttgctcacatattgtgatgatctctaagattttggtgcgcccatcacctgagcagtgtacactgtatccaacgtgtaatcttttatctctcacccccaccctttcctctgagtcctcaaagttcatcatatcattcttatgcctttacatcctcacagctaagctcccacttatgaatctagccacccagcagagctattggtttccgggctggtactggcggctgtctgcacagttctgtgatgtcaaccatcttcattcaggtctctcagccatggatagcagcagctgctccagtagaggtggcaggggagtgaaatggactcttgtttctggcaaacctccccaaggacctctgcaagacaaagtcagaaatggcttccctaaggacagagagagcccacagggctcttcctgctgcttcctctacccctgaattttgcttggctctcaaaatttgtctcaggtccagatgacagctttggaaaccaaaacagaaaaccaacacaacaaaacaacaatgacattctaaaggcactacctagtgacaatg

SEQ ID NO: 472272 - DNA, 597 bp, Homo sapiens
acgacaacaggaatttaaaggagtgtttatgccacattctgcatgtgtctgagatactcatctccactcctggcaagctgccttcctcctcccatcttctccctgaccccagtgcacaaagaccaaagctcaaaccaaatatccgactccattaaacttagtcaacatatgtgctctaagtctgacaatcagtgtactcacagggatggcctttggtccaacaaacaacttaaaacaccagatccacttcccgttgaccacggagatattgagaatatcttggaagtcatcgagccacatgcagtcagagacatgcagatcaaattgatggtatccatccttcaatcacagcccatgggtgataagaacaatacagcctggaatttatggagcagtcttggaatgaacaaggcctttaaacaagaaagttacatagaaaaagtttgataaatttgactacgtaaagaaatcttaaaaaaaaattatgactttaattatgtcgaaagccaaactacaaacttaggagaaaatatttgttgccaatgtgacagccaacaaatattcttttttctaaaaaaaaaaaaaaaaaaaaaaaaa

SEQ ID NO: 472273 - DNA, 1729 bp, Homo sapiens
gaccagcgctggaggaaatgcgaaggcagattcgttcttctacaacttccatgactttggtgaccaagtctctcaaatgtctgcgtccacactatggcaaactgaaggaaatgtatgagaacatggcccctggggagaatgagcattttgctgctgacatcatctctgttttggccatgaccatgagtggggagtgcgagtgcctcaagtatcggctagtaggctcccagaaggaattggcatcatggagtcatgagtatatcaggcacctggcaggagaagtggctaaggagtggcaggagctggatgatgcaaagaaggtccagcaggagccactgctcactctggtgaaggaaatcgtcccctacaacatggtccacgacgcagagcatgaggcctgtgaccttatggaaattgagcaggtggacatgctggagaaggacattgatgagaatgcatacacaaaggtctgcctttatctcaccagttgtgtgaattatgtgtctgagcctgagaactcagtcctactgcgttgtgccctggctctgagattggcactgatgcgcaatgacatggagctggtagaagacatcttcacatcctgcgaggatgtggtagtacagaaacagatggcattcatgctaggctggcatggggtgttcctggagctgagtgaagatgtcaaggagtatgagcacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgcaggctctgggaatgtgctgaaggtgcagcagctgctccacgtttgcagcgaacactttgactccaaagagaaggaggaagacaaaggcaagaaggaaaagaaggacaaggacaaaaaggaaacccctgctgacatgggagcacatcagggagtggctgttctggggattgcccttattgctgtgggggagattgaagtttcctataactccatttttgccatgggcatggtgggcagtggtaccaataatgcccgtctggctgcaatgttgcgccagttagctcaatatcatgccaaggaccccaacgacctcttcatggtgcacttggcacagggcctgacacatttagggaagggtacacttaccctctgcccctaccacagtgactggcagcttatgagtccagtggccatggctgggctgctcaccgtgcctctctctttcctggatgttcgaaacattattctaggcaaatcacactatgtattgtatgggctggtggctgccatgcggccccgaatgctggttacgtttgatgaggagctgaggccattgccagtgtctgtccatgtaggccaggcagtggatgtggtgggccaggctggcaagcctaagaccatcacagggttccagacacatacaaccccagtgtcgttggcccacggggaacgggcagaattggccactgaggagtttcttcctgttacccccattctggaaagttttgttatccttcggaagaaccccaattatgatctctaagtgaccaccaggggctctgaactgcagctgatgtatcagtgggccatgcatcctgctgccaagggtggacacagctgcagacttcc

SEQ ID NO: 472274 - DNA, 993 bp, Homo sapiens
gccagaccaattcttgtgctccatcggcttgcttctgttctcccccgcacacattcctgccgtctggaaggacccgaagcaaacgctgccctgcacgcacttccgaaagcgacatatctccctgcaggatcagtgacagggagacagctggccggcctcagaacgagctccgccccataaggactgcacggctgtcctgttagaaaagcaacggtgaggggctcctccccagctggtgcctttgtggggactttctcatcaagagtcattacaccgccagcgtggtggagtgacatatccatggggatttggggagaaataaaggagatccgtggcatggtttggatagaggaaataagagaaatgggacccaaaagccctttggtacccacgatgggactgaatggtggcactggaaaggagatgggaaaggcactgggaggagatgggaagagcagcattggcgagagggtcaagatggagtgggcaaagctcctggaactgcttcttggtgctggcggccttggtgaccttgagcacatcgaagcgcaccgtcttgctcaggggctggcactcgcccactgtgacgatgtcactgatctggacgtccctgaagcagggggacagttgtacggacatgttcttgtggcccttcttgaagcggttgtacttgcagatgtagtgcagtctcggcagatgacaatgatcctctgcatcttcgtcttggtcaccacgccagagaggacccaccctcgaatggagacattcccagtgaaggggcatttcttgtcaatgtgggcgccctcaatagcctcttgaagcccagactgatgttcttgtagtacaacggggacttctcctgccagtgtctcccagcaggaccctcttcttgttttgaaaggtgtctctttttattattatgaaataattctggcatataaaaagtatggagaacagtacaattagtaagcatgttcccataacctacattac

SEQ ID NO: 472275 - DNA, 651 bp, Homo sapiens
ctcggaggcggccatgacaggtcacgacaacgacacttgccaagagtcctacgatgctactcagcaatttctctccctgcttaccagaaaggaagaaagaaattccagaaaacaaattaagaaagaaaatgtgggtggaggacggatgacttactggtatctcctccacccatcctgtctcctgtccctactccgatcaccagtgagacgcctgaggtgtgggaggggctgtcaacaaaagcccagagaaagttctctgcttttcacggtccatttgcgtagatcaggcccaccggaaaaccttcctctcttaagaaccacagcaaagtctcttgcccctgtttacccctcgctccctctgtgtcccgacagaccccagtccttccccatgtggccctgtctggcctgctgtagcccctgtttccagggatctgtaagtacaaataacatcttccctcatgacagtcgtttccatgtctgcgtgccttaccatacctgattcagacacatttcaggtatccctgaaacacctttaatgaagtacctaatttatgcatatggctttgaaaatcactgggcagtaggaaggattgagaacaccagtataaataagactcaagcttggctgtcaactttttcagcattctggtc

SEQ ID NO: 472276 - DNA, 551 bp, Homo sapiens
ggccatttctgctcatacgagttattcaaagaatgaacaagagtgaatcatgcagggagaacagaggtgtctggtcatatttcaaaatggcccctcttcttgccctgccagaactaggagaggacttcttttcagatcatcaccgcaagaacctggcagagctcctggagataaacctcacagaagtaattttggcactctactcaagtttgtggtcctttcactctgaatcacaagcatgtgggggtgattccctgattgaggacaggggcatcttagctactttttgtgtatgttcattagggataagggactcacaagtgactaaagagacttacattgtgatatcatcttatatttctcatgaatccaatagaatctacgatacagataaggaaaccaaggttctgagaggttgtaagggccataacctggacttagagacttaaggctatttctatcaagtttgcattgatcaaatattcgtgctacaaatatcagctgtggtattggtattctgagggcagttatgagggaaaacgtttacactt

SEQ ID NO: 472277 - DNA, 599 bp, Homo sapiens
cagttgatactctgtaggatggatggaatcagctggaactgtcaacagattgctgcctcttcagcctggtgttctccacgtagccagacatcatccgtggtggctggtgttccccagcaagcatctcaagagaaccaggaggaaactgcaaggctttttctggcctggcactaaaggtcacacaaccttggaagctgcttctcagtgttttcctattgatgaggaggaggaggaggaagaagaagaggaggagaaggacaatgaatcacctagtttggcttcccttataaaatacaaagtagcagattccctgagagctgattccccaagggcttggagaatgagtgcttcagttgtgaaggtggatctgggcagtgccccacagtgtccactagagcagaagctgaaaacagagttcttccctaaagaccagaaaacgtatggccctgcttagccttggatttcagacttctatgttccagaactgtgcaagaataagtttctgtgggcttaaaccaccatatttgcagtcatttgttatggcagacttcggaaatgaataataagaagacaaagtggtatttattgaaatctccatc

SEQ ID NO: 472278 - DNA, 660 bp, Homo sapiens
gaaactgtggatagtgttgagccctatatatatatattctgttttctcctacacatatgtacctgaacagcaccaagggggaaggtgttaaaccattcaggagaaactgcccccatgattggataatcatcttccaccaggccctacctccaacgttggagattacaattcgacatgagatttgggcagggacacagatccaaaacatatcagacctaaaagcagtcatggagaccactaacaagcgcaaagcccctgagatgtgcgttcagggtgttcacaaaagagcaaagaggccgatgtggctggaagataaagcacagagtccatttgggaatctacggcaacaatatgtgcaagggaagatggtgaccaggaccaagatggtgaccaggaccgtgtggaagggcagggtgtggaggtcagaatcaggacttgagtttggagcacattatgcttttcatgtttattacacatcaaagtggagatttctagttggaaattagagagatagcctgtctttgggggtctttttcaatctctctatgtgcaatttacatagaatagcactaactgttctttgtagcgttttgatgaagacttttattttaacagtttctaaagctcattagtaaattaaaatgttaattctaataaaat

SEQ ID NO: 472279 - DNA, 1109 bp, Homo sapiens
gccattggagcgcactccttgacctcctcttccacttcaccaggctcgattatagtaggggtgtctgacacagacaggggatctgggagctctgggagacaacatagagacacttgccaatgagaggtgacagcgtgctggcagtccgcacagccctcgctcgctctcggcgcctcctctgcctgggctcccactttggcggcacttgaggggcccttcagcccaccgctgctctgtgggagcccctttctgggctggccaaggccggagccggctccctcagcttacagggaggtgtggagggagaggcgcgagcgggaaccggggctgcgcgcggcgcttgcgggccagctggagttccgggtgggcgtgggcttggcggccccgcactcagagcagctggccggccctgtcggccccaggcaatgagggcttagcacccgggccggcggctgcggaggatgtactgggtcccccagcagtgccggcccaccggcgctgtgctctatttctcgccgggccttagctgccttcccgcggggcagggctcgggacctgcagcccgccatgcctcagccttccccgacctccgtgggctcctgtgcagcccaagcctccccgaggagcgccgccccctgctccacggcgcccagtcccatcaccacccaagggctgaggagtgcggacgcacgccgcgggactggcaggcagctccacctgcagccccggtgcgggatccactgggtgaagccagctgggctcctgagtctgctgtaacactcactgtgaaggtccgcagcttccctcctgagccagcgagaccaggaacccaccagaaggaagaaactcagaacacatcccaacatcagaaggaacaaactccagacgcgccaccttaagagctgtaacactcaccgcgaggtgaatcttctgctgtggctattaaagtttactatgaaaaagaagcagaaagacatgctcctgtgcctgaacactgaagaggattgcaaaggccaaaggcaggaagaagttcaggggataggatggagaatgagcatagcaagttgctcctgaacttagtcctgtaataagtctgcagggcagaaggt

SEQ ID NO: 472280 - DNA, 994 bp, Homo sapiens
cccagggatgatcagctaaacatgatcaatgaggaacaaaaacataaagaaaccaacaacagcaatgctccgaaccccagtaaagaagggagtgaagggccagatgaggacattttacctctaacccttgaaaagaaggaaaacaaaggatacctaaaatctctgtttgaaatcttgattctgatgggaaagcaaaacatacctcttgatggacaggaggctgatgaaatcccagaaggtctctttactccagataacctaacctctgagagttactataaagaaatcctaagtgtcccaacagtggagcacattattcaggaacttaaagatataatcgcagaacagcacctccaagctcgtaaatgcttatctctggtaccctcagtcatgggacaactcaaattcaatacatcggaggaacaccatgctgacatgtatagaaatgacttacccaatcccgacatgctctcagccgagcttcattgttggagaatcaaatggaaatggggaaagacacagagcttctgtccaccatttatgaagccctccatctgcctgacatcaagttttttcctaatgtgtatgctaaatgacctattgccaaaggtcctgtgtatttctcctgtgatgaaggttgagaatgagcagtatgaaaatggacgaaagcatcttaaagcatacttgaggaacactttgacagaccaaaggtcaagtaacttggcttagattaacataaattttgatataaaacatgacctggatttattggtggacacatatattaaactctgtaacagaccttaatcatttcacatttattgggaaataaagctgagcatgtttgatatattttaaagatgaatatcatcttcctccagtattggttgaaaggatgaagataatgtaaatcatcaagcacagtgcttgatacataatggataaagcaatgtttatcttacctgcttcctttctttttctccaaaaggtcatc

SEQ ID NO: 472281 - DNA, 617 bp, Homo sapiens
taaaaataaatctatccataaaaataaccactagatgtgggaaaatggagttggcccccctggggcaagaaggaggacactgcctctggcatcagaagttcatagtctgcctgttctgctcagctctgagcaaaaacaaggcttggtccctgctgtgactactgtgaagagatactctggaagtatcagaggtcaagtatcttatactctggaagtatcaggggtcaagttccctgccccatggaagaagcctgcaataaaaaagaatacagctcgcatgcaagagaggcagacgagaaagctaaggaaagcctctaatctggttgtggagatatataaagcagataacaacagaataaagtatatgctgaagtctaaaactttgttccaggtgaaaaacccagtgaaagtttagcgaaggaaagctgaagatgggctggaagctttgcagaaggcttcttagagttgtgactagaacatcaaaggcatctgtgcatactgttaaatgaaggagtgcagaatttgacatgagaaaacccgaaacgggagggtataacaaattaatgccatttaaaaatagtttttggttaatggttgggctcaatagagctgaggaa

SEQ ID NO: 472282 - DNA, 1025 bp, Homo sapiens
tgtaaacatcccctccaccaagggaaaaacagcatggctgacagtggggaatctcatcagtgcagcaaggggatggaagcagcctcttgtacacattggtctccctgttccgtgtttcttctaaggctgagcagaaacatcttgaaagggcagttgctactgatccatgcttcatccgatgcctaccccactgtggagagcatcagggatgaggcctttcatggcgaattctactccaagcagaacgtagatcatgccttcctcatgagctttgccacaaagttctctgattacttcctgttaatagaggacaatgtcttttttgcccccaactttgtcacccacattcattcaagggtgaccaccatgaagtccaactcgtgggtgctaatggagttctccaatatgggcttccttggcaaactcttccacagcagggacctcccactcctggcccatttcctccttctcttctacaaggagaaaccccttgacagcctgatttctcatttccatacgctcctggtccaggaaagcccaatcctctgcagacctttcctattctactgcagggtctcctacactgcctttgatcacaagcagaaggccacagcacttcagaaaaagaatgccgatggtcccaacaacccgcctggagctgtcttcactgatatgcaggtttccgatgtgcatttcccctgggaggcctacactctggatgagtcattcttttggacacacaacattagtataggaaaccacctgacagtgattctgaaccatccagcaaacctgagcagggtgcaagtgatgacgggctccattgtggaatgggagctttagaagtcagtttggtgttttgggaagatcaaagttaggtactaggatgaacattcttttcctagctctgctattactgtctgtgtgatttttggctaattaacctttctgagtctcaatttctccatctgaaaaatggtaacactaataccactcatttcacagggctgatgttctatgatttg

SEQ ID NO: 472283 - DNA, 1021 bp, Homo sapiens
tttccttgcctccccagagatccttgaataaaaatggtgctctagacccatcatgcttctctggggttttatgaacttctagctgtcccaacttgagttgcacagttttaggctattcttcttggctgggaaatatacagaaagattctcccgggcttctcacagctgctgccaatccctcaccatccatgcttctcttgttgccaaggatccctcctcaccaatggcggaaagaggtggcccctgaggcgctcagcatttgccctgagacctgcattacaacccatacttgtctgaaagagtcagctctccccacctgggaatgcgagttgaaaaagagctctcccagaaagcctcaactccaacagatctgctcctggggtctccatgtgacatccagcttcccgctggatcgtgccattgagtttggtacagccgtcagctgccaggagcttctcatgaagcctcagtacctcccaggcctgggaaaaatgcaaggagacacgaaggagccatcgtctaaggcccatggcatccgggaattgagtgggcttggccaccaggtcgagggaaccttgagtgctgctggcagggcctctggcagttcgtgtggtaactgcagcgccaacccagggcaaaagagcccagtggcatgcactcacttcctctttcagctttgcaattcaaaggggtcacctggttcaatttatctaggttcattagggtctgtgacctcagaatcaacaaggcagctgatccagagaaatgctctgaccttaaaaggaatattggaggcaggaggaaacagaggaagcaagaagaatttcctggaaggtaattattgtaatataagcatacttcggagatattgcaggttccgttccagaccactgcaacagtgaatatctcaatcaagacccacagcttttttctaaccaaaagaataaatcgctgctgtgattgttttatgtaagagtgcaatttccatcttgccagtagactctctcccttgctgcctttg

SEQ ID NO: 472284 - DNA, 959 bp, Homo sapiens
aaggttactaaaggcttgctgtgtgccaggcactgtgctaatgctaacagcatgtgcaagtcagccatttttagatcctccatcagctcggccaacaaggaagggctggcactgaaggtggtcctgtccatgccaagggcagccttctgctgctgggcctcttcccgctgcttctccagctggagccagagctttgggcacaaccccaggccctctagatgccctggatctccaagtgccaatgcagggcctcgcttgcctgtgggtacagtcactctcaatgaatcattttgctgtctccataaagtcacaggtgaacaaaggcctttagatagtgtagggagagacaccagatccaaccggacacaactaaatgacatgcaacatttcattaccctgagtgggcagtccatgctaaaaccccagagtacaccagcaggaagtggaaatgggcagtcctgctgtttccaggttctggtgggcacctttccacatcctaaaccaaaatatgtgacatggactgtctggatttgttctgaagaggtgcttgatggagatacctcttactggtatcttacccctctgaatccacttcaccagatgcatgacatagcctgctatcttgttgtggagcttctcgctggggataatggcgatctcctcgcacacgcgcttatccgtgtggaagtcattgcccaggcgcgtgtagtacttttctgtgacgacctgggccgccttcttcacgaataatcttccattacatgaatataccatattttgtttatccactgggcttgtagaatttaaaacagcatcacttttagtacctaaagcatagtcaatttctgtcacgtaattaagataattatgtctttttaaaaataataataatttaggtatcttagcaaatgaagagaaaaaggaagagaagatatttaggaaaaacataggaaatttct

SEQ ID NO: 472285 - DNA, 660 bp, Homo sapiens
tctccaggatttaggagaggcaggaggaaagtctctgccagccatggttttcccttctcattgtgaagaactttcagtgtctctgattttgcctgtgtcccacctctcctctcctcaccctctcccaccaaacaatacaaatctccctcaaaacttaggagtacaaaaccttgcttgccttttggaaaaaaggagagaaaatactgagagcacaatacagatggctcttttttttttcttttggataattccacagcagagtctgctgcatggcaggggctgtagcaagccctttaccgatgaggaagtttggtctcttcagccccttcccttggagtatctgacccttaatccgcatctcactgtggggtcacaaccatcaacaagcctgggcacagtcaggatcagaatccaggtctttggactcaacccatggactgatgtttacaccacaatccctccttcaaatgcatgacgtgattttaaaaaaaaaggcaatggcagtaagaacagaaagtggttagggttggcaaacgcaaattattctttgcaggactatttcatgtactgcaagatgtctggtatcctgggccgcacccaataaatgcctggggtgtcctctaatcattgtgacaaacccaaaatgcctttcaaaatgtc

SEQ ID NO: 472286 - DNA, 646 bp, Homo sapiens
tttttctaaaagtttctgtaaaagtttcagcttctcttcattcagtatgatgttagctgtgggtttgtcatatatggcctttattgtattgagaggccagctgcctctatgctgccctattcgacttccaatcagccagctgcctctacactgccctattcgacttccaatcagccagctgcgtctacactgccctattcgacttccaatcagccagctgcctctacactgccctattcgtcttccaatcagccagctgcgtctacactgccctattcgacttccaatcagccagctgcctctacactgccctattcgacttccaatcagccagctgcgtctacactgccctattcgacttccaatcagccagctgcctctacactgccctattcgacttccaatcagccagctgcgtctacactgccctattcgacttccaatcagccagctgcgtctacactgccctgttcaacttccatttctagcaccatagtagttgccaaaaaatgtttgttgaacacataaattttttataataactcattaataaccgactggttagttggttgttctcagcactgaatcttgaccaacttgaatagtagatggttgaatatggtggctctaacatccttttcccaat

SEQ ID NO: 472287 - DNA, 681 bp, Homo sapiens
actgaaataaaactggcgtctgggaaacccggaggccagagcaactggtcaggcccaggggagaatatcgtattgggggaggagcgcaggaaaagtcacccaaaagccatgggaaaggttgtggaaatggggagtgctggtcccacccctttcagccaagcgcgtgacccagaactctgcacaatcacccacgcccacggcaaagcagatgaggctctagagcttgcaagtctttatctagggaactgcgtcatcctcctcggtcggacaccaggtggcagcaaagctccaactcatcagtcaccccaccctccgtccaggccgtcttctgacgcagaacttaaaaaagatactgcagattttccttctaaggaaggagctacccatacaaaactagcagctttagagagagccatagctaaaactgaaactcgaagaaggtttcctgaagaaggaggggtgtcaggcaattttttaaataccagaaagctgagcctaagatgcacttatgaggaatgggtgagtggaaaaggctccatcatcttgggagcttggcagacctaatttgaaacattgtctctgcatatctgagctgagatacttgacaaaatttttaaagcttattgagccttaactacctcatgtgtaggatgaggccccataatccttagtttgcagtgc

SEQ ID NO: 472288 - DNA, 1490 bp, Homo sapiens
agccggaatctcagaaagactgactgactgactctgacaggatccggggctgaaggaaggaggcggtgaccatggagttaggtgagctgctctacaacaagtctgagtatatcaagacggcatctgggaacaaagtcagtctccagtcagtgttgtgtggaagccagaacatacttctcaatcgcaagaccatgccaccattcaagaaattcagcaaaggtgttgaattctttcctttacatattggggaccatgtctttattgaggaagagtgtgtggtcaacgcagctcagattggttcttgcattcatgttggcaagaactgcgtgattgggtgccggtgtttgttgaaagactgctgcaaaattcttgacaacacagcattacctccagaaactgtggtcccaccattcactgtcttctcaggctgcccaggatgcttctcaggagagctcgtggagtgcactcaggagctgacgattgatgtcaccaagagctattatcagaagtttttgcccctgacacaaaatttactaacagatggaccatctggaggagttgtcttcaaatgctgtgcttacaccttatctgtgaccagtcactttgtaccattatccgtggaacacagaatcatctgttcccaacgctccagccccttggtcttgtgcatggctggatcccaccggaaacgggcctgcacagcagcagcaccctcctggtgtggaggttatgtagctggtgagctgctcacagccatacactgcccatgccgagcacctcccacacaggaacagtccgtcaccacaaattacttttataaccctagagaagaaagtctccttgtcctcagaatacttcctgaagaacaaccagatgggaaggaccttgattgggactctttccagtgggcttggggcagagggaatttaatggctcacatagctgaaaaggcagggctagattgggctttgggctgcatcccagaactccaaacagggatctgtctcttcggctctcagctctgctttcctttgagttggctttattctcgggctccatggtgtggccccacagcaccagttattggtaaaaagagctcccatttgctgacagaactgctggatttagttctcattggtccacacgaggaaggtatccagcctcaagtcatcactgtggccaaaagatggaatacactgagtggacaggcctggcatgtgtatccacagagactgagagttggtgctgatggtatggtggtggatgagattaccagaagaagggacaaatgggtgctgggcaggaaaaagcatcagctgcccagtttaggcctctcctctttccctggcgtcttcacttttcctccctatccctgctgttccttaccctctgcccagtctctcagtactcctggtcttgggaaggtgccttctgaggatgctcctggcacgggtacctgagcctggattagagggcagggggaggatgtc

SEQ ID NO: 472289 - DNA, 731 bp, Homo sapiens
acactatagaactctctggcactatgggcacttgcacatcccttaccttatttgatcctcctaagagccttgtaagggaaaacagcagggaagtaggggatgaaaggatggtatcacgtcatatagcccacagtcttccatcaagtcactcttggtcccttttttctctcttagcacccctccttttcaaagcaaaatgcattgtactctttatctcacccttacaattagaagagcaagtgttattgcttgcacatgccctggaatctcacaattcaactcaagcaatttatcaaagtatttcttccaaacaaataaatatagcatcttctccaaaaggaatcagtctgaatatttttcttcacctcattgtacccatatttgggattgatactgggacagagtctaagtgcacattggaagagttctcagtggagagtgatgaactcaatcacgtgcactcagcctcatgtaaatttgctttacttccatctacttccccttttcaggtattagcatgaaagagaggaccaaaaaaagggaaatttttccatgtcatttcgtatggtaagttaggaagtagaatattttgtgacagaacatgtttcttttaggcaaatatgctggacttgagcaacgtggttttcagccctcctgaacatgaagcgaggaggcatcctgcatcattcatccagcccccttaaattaaagccctccccatagaaagtctt

SEQ ID NO: 472290 - DNA, 681 bp, Homo sapiens
gcaactgggggtgtggcatcaaagcacaactggggctgacttggttttgttagtataaacaaccacgtccggagagccatgtgtctagggaaggctggtccccgggccagcccagggatggaggttgagggagttgacaatgatgttccaagccaatcaaagtggatgcagaaggaattaagagaaaccctgtccttcctgcccatgggaaagacttccctccctgaagcccaggcaagtgaagaaggctgtccaaggattgtaaagattggggatttgggcatgaagggaaactattggcatttcattcttcagctagtttctgcttttgaagctgactctatgacctgtgcttgtaccacacgaataaggaaaacagcattggaaaaaagatggtatgtgggacagtctgcccaagaaggatgccaagatgggctcttcaagttctcagttctagggaagcatggagagatgtactacacatgctcatactcctggccatcactgtggcagacagatgagattgggcaacctaaatatgttgataggctttggggtgtgtattagtccattttcatgctgcttataaagacatacccaagactgtgaagaaaaataagtttaatgaacttacagttccatatggctggggaggcctcacaatcaaggtggaaagcaaaa

SEQ ID NO: 472291 - DNA, 1040 bp, Homo sapiens
ttggattgttgctgtgtctgtgtggaaagagaatcccagcccgagttatgtttcaacaatgtgaagcaacgcaagaactggagaacagagaaaaaatagaaactattaagttttctgcagcagcaataggcagttgtatgcattgtgtggacttgcataactgtagatgtgacactgtccagaagcttccaggtatccttctgccaccaatcataccccttggtgttgtagcagctaagaaggatgaagctgcctccaaaaggctgcccaagagcaaagagcccctgctgtatcacagatgcacatcatgcatatcatgtacatgttctccagtgacgagaattcccactcactatggacaaaacctgagagatggcccacaatacaaaatactgcgctgggaagaaggaagtgctgccttgagattcagtagcttcttggggctacttggcactcctgttgcaaatcaggctccttgggaagactcttaactttttcgggccacagtgaacttacatagagaggcttttgtccatattatcctttcagccaaggaagaccactatgcttagcacacttggctctttcttgtacctgtagaatatgcgtaagtatgtttaatcagcagtgtcaaataattcatgtaaaacttcctacacaagtggcctaaaatagtgtaggttctgtctccaagagtctaatttacacctagaccttgaggagaatttgaattatatttcttaattttctgttatctaacccattctaatctcagagtgcccccgcgatattgaatggctcagaaataagtcagctgaattcaggcatagtaaaaaaatttttttttatttgataagcatttattgagggcttccatattccagaaacagctttgtattagtgataacacagtattcagtgtgcaaatctagggaatggttggtgagggtagtgagggctgtgaagagggtgctaccgtcagaaatcagcatttaaggggggtcaatcagtgcacaattttgtgggtaaacctttgtgtt

SEQ ID NO: 472292 - DNA, 706 bp, Homo sapiens
tcaggaagatttcagggagatttctcagatggagaataggaggatagtttggaagggatactcttggagttgttggttagggatcagatttggaatccttctgtctgtctcatctttgtgtgtttttgtatatgtgaaggggacctctgaagaaattgcttatggaagtccagcagacttaactcagaacccccccttatttatctggtcacatttggtgatccctaaagaaagctcaacaggcctgtctcagggtggctattcgctcttcaccttgaccagagatcccaatgtgaattaccatctggaggtgatcccttcccatctggagtggatcaaagacaacagggaccaacaggagaaatggcttgaccctcacagctatggcacagcaagcagggtcatcaaaaactgctccattcttatggaagctgcagagaaagggaacctgaaaacctagtatgccggcagaaaggggtttgattaatatatttaaaaaaaaaaggatttgtgaggctagtcttaggctgtagcaaatctggtacactttgtgctaaaaatttgtctttatataatggagagagggatatcacaggatagaacatgggtttaggacacctacaagcctgcttttcaagccagcctggcaggctggtgaggtacaaactttgctgcaggactcccacaatgcagactgtggtccatt

SEQ ID NO: 472293 - DNA, 1157 bp, Homo sapiens
tgcctgctagtgagctgttagttacaaatgtatacatgtgccatgctggcgcgctgcacccactaactcgtcatctagcattaggaccctcagctgcaggtctgttggagtttgccggaggtccactccagaccctgtttgcctgggtatcagcaacagtggctgcagaacagcaaatattggtgaacagcaaatgttgctgcctgatcgttcctctggaagttttgtctcagaggagtacccggccgtgtgaggtatctctagctgtgtgctgggagaaccactgctctcttcaaagctgtcagacagggacatttaagtctgcagaggttactgctgtctttttgtttgtctatgccctgccgccagaggtggagcctacagaggcaggcaggcctcctggagctgtgggccgattccagctcattggggatccccactaccagaactgctccttggtgatcagagatgtgcagatggaggatacggcagtgtacttctttcgggtgaagagaggaagctttgtgagatacaatttcatgaatacattctttctggaactgacagccctgactcagaagcctgatgtctacatccccaaggccctagagcatgggaagccagtgacagtcatctatgtgtttaactgggcttttgaggaattgctcaacctcatacttagaccccaggaccatgacacctaccacacttgctgcatagacttctccagaacgggtgtgagtgcatggtggaccatccaactcttcgtggcttatacctctaggtaccttgttatcagcatttcctatgacaatgcaccaactgaattggcctcatcccatatttcctccaagaaatcagggcccatggaggcggtggttctggtggccgtcagggagggggctgtgaagatcctgcttctctgcatctgcttcaccttcctcagtgtcagtttttacaggaggaaggtgatgagggcagcagtgggtgtggaggctgcaaacactgtcacaggctaatccctcaggcctccagactgtgtttccagatgcctacttgtccagttcctccacaatctgaatggccatgtttcctctccattactggaggatgaggggcaaatgccacagactggactgaaggccttgcagggtcgg

SEQ ID NO: 472294 - DNA, 1476 bp, Homo sapiens
actaggcttaacgtctgagtgatgaaatcatctgtgcaacaaactccccacattcttcagaattttcctctgaaatggtgcacaggaggcacactggcttcccagctgttccgtgaacatgtgcgatatgttaccacctttgacacttggcactggctgctcctcggtcagaaggctcctcacccagacatctggaagacgaacaccttcacttcttttaaatcccgctggcagaagaccgacgatgaactctgtagacatagcatgtcttttatccttcacaaagccattcgcaatgacttctttcagagctatctctacctgctggaaaaaattcccctggtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttggggatgggtctctgtacttgaaatatcaaggtgcctttctgcaggggcctgggagagctggaacagactgcgccttggactgcggctccgggataggaagggtcagcaaacacgtcttattgcctgttttcaacagtgtggagctggtggatatgatggaatcctttctccttgaagcccagaactacctgcaggtcaaaggtgacaaagtagaaagctaccactgctacagcctgcaggaattcacaccccccttcaggagatatgatgtcatctggattcagtgggtctctgggcacctgactgataaggaccttcttgcatttctttcccggtgccgagatggcctgaaagaaaatggcatcatcatattgaaggacaatgtggcccgggagggctgtatccttgatctctctgacagcagtgtgactcgggacatggacatcctccggagcctaataaggaagagtgggctggtggtgctgggccaggagaagcaggatggcttcccagagcagtgcatccccgtgtggatgcatcaaacgggaattagagaaagcagcaggaaaaacgaaggcctttttaagttccatgagaactacggtttgcaagactggtcaaaacagtacaatgcaagcggcaagaatcaggaagtgcacagaaacaagaagctcggtgcacactgggatcaggcaagcatctgggagaagactgtagcaagactggatcctgaggagacaatccgaggatatgagcaatctgaagtccacagtttcattagaatgatggtcttcatgttctgagtttttttcctgcacttggtctattctgctattaatacttgtgattgcattgtgaagttcttgtagtgtgtttttcagctctaacatgctggttatgttcttctttaaactgcctgttttggctgtcagctcctgtgttgttttatcatgattctt

SEQ ID NO: 472295 - DNA, 573 bp, Homo sapiens
cgtcgcacagtcactcaccactccctttggacccttggctaatgaaagatgagcaccctgaacataggccctggtctggggcttggtgtgcaatgttcagatcatgctcttaccttagacttggagggctcagaagacaggaagatgtggaaaagtttggaacatcctagagacttgttgaatggcttcgacaaaaatgctgatagtgatatggacaatgaagtccaggctgaggtggtctcacatggagatgatgaacttgctgggaactacaatcccccacacagagtccccactggggcactacctagtggagctgtgagaagaaggccaccatcctccagaccccaaaatgatggatccactgacagcttgcaccatgcatctggaaaagctgcaggtgctcaatgccagcccatgaaagcagccaggctgagaattttgagcaggaaagtagaggagaatgactgaaaattaaagaacaagacaagctttatttttttgagaggaggagatatggacaagtgagggataggcatgtaaataagtaaacatgtcactgaagatggatgg

SEQ ID NO: 472296 - DNA, 869 bp, Homo sapiens
gagttaatgggtgcagcacaccaacatggcacatgtatacatatctgcccttttcacctcctttgtttgtttgccttcccagcagggcagctactcgactccgtccatccttatttacctccgtcctttactgtccccaacttggctcaatgatctctttctggcttcaaccctcatctctatggaggtggttccccaatctgtatctcagctcctgatccctttcctgagtagcttcctaaagcttgttgagcgttttaacccagatatagtcctaggatttcaaattcagcatatcaaaaacaaactcatgagatttccctcttacttggcttctagtcccaatcttccaaattctactaatgacacccttctctgcttaaaatgtgtcatccctgagctccccctttctctcatctcaccccatgcaagcaatccaaatgtctgtcacttccatgtactcttttccattcccacaaatgtcttatttcctctcatatacgcctactgaacactttctatttcacctatattttcaaattgattggtgtaattgctcatagcattctctcagtatgtcagtttctgctttatctgtagttatgtcccttttgtcattcccagtattgcttctttgtgccttgtctcttatgttctaattagtcgtgccagaagccacaagagcacagagcttcacggttcagatcttccaggtgtccctggttgaagactcccacctttcttatggctaatctgctctcttctccccacagtccctttctcttttaactcatcccttttctgatgtctttaacctctcttctattttccagaatgtgccacttcttcatcaaaaatcaagttctctc

SEQ ID NO: 472297 - DNA, 1564 bp, Homo sapiens
ataacttttcagtatttattgtaaacacagagactttatcaaaaacatgattacagccacatctcaagctggctgtgctgtccttattgttactgctcacatatacatcacagtagatgaatttgaagctggaatctccaagaatgggcagagccatgagcatgtccttctggcttccacactgagtgtgaaagaactaattgttgtcaatgttacaactgaaataaagtctgttgaaatgcaccatgaagctttgagtgaagctcttcctggggacagcatgggcttcaatatcaagaatgtgtctgtcaaagatgttcgttgtggcaatgttgttggtgacagcaaaaatgacccaccaatggaagcagctggcttcactgctcaagtgattatcctgaaccatccaggccaaatccctgttggcagtgcccctgtactggattgtcacacagctcaccttacttgcaagtttgctgaactgaaggaaaagattgattgccattctggtaagaagctggaaaatggccctaaattcttgaaatctggtgatgctgccatttgttgatgaggttcctggcaagccacgcatgttgaggactcctctgactatcctcctctgcgtcctttggctgttcgtaatgcgagatagacagctgccgtggtgtcatccaagtagcggacaagaaggctgctaggagctggcaagttcaccaagtctccccagaaagctcagaaggctaaatgaatattatccctaatacctgccaacccagtcttaacagttgtggaagaagagcctcaaaactctttgtttcaactggccatttaaaagactggctaatgataataatgcatcataaaacctttaaaaggaaaggagaatgttttgtgggccattttttgtttttttgttttttgcagttgcatgtggcagttttaacttattagttttttaaaaacaacttgaccaaaaatctgtcacagaatttgagacccattaaaacaaagtttaatgagaaaataactaaaaaagaaggtttgtaaataaaaataaaatacttcatcaaacctaagccataaaaatacatatttttccctgagtctttgggtcttcacttctgaaaacctccatatcatgtaaaacttctgttaaacaaatttgttatgcttttctcttgttaatctttcttgtatatgggtgagagaaagctattactttttctcttctgtaagttcaaaatatttattttatattgagacatagcagcaaatatttgtggatcagcacaagtctctggaaccaagtcttttggaaagagtggttgattaaagtatttttatttggccagtgccaaaaaataactataaaataactaattttcaaatatgtgctataaattagttctaaataaatataaatattgaaaataatttaggtttctaattagtctttccagactgcatcaacctagagaaggtatataagtcaccataagggaaacaagctgtttttactggttcggctctcatcttcagaattgttatccgtaatgacacttct

SEQ ID NO: 472298 - DNA, 586 bp, Homo sapiens
gagaaacaggaaaattctttgcaagtggttttggaaaaaggactgaatttggagtccggatgtgtaatttaaatcctagtgttatgaaaacaggtcgcaatccagaccccaagagagggttcttggacctcgcacaagaaagaatctggggcaaatggaaaaagacagaccaagggagccttgcccccacagctccccagcttgtgaatcaggattcacgtgtggctggttcatccagtgattcactaaacaaattaacaaaaatgaccaatgagcatagaattcagattttaatggatttagcaccaagcattgttcctttatatgtgcacacagaacacacactctgtgtctcagcattctcagctctcggaacactatgcaagtgtctgggagaagaaatcttgcacagcaatggcgataaagtctctcttcagccagtctttttctttggcgtatgtgtgtgtgtgtgtgtgtgtgtgtgtgtgtgtttccatccacttgtgcatgcatttactcatgtgtgtatacacatacaagtacacgcatatatacacttgatggataatttttgagcacttaccaa

SEQ ID NO: 472299 - DNA, 655 bp, Homo sapiens
cagatagcgactgcggaaacttccgttgaaggagccgtggctccagcagtgattgggtcagtgatcctgcttcccttgtctttccaacactgatgagatgtctgaggccaggaaccaaattctccttgtgtgtttggccttgctcaccatcttcttccctcaaactccaactttcacagggtgtggccctccaagggacagaacaaaacacctgtgtaatttatttccttctcctgctgttgactgtgacttacaccatcagagctctgattctcagaactacaccaccagctttcctgggtctccagcttgcagacagcagattgtggaagttagcctccataattgtttgactttcgaaccagctctcacttctaatacaaatgagggccttgcagctcaacagaggatgctctgcggaaaccaaacagccgttcaggacttgagggaaagcaggtctttaaacattgagcaccggttttttaatgggctgtcggcatatccccaatcggttctcagacctggagagatccctgacttgggataccctactccctagatgtgatggttacttttatgtgtcaactgggctgggctaagagatacccagacagctagtaaaatgttatttctgcatgtatctgtatattaatcc

SEQ ID NO: 472300 - DNA, 477 bp, Homo sapiens
caaagttcaaaatgatacgagaacaaaaaatgttaataaattttattgccaatttatttcaggaagtaagaagctctacagaggagtcagatcatatcacaaaaaagactgcctcactagaggttttccaaggcaaaccctttccctcaaattctgaatgcatgaatctagaggaagataactgtagaaaaggggcacatgctggcgagtatcagtgtcttcctgcactcatggtatggaacctcctcaagctgtggagtctcacccacagcataaccttgacctgcgatagcacccaccgtccaccaccaccctatagcaagggagataatgtgtttctggtcataattagtaagccaaagagggatgttccagatgtaagttttactgaggtttattgcatggtagaaggaaaagagccatgctttgacatcatgcatacctaggtttgatgcctgatgcctgatactgttcctt

SEQ ID NO: 472301 - DNA, 630 bp, Homo sapiens
tctcacaaccctatgggacagaaccgagtgtccatttcatctctggcagctctgggatgtgctgcttttagccaagctcttcccagggatgatagtcaaggaagagaaagtgaatctcagccctcatgtgaacggacagcagctcaagtcaaatcagttctgtcccacagggaatggcagctgagctcagtagccatgactgcactttccctgtggtcaccattgctggcagtactgtggccagttcctgcccaatccatcgaacattggcctccaaattgggcacagggtcctgttcttgaaacttcagagggtgaaggggaagctttcccttggcctatacagctttggtgccatgagcaggataccaaagcttctctgctagaagccacagtgaagggaaccagcaaagagtggtccacagaacgttggaccaactacggcatgaaagctctccatcagagggcaggactcctgataagctaaatttcacctttatattagtgtgttattaatgttaaacttaagtttaataaaaccttatagacatatttatccaatttttaatgtctgaccataagatttttatagactctttttaaccttttataatttttgttaatgagcagg

SEQ ID NO: 472302 - DNA, 534 bp, Homo sapiens
gggcagacaagatgacgttagaacaggaccagatcatattgggccttgtcagctccaggctacaaatgcacatgtactgtggacgtgggctgtcagtccacaacgctgtgtctagagagacttggaaaattcaagcctggttcgagagagcacggtcatgcagagcagaacgtggctgtggacatccaggagggaagagggcagccaggtcagccccagctggtgggttgagtttcgggcaacacagggaaagatccctggaggagggggcccgctggactgggcagggttggtgggaggggatctgtggctgcgccctgcatgaagtctggagagagactctaagaagaatacttggaaagcttgaactggccagttccaactactgtgctctaggtgagacattattgtccctgagctctgagcttttgcaagcaagaaagaaaggtttagaaaacaaaggggctatattgggtcctgtgactgaaaaggaagccagctgaacatcttccaggtctgtccgctccgatccat

SEQ ID NO: 472303 - DNA, 654 bp, Homo sapiens
aagtttctaagtttggccctgccatcttcccctttcccatgacccactctgctgtggctcagcagctgctgctcagacaaagaggtgccttctctgctggctccgtctgcaagctgaggaaacgagaagcctcaaaaccaggaagccaacagtgtggtctgcagttagtggtgaaggcctacgaacctcggcaagccacaggtgcagtcccagagtctaaaggccgaagaacctggagtctagatgtccacgggcaggaggagagcaagcaagcgtccagctcgggaagacagcaatccagaagatgcagcaagcaggttgatcccccttcttccccggctttgaaggactacctgatcccatgtaacaacctagaggaagagaagaaatctggccccaggccccttttgcatttgtcccttccaaaattcacttctttgttttccacttcatattgccatgtcgtgcctatgtgtgtatttggggcgagaggtggggatggcaagaggaggtcagaggatgccaggactagagcctaaatgcattgagggcagaggtttgtccactctgcctgtgtaactcgagcaatttgcctggccatagcaagagcttcgcaaatgtttgcgaaataaatcaagtattaagcacataaat

SEQ ID NO: 472304 - DNA, 619 bp, Homo sapiens
ctcccctgagcactcgagtttcagacccttgccatagaaatgggaaaattggcagcttcctttccgggtttctttgcagagtgttatgagatcttgtatatcaaagtatgcctgctacctgcagtctttgtgcctgcactgaggatgtatggattcccctgccaagtggaatctccaggttttttttatgttgcatcctcatctgggaagacaccagcacctggaaaagccagggtgctggggcactatctggtcaacacagacagctaccaggcctactctccagtgccctttcatctgagggccccacacaccgcacagcagccccacagacatcggattccacggcgcacatcagtgcataacgcattgcgtatttgccactccttaagccaacacctaagagaggggtttttggcatcagaacaccaccagttccctcctctgcctccttctgtcactctccctgcccttccattcccttcccaggctaagtttccatggtaccttttcagcctctgctgttaacaccatcctttcaaaatctaaaggaaatgagggctctttccctttaagtcctttttacaaacccctttctctcgattcacctggaaaattc

SEQ ID NO: 472305 - DNA, 1535 bp, Homo sapiens
ccgaggagccaagatggccgaataggaacatctccagtctacagctcccagtgtgagcgacgcagaagacgggtgatttctgcatttccatctgaggtaccgggttcatctcactagggagtgccagacagtgggcacaggtcagtgggtgcagtgcaccgtgcgccagccgaagcaaggcgaggcgttgcctcactcgggaagcgcaaggggtcagggagttccctttcctagtcaaagaaaggggtgacagacggcacctggaaaattgggtcactcccacccgaatactgcgcttttccgacgggcttaaaaaacggcgcaccacgagattatatcccgcacctggctcagagggtcctacgcccacggagtctcgctgattgctagcacagcagtctgagatcaaactgcaaggcggcagcgaggctgggggaggggtgcccgccactgcccaggattgcttaggtaaacaaagcagccgggaagctcgaactgggtggagcccaccacagctcatggaggcctgcctgcctctgtaggctccacctctgggggcagcgcacaggcaaacaaaaagacagcagtaacctctgcagacttaaatgtccctgtctgacagctttgaagagagcagtggttctcccagcatgcagctggagatctgagaaggggcagactgcctcctcaagtgagtccctgacccctgacccccaagcagcctaactgggaggcaccccctagcaggggcagactgacacctcacacgtccgggtactccaacagacctgcagctgagggtcctgtctgttagaaggaaaactaactaacaaacagaaaggacatccacaccaaaaacccatctgtacatcaccatcagcaaagaccaaaagtagataaaaccacaaagatagggaaaaaacagagcagaaaaactggaaactaaaaagcagagcacctctcctcctctaaaggaacgcactgttgggtacacctcccagacggggtggcggccgggcagaggggctcctcacttcccagacgggccggccgggcagaggcgccccccacctcccggacggggcggctggtcagatggggcggctgccaggcggaggggctcctcatttctcagatggggcagccagtcagagacgctcctcacctcccagacggggtggtggcggggcagagacactcctcagttccaagacggggtcgcggccggacagaggcgctcttcacatctcagacggggcggcggggcagaggcgctccccacatcccagacgatgggcggccgggcagagatgctcctcacttcctagacgggatgacggccaggaagagacgctcctcacttcccagactgggcggccgggcagaagggctcctcacatcccagacgatgggcggccaggcagagatgctcctcacttcctagacagagtggcacctgggcagaggctgcaatctcggcactttgggaagccaaggcaggcggctgggaggtggaggttgtagcgagccaagaa

SEQ ID NO: 472306 - DNA, 1027 bp, Homo sapiens
ctgtcaccatggctgcaggggcagttctagaactaggagctgtgaaatcaaccaggaatgaggcatgaccgtcaggaacccacttgaggaggcagtctgtcccttagcagagctcaagcgtggtgctgggagatccgctgctctcttcggagccaccagtcagggacgtttaagtctgctgaagctgtgcccgcagccgcccccgcccctcactccccaccccaccaccgcccccacccctccgccgccaggtgctctgtcccagggagatgggaattttatctataagcccctgactagagctgctgcctttctttcagagatgccctgcccagtgaggaggaatctagagaggcagtctggacacagccactttgccgtgctgcagtcagttcccccaaacttcccagcagcttccttaacacttgaggtgacgccccaccctgcttctgctcaccctctgtgggctgcacccaccgtctaaccagtcctacctttgtgctccttatgtcatcatttgttgtaatgtcagatctatgtttctcagctgatatcattttccttctgcctgaaagacatcctttagcatttcttgcagtaaagttctgctggtgatgaattctttcagattttttttctccccatctctttcaatatctttcagcctttttatgtctgctaaagcactttttttcctttcatttttgaaagggactccagttagatgtctattagactgcctgactgttcccctgtggctgtttttttaattctccttcttttgtctcattttagattgtttctattattatcttcaagttcactaagtttttcttctgtaacatcatatatgctgttacttctctccagtataagtatatttttatctcacatattattgtttcatctctaaaattagatttgggtctctattttgctttttgatggtatggaatacaactatcacaatcattttaatgtctttgctcattctaactctatatcagttatgattcagtttcagctg

SEQ ID NO: 472307 - DNA, 1258 bp, Homo sapiens
gcagtgccagaatgcatagttggcatagatgtacttagcagctggctccctgactgggagggtgagggctattatggtgggaaaggccaaatggaagccattagagctgcctctacctagaaaaatagtaaatcaaaaacaatatcgcatgattggagggattgcggagattagtgccaccattaaggacttgaaagacgcaggagtggtgattcccaccaaatccctcttcaattctcccatttggcctgtgcagaagacaaatggatcttggagaatgacagtggattatcataagcttaaccaagtggtgactccaattgcagctgctggaccagatgaggtttcattgcttgaacaaattaacacatctcctggtacctggtatgcagccattgatttggcaaatggctttttctccattcccgtccatgaggcctaccagaggcaatttgtcttcagctggcaaggccagccatatacctttactgtcctacctcagaggtatatcaatgctcaggctttgtgtcataatcttattcagaaagaccttgtttgctttttgcttccgcgagatatcatactagtccattacattaatgacattatgctgattggatccaaagagcaagaagtagcaaacacactggacttattggtgaaatatttgtgtaccagaagatgggaaataaatccgactaaaattcagggatcttctacttcagtaaaatttctaggggtccagtggtgtggggcctgtcaagatattccttgtaaggctgtaccaatgtcctcatggggagttccctatgatcagttgacagaggaagagaagactagggcctggttcacagatgtttctgcacaatatgtaggcaccatcttaaagtgaacagcttacagtactacagcgcctttctaggacttccctgaaggacagcagtgaagccaaatcttcccagtgggcaaaatttagagcagtgcacctggttgtgcactttgcatgaaagtagaaatggccagatgtgtgattatatactgattcatgggctgtagccaatgttttggctgtatggtcagggacttcaaagaagcatgattggaaaattggtgacaaagaaatttggggaagaggcatgtggatggacctctctgagtggtcaaaaactgtgaagatatttgtatcccatgtgagtgctcaccaatgggtgacctcagcagaggaagattttaataatcaagtggataggatgaccca
